United States Patent
Berka et al.

(10) Patent No.: US 7,494,798 B2
(45) Date of Patent: Feb. 24, 2009

(54) BACILLUS LICHENIFORMIS CHROMOSOME

(75) Inventors: Randy Berka, Davis, CA (US); Michael Rey, Davis, CA (US); Preethi Ramaiya, Walnut Creek, CA (US); Jens Tønne Andersen, Nærum (DK); Michael Dolberg Rasmussen, Vallensbæk (DK); Peter Bjarke Olsen, Copenhagen Ø (DK)

(73) Assignee: Novozymes, Inc., Davis, CA (US)

( * ) Notice: Subject to any disclaimer, the term of this patent is extended or adjusted under 35 U.S.C. 154(b) by 661 days.

(21) Appl. No.: 10/983,128

(22) Filed: Nov. 5, 2004

(65) Prior Publication Data

US 2008/0050774 A1 Feb. 28, 2008

Related U.S. Application Data

(60) Provisional application No. 60/572,403, filed on May 18, 2004, provisional application No. 60/561,059, filed on Apr. 8, 2004, provisional application No. 60/535,988, filed on Jan. 9, 2004.

(51) Int. Cl.
*C12N 9/42* (2006.01)
*C12N 15/57* (2006.01)
*C12N 15/74* (2006.01)

(52) U.S. Cl. .................. 435/209; 435/69.1; 435/252.31; 435/320.1; 536/23.2

(58) Field of Classification Search ........................ None
See application file for complete search history.

(56) References Cited

U.S. PATENT DOCUMENTS

| | | | |
|---|---|---|---|
| 5,589,381 A | 12/1996 | Neyra et al. | |
| 5,665,354 A | 9/1997 | Neyra et al. | |
| 7,018,794 B2 * | 3/2006 | Berka et al. | 435/6 |
| 2007/0015168 A1 * | 1/2007 | Bolotine et al. | 435/6 |

OTHER PUBLICATIONS

Sanchez, M.M., et al., 2003, Exo-mode of action of cellobiohydrolase Cel48C from *Paenibacillus* sp. BP-23. A unique type of cellulase among *Bacillales*, European Journal of Biochemistry, vol. 270, No. 13, pp. 2913-2919.*

Veith B., et al., 2004, "The complete genome sequence of *Bacillus licheniformis* DSM13, an organism with great industrial potential", Journal of Molecular Microbiology and Biotechnology, vol. 7, No. 1, pp. 204-211.*

Liu, Y., et al., 2004, "Molecular cloning of novel cellulase genes cel9A and cel12A from *Bacillus licheniformis* GXN151 and synergism of their encoded polypeptides", Current Microbiology, vol. 49, No. 4, pp. 234-238.*

Kunst et al., Nature, 1997, vol. 390, pp. 249-266.

NCBI submission of *B. Subtilis* DNA, 180 kb region of repliation origin, ID BAC180K, publicly available Jun. 2, 1999, at ncbi.nlm.nih.gov.

Claus, D. and Berkeley, R.C.W., 1986, In *Bergey's Manual of Systematic Bacteriology*, vol. 2., eds.

Sneath, P.H.A. et al., Williams and Wilkins Co. Baltimore, MD, pp. 1105-1139.

Eveleigh, D.E. (1981) *Scientific American* 245. 155-178.

Erickson, R.J., 1976, In *Microbiology*, ed. Schlesinger, D. (Am. Soc. Microbiol., Washington, DC), pp. 406-419.

Logan, N.A. and Berkeley, R.C.W., 1981, In *The Aerobic Endospore-Forming Bacteria: Classification and Identification*, eds. Berkeley, R.C.W. and Goodfellow, M., Academic Press, Inc., London, pp. 106-140.

O'Donnell, A.G., et al., 1980, *Internat. J. Systematic Bacteriol.* 30: 448-459.

Lapidus et al. 2002, *FEMS Microbiol. Lett.* 209: 23-30.

* cited by examiner

*Primary Examiner*—Nashaat T. Nashed
*Assistant Examiner*—William W Moore
(74) *Attorney, Agent, or Firm*—Robert L. Starnes

(57) ABSTRACT

The present invention relates to an isolated polynucleotide of the complete chromosome of *Bacillus licheniformis*. The present invention also relates to isolated genes of the chromosome of *Bacillus licheniformis* which encode biologically active substances and to nucleic acid constructs, vectors, and host cells comprising the genes as well as methods for producing biologically active substances encoded by the genes and to methods of using the isolated genes of the complete chromosome of *Bacillus licheniformis*.

7 Claims, No Drawings

BACILLUS LICHENIFORMIS CHROMOSOME

CROSS-REFERENCE TO RELATED APPLICATIONS

This application claims the benefit of U.S. Provisional Application No. 60/535,988, filed Jan. 9, 2004, U.S. Provisional Application No. 60/561,059, filed Apr. 8, 2004, and U.S. Provisional Application No. 60/572,403, filed May 18, 2004, which applications are incorporated herein by reference.

BACKGROUND OF THE INVENTION

1. Field of the Invention

The present invention relates to an isolated polynucleotide molecule comprising the complete chromosome of *Bacillus licheniformis*. The present invention also relates to features (genes) of the complete chromosomal DNA molecule of *Bacillus licheniformis* which encode biologically active substances and to nucleic acid constructs, vectors, and host cells comprising the features as well as methods for producing biologically active substances encoded by the features and to methods of using the isolated features derived from the complete chromosomal DNA molecule of *Bacillus licheniformis*.

2. Description of the Related Art

Microbes, which make up most of the earth's biomass, have evolved for some 3.8 billion years. They are found in virtually every environment, surviving and thriving in extremes of heat, cold, radiation, pressure, salt, acidity, and darkness. Often in these environments, no other forms of life are found and the only nutrients come from inorganic matter. The diversity and range of their environmental adaptations indicate that microbes long ago "solved" many problems for which scientists are still actively seeking solutions. The value in determining the complete genome sequence of microbes is that it provides a detailed blueprint for the organism revealing all of the biochemical pathways, substrates, intermediates, and end products as well as regulatory networks, and evolutionary relationships to other microbes. A complete manifest of proteins, both structural and catalytic, is encoded as a list of features in the DNA molecule comprising the genome, as well as their likely cellular location.

Knowledge about the enormous range of microbial capacities has broad and far-reaching implications for environmental, energy, health, and industrial applications, such as cleanup of toxic-waste, production of novel therapeutic and preventive agents (drugs and vaccines), energy generation and development of renewable energy sources, production of chemical catalysts, reagents, and enzymes to improve efficiency of industrial processes, management of environmental carbon, nitrogen and nutrient cycling, detection of disease-causing organisms and monitoring of the safety of food and water supplies, use of genetically altered bacteria as living sensors (biosensors) to detect harmful chemicals in soil, air, or water, and understanding of specialized systems used by microbial cells to live in natural environments.

*Bacillus licheniformis* is a gram positive spore-forming bacterium that is widely distributed as a saprophytic organism in the environment. Unlike most other bacilli that are predominantly aerobic, *Bacillus licheniformis* is a facultative anaerobe which may allow it to grow in additional ecological niches. This species produces a diverse assortment of extracellular enzymes that are believed to contribute to the process of nutrient cycling in nature (Claus, D. and Berkeley, R. C. W., 1986, In *Bergey's Manual of Systematic Bacteriology*, Vol. 2., eds. Sneath, P. H. A. et al., Williams and Wilkins Co., Baltimore, Md., pp. 1105-1139). Certain *Bacillus licheniformis* isolates are capable of denitrification, however, the relevance of this characteristic to environmental denitrification may be small since the species generally persists in soil as endospores (Alexander, M., 1977, *Introduction to Soil Microbiology*. John Wiley and Sons, Inc., New York).

There are numerous industrial and agricultural uses for *Bacillus licheniformis* and its extracellular products. The species has been used for decades in the manufacture of industrial enzymes including several proteases, α-amylase, penicillinase, pentosanase, cycloglucosyltransferase, β-mannanase, and several pectinolytic enzymes, owing largely to its ability to secrete sizeable amounts of degradative enzymes. *Bacillus licheniformis* is also used to produce peptide antibiotics such as bacitracin and proticin, in addition to a number of specialty chemicals such as citric acid, inosine, inosinic acid, and poly-γ-glutamic acid. The proteases from *Bacillus licheniformis* are used in the detergent industry as well as for dehairing and batting of leather (Eveleigh, D. E., 1981, *Scientific American* 245, 155-178). Amylases from *Bacillus licheniformis* are deployed for the hydrolysis of starch, desizing of textiles, and sizing of paper (Erickson, R. J., 1976, In *Microbiology*, ed. Schlesinger, D. (Am. Soc. Microbiol., Washington, D.C.), pp. 406-419.). Certain strains of *Bacillus licheniformis* have shown efficacy to destroy fungal pathogens affecting maize, grasses, and vegetable crops (U.S. Pat. Nos. 5,589,381; 5,665,354). As an endospore-forming bacterium, the ability of the organism to survive under unfavorable environmental conditions may enhance its potential as a natural control agent.

*Bacillus licheniformis* can be differentiated from other bacilli on the basis of metabolic and physiological tests (Logan, N. A. and Berkeley, R. C. W., 1981, In *The Aerobic Endospore-Forming Bacteria: Classification and Identification*, eds. Berkeley, R. C. W. and Goodfellow, M., Academic Press, Inc., London, pp. 106-140; O'Donnell, A. G., Norris, J. R., Berkeley, R. C. W., Claus, D., Kanero, T., Logan, N. A., and Nozaki, R., 1980, *Internat. J. Systematic Bacteriol.* 30: 448-459). However, biochemical and phenotypic characteristics may be ambiguous among closely related species. Lapidus et al. (Lapidus, A., Galleron, N., Andersen, J. T., Jørgensen, P. L., Ehrlich, S. D., and Sorokin, A., 2002, *FEMS Microbiol. Lett.* 209: 23-30) recently constructed a physical map of the *Bacillus licheniformis* chromosome using a PCR approach, and established a number of regions of co-linearity where gene content and organization were ostensibly conserved with the *Bacillus subtilis* chromosome.

It would be advantageous to the art to have available the complete primary structure of the chromosomal DNA molecule of the *Bacillus licheniformis* type strain ATCC 14580. With the complete chromosome data in hand, it should be possible to do comparative genomics and proteomics studies that can lead to improved industrial strains as well as to a better understanding of genome evolution among closely-related bacilli in the *subtilis-licheniformis* group.

It is an object of the present invention to provide an isolated polynucleotide with the sequence of the complete chromosome of *Bacillus licheniformis*.

SUMMARY OF THE INVENTION

The present invention relates to an isolated polynucleotide of the complete chromosomal DNA molecule of *Bacillus licheniformis* ATCC 14580 having the nucleotide sequence of SEQ ID NO: 1.

The present invention also relates to isolated features (genes) of the complete chromosomal DNA molecule of

*Bacillus licheniformis* ATCC 14580 encoding biologically active substances, selected from the group consisting of:

(a) a gene comprising a nucleotide sequence having at least 60% identity with any of the polynucleotides of SEQ ID NOs: 2-4198; and (b) a gene comprising a nucleotide sequence which hybridizes under at least medium stringency conditions with any of the polynucleotides of SEQ ID NOs: 2-4198, or a complementary strand thereof.

The present invention also relates to biologically active substances encoded by the isolated genes, and nucleic acid constructs, vectors, and host cells comprising the genes.

The present invention also relates to methods for producing such substances having biological activity comprising (a) cultivating a recombinant host cell comprising a nucleic acid construct comprising a gene encoding the biologically active substance under conditions suitable for production of the biologically active substance; and (b) recovering the biologically active substance.

The present invention also relates to methods for monitoring differential expression of a plurality of genes in a first bacterial cell relative to expression of the same genes in one or more second bacterial cells, comprising:

(a) adding a mixture of detection reporter-labeled nucleic acids isolated from the bacterial cells to a substrate containing an array of *Bacillus licheniformis* genes selected from the group consisting of nucleotides SEQ ID NOs: 2-4198, complementary strands of SEQ ID NOs: 2-4198, or fragments of SEQ ID NOs: 2-4198, under conditions where the detection reporter-labeled nucleic acids hybridize to complementary sequences of the *Bacillus licheniformis* genes on the array, wherein the nucleic acids from the first bacterial cell and the one or more second bacterial cells are labeled with a first detection reporter and one or more different second detection reporters, respectively; and (b) examining the array under conditions wherein the relative expression of the genes in the bacterial cells is determined by the observed detection signal of each spot on the array in which (i) the *Bacillus licheniformis* genes on the array that hybridize to the nucleic acids obtained from either the first or the one or more second bacterial cells produce a distinct first detection signal or one or more second detection signals, respectively, and (ii) the *Bacillus licheniformis* genes on the array that hybridize to the nucleic acids obtained from both the first and one or more second bacterial produce a distinct combined detection signal.

The present invention also relates to methods for isolating a gene encoding an enzyme, comprising:

(a) adding a mixture of labeled first nucleic acid probes, isolated from a microbial strain cultured on medium without an inducing substrate, and labeled second nucleic acid probes, isolated from the microbial strain cultured on medium with the inducing substrate, to an array of *Bacillus licheniformis* genes selected from the group consisting of nucleotides SEQ ID NOs: 2-4198, complementary strands of SEQ ID NOs: 2-4198, or fragments of SEQ ID NOs: 2-4198, under conditions where the labeled nucleic acid probes hybridize to complementary sequences of the *Bacillus licheniformis* genes on the array, wherein the first nucleic acid probes are labeled with a first reporter and the second nucleic acid probes are labeled with a second reporter;

(b) examining the array under conditions wherein the relative expression of the genes of the microbial strain is determined by the observed hybridization reporter signal of each spot on the array in which (i) the *Bacillus licheniformis* genes on the array that hybridize to the first nucleic acid probes produce a distinct first hybridization reporter signal or the second nucleic acid probes produce a distinct second hybridization reporter signal, and (ii) the *Bacillus licheniformis* genes on the array that hybridize to both the first and second nucleic acid probes produce a distinct combined hybridization reporter signal; and (c) isolating a gene from the microbial strain that encodes an enzyme that degrades or converts the substrate.

The present invention also relates to genes isolated by such methods and nucleic acid constructs, vectors, and host cells containing the genes.

DEFINITIONS

Biologically active substance: The term "biologically active substance" is defined herein as any substance which is encoded by a single gene or a series of genes (contiguous or non-contiguous) composing a biosynthetic or metabolic pathway or operon or may be the direct or indirect result of the product of a single gene or products of a series of genes of the *Bacillus licheniformis* chromosome. Such substances include, but are not limited to, biopolymers, metabolites, and cellular structures and components (e.g., ribosome, flagella, etc.). For purposes of the present invention, biological activity is determined according to procedures known in the art such as those described by Carpenter and Sabatini, 2004, *Nature* 5: 11-22; Sordie et al., 2003, *Proceedings of the National Academy of Sciences USA* 100: 11964-11969; Braun and LaBaer, 2003, *TRENDS in Biotechnology* 21: 383-388; and Kaberdin and McDowall, 2003, *Genome Research* 13: 1961-1965.

In the methods of the present invention, the biopolymer may be any biopolymer. The term "biopolymer" is defined herein as a chain (or polymer) of identical, similar, or dissimilar subunits (monomers). The biopolymer may be, but is not limited to, a nucleic acid, polyamine, polyol, polypeptide (or polyamide), or polysaccharide.

In a preferred aspect, the biopolymer is a polypeptide. The polypeptide may be any polypeptide having a biological activity of interest. The term "polypeptide" is not meant herein to refer to a specific length of the encoded product and, therefore, encompasses peptides, oligopeptides, and proteins. The term "polypeptide" also encompasses naturally occurring allelic variations.

In a preferred aspect, the polypeptide is an antibody, antigen, antimicrobial peptide, enzyme, growth factor, hormone, immunodilator, neurotransmitter, receptor, reporter protein, structural protein, transcription factor, and transporter.

In a more preferred aspect, the polypeptide is an oxidoreductase, transferase, hydrolase, lyase, isomerase, or ligase. In a most preferred aspect, the polypeptide is an alpha-glucosidase, aminopeptidase, amylase, carbohydrase, carboxypeptidase, catalase, cellulase, chitinase, cutinase, cyclodextrin glycosyltransferase, deoxyribonuclease, esterase, alpha-galactosidase, beta-galactosidase, glucoamylase, glucocerebrosidase, alpha-glucosidase, beta-glucosidase, invertase, laccase, lipase, mannosidase, mutanase, oxidase, pectinolytic enzyme, peroxidase, phospholipase, phytase, polyphenoloxidase, proteolytic enzyme, ribonuclease, transglutaminase, urokinase, or xylanase.

In another preferred aspect, the polypeptide is a collagen or gelatin.

In another preferred aspect, the biopolymer is a polysaccharide. The polysaccharide may be any polysaccharide, including, but not limited to, a mucopolysaccharide (e.g., heparin and hyaluronic acid) and a nitrogen-containing polysaccharide (e.g., chitin). In a more preferred aspect, the polysaccharide is hyaluronic acid (hyaluronan).

In the methods of the present invention, the metabolite may be any metabolite. The metabolite may be encoded by one or more genes, such as a biosynthetic or metabolic pathway. The term "metabolite" encompasses both primary and secondary metabolites. Primary metabolites are products of primary or general metabolism of a cell, which are concerned with energy metabolism, growth, and structure. Secondary metabolites are products of secondary metabolism (see, for example, R. B. Herbert, *The Biosynthesis of Secondary Metabolites*, Chapman and Hall, New York, 1981).

The primary metabolite may be, but is not limited to, an amino acid, fatty acid, nucleoside, nucleotide, sugar, triglyceride, or vitamin.

The secondary metabolite may be, but is not limited to, an alkaloid, coumarin, flavonoid, polyketide, quinine, steroid, peptide, or terpene. In a preferred aspect, the secondary metabolite is an antibiotic, antifeedant, attractant, bacteriocide, fungicide, hormone, insecticide, or rodenticide.

Isolated biologically active substance: The term "isolated biologically active substance" is defined herein as a substance which is at least about 20% pure, preferably at least about 40% pure, more preferably about 60% pure, even more preferably about 80% pure, most preferably about 90% pure, and even most preferably about 95% pure, as determined by SDS-PAGE, HPLC, capillary electrophoresis, or any other method used in the art.

Substantially pure biologically active substance or pure biologically active substance: The term "substantially pure biologically active substance" is defined herein as a biologically active substance preparation which contains at most 10%, preferably at most 8%, more preferably at most 6%, more preferably at most 5% by weight, more preferably at most 4%, at most 3%, even more preferably at most 2%, most preferably at most 1%, and even most preferably at most 0.5% by weight of other material with which it is natively associated. It is, therefore, preferred that the substantially pure biologically active substance is at least 92% pure, preferably at least 94% pure, more preferably at least 95% pure, more preferably at least 96% pure, more preferably at least 96% pure, more preferably at least 97% pure, even more preferably at least 98% pure, most preferably at least 99%, and even most preferably at least 99.5% pure by weight of the total material present in the preparation. The term "pure biologically active substance" is defined as a biologically active substance preparation which contains no other material with which it is natively associated.

The biologically active substances of the present invention are preferably in a substantially pure form. In particular, it is preferred that the biologically active substances are in "essentially pure form", i.e., that the biologically active substance preparation is essentially free of other material with which it is natively associated. This can be accomplished, for example, by preparing the biologically active substance by means of well-known recombinant methods or by classical purification methods.

Identity: The relatedness between two amino acid sequences or between two nucleotide sequences is described by the parameter "identity".

For purposes of the present invention, the degree of identity between two amino acid sequences is determined by the Smith-Waterman Protein method for the Genematcher2, as implemented by Paracel Inc. (Pasadena, Calif.), or the BLASTP method as described by Altschul et al., 1990, *Journal of Molecular Biology* 215: 403-410.

For purposes of the present invention, the degree of identity between two nucleotide sequences is determined by the Smith Waterman nucleotide method for the Genematcher2 or BLASTN for the BlastMachine as implemented by Paracel Inc.

Polypeptide Fragment: The term "polypeptide fragment" is defined herein as a polypeptide, which retains biological activity, having one or more amino acids deleted from the amino and/or carboxyl terminus of a polypeptide encoded by any of the genes of the present invention, i.e., polypeptides of SEQ ID NOs: 4199-8395. Preferably, a fragment contains at least 80%, preferably at least 85%, more preferably at least 90%, even more preferably at least 95%, and most preferably at least 97% of the amino acid residues of the mature encoded polypeptide product.

Subsequence: The term "subsequence" is defined herein as a polynucleotide comprising a nucleotide sequence of any of SEQ ID NOs: 2-4198 except that one or more nucleotides have been deleted from the 5' and/or 3' end. Preferably, a subsequence contains at least 80%, preferably at least 85%, more preferably at least 90%, even more preferably at least 95%, and most preferably at least 97% of the nucleotides of any of the genes of the present invention.

Allelic variant: The term "allelic variant" denotes herein any of two or more alternative forms of a gene occupying the same chromosomal locus. Allelic variation arises naturally through mutation, and may result in polymorphism within populations. Gene mutations can be silent (no change in the encoded polypeptide) or may encode polypeptides having altered amino acid sequences. An allelic variant of a polypeptide is a polypeptide encoded by an allelic variant of a gene.

Substantially pure polynucleotide or pure polynucleotide: The term "substantially pure polynucleotide" as used herein refers to a polynucleotide preparation free of other extraneous or unwanted nucleotides and is in a form suitable for use within genetically engineered production systems. Thus, a substantially pure polynucleotide contains at most 10%, preferably at most 8%, more preferably at most 6%, more preferably at most 5%, more preferably at most 4%, more preferably at most 3%, even more preferably at most 2%, most preferably at most 1%, and even most preferably at most 0.5% by weight of other polynucleotide material with which it is natively associated. A substantially pure polynucleotide may, however, include naturally occurring 5' and 3' untranslated regions, such as promoters and terminators. It is preferred that the substantially pure polynucleotide is at least 92% pure, preferably at least 94% pure, more preferably at least 95% pure, moire preferably at least 96% pure, more preferably at least 96% pure, more preferably at least 97% pure, more preferably at least 98% pure, most preferably at least 99%, and even most preferably at least 99.5% pure by weight. The polynucleotides of the present invention are preferably in a substantially pure form. In particular, it is preferred that the polynucleotides disclosed herein are in "essentially pure form", i.e., that the polynucleotide preparation is essentially free of other polynucleotide material with which it is natively associated. The term "pure polynucleotide" is defined as a polynucleotide preparation which contains no other material with which it is natively associated.

Nucleic acid construct: The term "nucleic acid construct" as used herein refers to a nucleic acid molecule, either single- or double-stranded, which is isolated from a naturally occurring gene or which has been modified to contain segments of nucleic acids in a manner that would not otherwise exist in nature. The term nucleic acid construct is synonymous with the term "expression cassette" when the nucleic acid construct contains the control sequences required for expression of a coding sequence of the present invention.

Control sequence: The term "control sequences" is defined herein to include all components, which are necessary or advantageous for the expression of a biologically active substance of the present invention. Each control sequence may be native or foreign to the polynucleotide encoding the substance. Such control sequences include, but are not limited to, a leader, propeptide sequence, promoter, signal peptide sequence, and transcription terminator. At a minimum, the control sequences include a promoter, and transcriptional and translational stop signals. The control sequences may be provided with linkers for the purpose of introducing specific restriction sites facilitating ligation of the control sequences with the coding region of the polynucleotide encoding a biologically active substance.

Operably linked: The term "operably linked" as used herein refers to a configuration in which a control sequence is placed at an appropriate position relative to the coding sequence of the DNA sequence, such that the control sequence directs the expression of a biologically active substance.

Coding sequence: When used herein the term "coding sequence" is intended to cover a nucleotide sequence, which directly specifies the amino acid sequence of its protein product. The boundaries of the coding sequence are generally determined by an open reading frame, which usually begins with the ATG start codon or alternative start codons such as GTG and TTG.

Expression: The term "expression" includes any step involved in the production of a biologically active substance including, but not limited to, transcription, post-transcriptional modification, translation, post-translational modification, and secretion.

Expression vector: The term "expression vector" herein covers a DNA molecule, linear or circular, that comprises a segment encoding a biologically active substance of the invention, and which is operably linked to additional segments that provide for its transcription.

Host cell: The term "host cell", as used herein, includes any cell type which is susceptible to transformation, transfection, conjugation, electroporation, etc. with a nucleic acid construct, plasmid, or vector.

DETAILED DESCRIPTION OF THE INVENTION

*Bacillus licheniformis* Chromosome and Features (Genes) Thereof

The present invention relates to an isolated polynucleotide of the complete chromosomal DNA molecule of *Bacillus licheniformis* ATCC 14580 having the nucleotide sequence of SEQ ID NO: 1. *Bacillus licheniformis* ATCC 14580, consists of a circular molecule of 4,222,336 base pairs with a mean G+C content of 46.2%. The chromosome contains 4208 predicted protein-coding genes (SEQ ID NOs: 2-4198) with an average size of 873 bp, 7 rRNA operons, and 72 tRNA genes. The deduced amino acid sequences of the 4208 predicted protein-coding genes are shown in SEQ ID NOs: 4199-8395. SEQ ID NO: 4210 corresponds to SEQ ID NO: 2. SEQ ID NO: 4211 corresponds to SEQ ID NO: 3; SEQ ID NO: 4212 corresponds to SEQ ID NO: 4, etc. The predicted functions of the 4208 gene products are shown in Table 1.

The *Bacillus licheniformis* chromosome possesses regions that are markedly co-linear with the chromosomes of *Bacillus subtilis* and *Bacillus halodurans*, and approximately 80% of the predicted genes have *Bacillus subtilis* orthologues.

The present invention also relates to isolated features (genes) of the complete chromosomal DNA molecule of *Bacillus licheniformis* ATCC 14580 encoding biologically active substances, selected from the group consisting of:

(a) a gene comprising a nucleotide sequence having at least 60% identity with any of the nucleotide sequences of SEQ ID NOs: 2-4198; and (b) a gene comprising a nucleotide sequence which hybridizes under at least medium stringency conditions with any of the genes of SEQ ID NOs: 2-4198, or a complementary strand thereof.

In a first aspect, the present invention relates to isolated genes, which have a degree of identity to the nucleotide sequences of any of SEQ ID NOs: 2-4198 of at least about 60%, preferably at least about 65%, more preferably at least about 70%, more preferably at least about 75%, more preferably at least about 80%, more preferably at least about 85%, even more preferably at least about 90%, most preferably at least about 95%, and even most preferably at least about 97%, which encode biologically active substances having a particular biological activity (hereinafter "homologous biologically active substances").

In a second aspect, the present invention relates to isolated genes comprising nucleotide sequences which hybridize under very low stringency conditions, preferably low stringency conditions, more preferably medium stringency conditions, more preferably medium-high stringency conditions, even more preferably high stringency conditions, and most preferably very high stringency conditions with any of (i) the genes of SEQ ID NOs: 2-4198, or subsequences thereof, or (ii) complementary strands thereof (J. Sambrook, E. F. Fritsch, and T. Maniatus, 1989, *Molecular Cloning, A Laboratory Manual*, 2d edition, Cold Spring Harbor, N.Y.). Subsequences of SEQ ID NOs: 2-4198 may be at least 100 nucleotides or preferably at least 200 nucleotides. Moreover, the subsequences may encode fragments of a gene product which have biological activity. The biologically active substances may also be biologically active allelic variants of the biologically active substances.

The nucleotide sequences of SEQ ID NOs: 2-4198 or subsequences thereof, as well as the amino acid sequences of SEQ ID NOs: 4199-8395 or fragments thereof, may be used to design nucleic acid probes to identify and clone DNA encoding biologically active substances from strains of different genera or species according to methods well known in the art. In particular, such probes can be used for hybridization with the genomic DNA of the genus or species of interest, following standard Southern blotting procedures, in order to identify and isolate the corresponding gene therein. Such probes can be considerably shorter than the entire sequence, but should be at least 14, preferably at least 25, more preferably at least 35 nucleotides in length, such as at least 70 nucleotides in length. It is preferred, however, that the nucleic acid probes are at least 100 nucleotides in length. For example, the nucleic acid probes may be at least 200 nucleotides, at least 300 nucleotides, at least 400 nucleotides, or at least 500 nucleotides in length. Even longer probes may be used, e.g., nucleic acid probes which are at least 600 nucleotides, at least 700 nucleotides, at least 800 nucleotides, or at least 900 nucleotides in length. Both DNA and RNA probes can be used. The probes are typically labeled for detecting the corresponding gene (for example, with $^{32}P$, $^{3}H$, $^{35}S$, biotin, or avidin). Such probes are encompassed by the present invention.

A genomic DNA library prepared from such other organisms may, therefore, be screened for DNA which hybridizes with the probes described above and which encodes a biologically active substance. Genomic DNA from such other organisms may be separated by agarose or polyacrylamide gel electrophoresis, or other separation techniques. DNA from the libraries or the separated DNA may be transferred to and immobilized on nitrocellulose or other suitable carrier material. In order to identify a clone or DNA which is homologous with any of SEQ ID NOs: 2-4198 or subsequences thereof, the carrier material is used in a Southern blot.

For purposes of the present invention, hybridization indicates that a polynucleotide hybridizes to a labeled gene having the nucleotide sequence shown in any of SEQ ID NOs: 2-4198, complementary strands thereof, or subsequences thereof, under very low to very high stringency conditions. Molecules to which the nucleic acid probe hybridizes under these conditions can be detected using X-ray film.

In a preferred aspect, the nucleic acid probe is any of the genes of SEQ ID NOs: 2-4198, or subsequences thereof. In another preferred aspect, the nucleic acid probe is the mature coding region of any of the genes of SEQ ID NOs: 2-4198. In another preferred aspect, the nucleic acid probe is the gene of any of SEQ ID NOs: 2-4198 contained in *Bacillus licheniformis* ATCC 14580. In another preferred aspect, the nucleic acid probe is the mature coding region of any of the genes of SEQ ID NOs: 2-4198 contained in *Bacillus licheniformis* ATCC 14580.

For long probes of at least 100 nucleotides in length, very low to very high stringency conditions are defined as prehybridization and hybridization at 42° C. in 5×SSPE, 0.3% SDS, 200 µg/ml sheared and denatured salmon sperm DNA, and either 25% formamide for very low and low stringencies, 35% formamide for medium and medium-high stringencies, or 50% formamide for high and very high stringencies, following standard Southern blotting procedures.

For long probes of at least 100 nucleotides in length, the carrier material is finally washed three times each for 15 minutes using 2×SSC, 0.2% SDS preferably at least at 45° C. (very low stringency), more preferably at least at 50° C. (low stringency), more preferably at least at 55° C. (medium stringency), more preferably at least at 60° C. (medium-high stringency), even more preferably at least at 65° C. (high stringency), and most preferably at least at 70° C. (very high stringency).

For short probes which are about 14 nucleotides to about 70 nucleotides in length, stringency conditions are defined as prehybridization, hybridization, and washing post-hybridization at about 5° C. to about 10° C. below the calculated $T_m$ using the calculation according to Bolton and McCarthy (1962, *Proceedings of the National Academy of Sciences USA* 48:1390) in 0.9 M NaCl, 0.09 M Tris-HCl pH 7.6, 6 mM EDTA, 0.5% NP-40, 1× Denhardt's solution, 1 mM sodium pyrophosphate, 1 mM sodium monobasic phosphate, 0.1 mM ATP, and 0.2 mg of yeast RNA per ml following standard Southern blotting procedures.

For short probes which are about 14 nucleotides to about 70 nucleotides in length, the carrier material is washed once in 6×SCC plus 0.1% SDS for 15 minutes and twice each for 15 minutes using 6×SSC at 5° C. to 10° C. below the calculated $T_m$.

Under salt-containing hybridization conditions, the effective $T_m$ is what controls the degree of identity required between the probe and the filter bound DNA for successful hybridization. The effective $T_m$ may be determined using the formula below to determine the degree of identity required for two DNAs to hybridize under various stringency conditions.

Effective $T_m$=81.5+16.6(log $M$[Na$^+$])+0.41(% $G+C$)−0.72(% formamide)

The % G+C content of any of the genes of SEQ ID NOs: 2-4198 can easily be determined. For medium stringency, for example, the concentration of formamide is 35% and the Na$^+$ concentration for 5×SSPE is 0.75 M. Applying this formula to these values, the Effective $T_m$ in ° C. can be calculated. Another relevant relationship is that a 1% mismatch of two DNAs lowers the $T_m$ 1.40° C. To determine the degree of identity required for two DNAs to hybridize under medium stringency conditions at 42° C., the following formula is used:

% Homology=100−[(Effective $T_m$−Hybridization Temperature)/1.4]

Applying this formula, the degree of identity required for two DNAs to hybridize under medium stringency conditions at 42° C. can be calculated.

Similar calculations can be made under other stringency conditions, as defined herein.

The present invention also relates to isolated polynucleotides obtained by (a) hybridizing a population of DNA under very low, low, medium, medium-high, high, or very high stringency conditions with any of (i) the genes of SEQ ID NOs: 2-4198, or subsequences thereof, or (ii) complementary strands thereof; and (b) isolating the hybridizing polynucleotide from the population of DNA. In a preferred aspect, the hybridizing polynucleotide encodes a polypeptide of any of SEQ ID NOs: 2-4198, or homologous polypeptides thereof.

In a third aspect, the present invention relates to isolated polypeptides having amino acid sequences which have a degree of identity to any of SEQ ID NOs: 4199-8395 of at least about 60%, preferably at least about 65%, more preferably at least about 70%, more preferably at least about 75%, more preferably at least about 80%, more preferably at least about 85%, even more preferably at least about 90%, most preferably at least about 95%, and even most preferably at least about 97%, which have biological activity (hereinafter "homologous polypeptides"). In a preferred aspect, the homologous polypeptides have an amino acid sequence which differs by ten amino acids, preferably by five amino acids, more preferably by four amino acids, even more preferably by three amino acids, most preferably by two amino acids, and even most preferably by one amino acid from the amino acid sequences of SEQ ID NOs: 4199-8395.

The polypeptides of the present invention preferably comprise the amino acid sequence of any of SEQ ID NOs: 4199-8395 or an allelic variant thereof; or a fragment thereof that has biological activity. In a more preferred aspect, the polypeptides of the present invention comprise the amino acid sequence of any of SEQ ID NOs: 4199-8395. In another preferred aspect, the polypeptides of the present invention comprise the mature polypeptide region of any of SEQ ID NOs: 4199-8395, or an allelic variant thereof; or a fragment thereof that has biological activity. In another preferred aspect, the polypeptides of the present invention comprise the mature polypeptide region of any of SEQ ID NOs: 4199-8395. In another preferred aspect, the polypeptides of the present invention consist of the amino acid sequence of any of SEQ ID NOs: 4199-8395 or an allelic variant thereof; or a fragment thereof that has biological activity. In another preferred aspect, the polypeptides of the present invention consist of the amino acid sequence of any of SEQ ID NOs: 4199-8395. In another preferred aspect, the polypeptides consist of the mature polypeptide region of any of SEQ ID NOs: 4199-8395 or an allelic variant thereof; or a fragment thereof that has biological activity. In another preferred aspect, the polypeptides consist of the mature polypeptide region of any of SEQ ID NOs: 4199-8395.

In a fourth aspect, the present invention relates to isolated substances having biological activity which are encoded by polynucleotides which hybridize, as described above, under very low stringency conditions, preferably low stringency conditions, more preferably medium stringency conditions, more preferably medium-high stringency conditions, even more preferably high stringency conditions, and most preferably very high stringency conditions with which hybridize under very low stringency conditions, preferably low stringency conditions, more preferably medium stringency conditions, more preferably medium-high stringency conditions, even more preferably high stringency conditions, and most preferably very high stringency conditions with any of (i) the genes of SEQ ID NOs: 2-4198, or subsequences thereof, or (ii) complementary strands thereof. A subsequence of any of SEQ ID NOs: 2-4198 may be at least 100 nucleotides or preferably at least 200 nucleotides. Moreover, the subsequence may encode a fragment, e.g., a polypeptide fragment, which has biological activity.

Nucleic Acid Constructs

The present invention also relates to nucleic acid constructs comprising an isolated gene or isolated genes (e.g., operon) of the present invention operably linked to one or more control sequences which direct the expression of the coding sequence in a suitable host cell under conditions compatible with the control sequences.

An isolated gene(s) of the present invention may be manipulated in a variety of ways to provide for production of a biologically active substance encoded directly or indirectly by the gene(s). Manipulation of the nucleotide sequence prior to its insertion into a vector may be desirable or necessary depending on the expression vector. The techniques for modifying nucleotide sequences utilizing recombinant DNA methods are well known in the art.

The control sequence may be an appropriate promoter sequence, a nucleotide sequence which is recognized by a host cell for expression of the gene(s) encoding the biologically active substance. The promoter sequence contains transcriptional control sequences which mediate the expression of the biologically active substance. The promoter may be any nucleotide sequence which shows transcriptional activity in the host cell of choice including mutant, truncated, and hybrid promoters, and may be obtained from genes encoding extracellular or intracellular polypeptides or biologically active substances either homologous or heterologous to the host cell.

Examples of suitable promoters for directing the transcription of the nucleic acid constructs of the present invention, especially in a bacterial host cell, are the promoters obtained from the *E. coli* lac operon, *Streptomyces coelicolor* agarase gene (dagA), *Bacillus subtilis* levansucrase gene (sacB), *Bacillus licheniformis* alpha-amylase qene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (Villa-Kamaroff et al., 1978, *Proceedings of the National Academy of Sciences USA* 75: 3727-3731), as well as the tac promoter (DeBoer et al., 1983, *Proceedings of the National Academy of Sciences USA* 80: 21-25). Further promoters are described in "Useful proteins from recombinant bacteria" in *Scientific American*, 1980, 242: 74-94; and in Sambrook et al., 1989, supra.

The control sequence may also be a suitable transcription terminator sequence, a sequence recognized by a host cell to terminate transcription. The terminator sequence is operably linked to the 3' terminus of the gene encoding the biologically active substance. Any terminator which is functional in the host cell of choice may be used in the present invention.

The control sequence may also be a signal peptide coding region that codes for an amino acid sequence linked to the amino terminus of a polypeptide and directs the encoded polypeptide into the cell's secretory pathway. The 5' end of the coding sequence of the nucleotide sequence may inherently contain a signal peptide coding region naturally linked in translation reading frame with the segment of the coding region which encodes the secreted polypeptide. Alternatively, the 5' end of the coding sequence may contain a signal peptide coding region which is foreign to the coding sequence. The foreign signal peptide coding region may be required where the coding sequence does not naturally contain a signal peptide coding region. Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells are the signal peptide coding regions obtained from the genes for *Bacillus* NCIB 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are described by Simonen and Palva, 1993, *Microbiological Reviews* 57: 109-137.

The control sequence may also be a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active polypeptide by catalytic or autocatalytic cleavage of the propeptide from the propolypeptide. The propeptide coding region may be obtained from the genes for *Bacillus subtilis* alkaline protease (aprE) and *Bacillus subtilis* neutral protease (nprT).

Where both signal peptide and propeptide regions are present at the amino terminus of a polypeptide, the propeptide region is positioned next to the amino terminus of a polypeptide and the signal peptide region is positioned next to the amino terminus of the propeptide region.

It may also be desirable to add regulatory sequences which allow the regulation of the expression of a biologically active substance relative to the growth of the host cell. Examples of regulatory systems are those which cause the expression of the gene to be turned on or off in response to a chemical or physical stimulus, including the presence of a regulatory compound. Regulatory systems in prokaryotic systems include the lac, tac, and trp operator systems. Other examples of regulatory sequences are those which allow for gene amplification. In eukaryotic systems, these include the dihydrofolate reductase gene which is amplified in the presence of methotrexate, and the metallothionein genes which are amplified with heavy metals. In these cases, the nucleotide sequence encoding the biologically active substance would be operably linked with the regulatory sequence.

Expression Vectors

The present invention also relates to recombinant expression vectors comprising an isolated gene of the present invention, a promoter, and transcriptional and translational stop signals. The various nucleic acid and control sequences described above may be joined together to produce a recombinant expression vector which may include one or more convenient restriction sites to allow for insertion or substitution of the nucleotide sequence encoding the polypeptide at such sites. Alternatively, a gene of the present invention may be expressed by inserting the nucleotide sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector may be any vector (e.g., a plasmid or virus) which can be conveniently subjected to recombinant DNA procedures and can bring about the expression of a gene of the present invention. The choice of the vector will typically depend on the compatibility of the vector with the host cell into which the vector is to be introduced. The vectors may be linear or closed circular plasmids.

The vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the host cell, is integrated into the genome and replicated together with the chromosome(s) into which it has been integrated. Furthermore, a single vector or plasmid or two or more vectors or plasmids which together contain the total DNA to be introduced into the genome of the host cell, or a transposon may be used.

The vectors of the present invention preferably contain one or more selectable markers which permit easy selection of transformed cells. A selectable marker is a gene the product of which provides for biocide or viral resistance, resistance to heavy metals, prototrophy to auxotrophs, and the like.

Examples of bacterial selectable markers are the dal genes from *Bacillus subtilis* or *Bacillus licheniformis*, or markers which confer antibiotic resistance such as ampicillin, kanamycin, chloramphenicol or tetracycline resistance.

The vectors of the present invention preferably contain an element(s) that permits integration of the vector into the host cell's genome or autonomous replication of the vector in the cell independent of the genome.

For integration into the host cell genome, the vector may rely on portions of the sequence of the gene or any other element of the vector for integration of the vector into the genome by homologous or nonhomologous recombination. Alternatively, the vector may contain additional nucleotide sequences for directing integration by homologous recombination into the genome of the host cell. The additional nucleotide sequences enable the vector to be integrated into the host cell genome at a precise location(s) in the chromosome(s). To increase the likelihood of integration at a precise location, the integrational elements should preferably contain a sufficient number of nucleotides, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleotide sequences. On the other hand, the vector may be integrated into the genome of the host cell by non-homologous recombination.

For autonomous replication, the vector may further comprise an origin of replication enabling the vector to replicate autonomously in the host cell in question. The origin of replication may be any plasmid replicator mediating autonomous replication which functions in a cell. The term "origin of replication" or "plasmid replicator" is defined herein as a sequence that enables a plasmid or vector to replicate in vivo. Examples of bacterial origins of replication are the origins of replication of plasmids pBR322, pUC19, pACYC177, and pACYC184 permitting replication in *E. coli*, and pUB110, pE194, pTA1060, and pAMβ1 permitting replication in *Bacillus*.

More than one copy of a gene of the present invention may be inserted into the host cell to increase production of the gene product. An increase in the copy number of the gene can be obtained by integrating at least one additional copy of the sequence into the host cell genome or by including an amplifiable selectable marker gene with a gene of the present invention where cells containing amplified copies of the selectable marker gene, and thereby additional copies of the gene of the present invention, can be selected for by cultivating the cells in the presence of the appropriate selectable agent.

The procedures used to ligate the elements described above to construct the recombinant expression vectors of the present invention are well known to one skilled in the art (see, e.g., Sambrook et al., 1989, supra).

Host Cells

The present invention also relates to recombinant host cells, comprising an isolated gene of the present invention, where the host cells are advantageously used in the recombinant production of a biologically active substance encoded by the gene. A vector comprising a gene of the present invention is introduced into a host cell so that the vector is maintained as a chromosomal integrant or as a self-replicating extrachromosomal vector as described earlier. The term "host cell" encompasses any progeny of a parent cell that is not identical to the parent cell due to mutations that occur during replication. The choice of a host cell will to a large extent depend upon the gene encoding the biologically active substance and its source.

The host cell may be any unicellular microorganism, e.g., a prokaryote.

Useful unicellular cells are bacterial cells such as gram positive bacteria including, but not limited to, a *Bacillus* cell, e.g., *Bacillus alkalophilus*, *Bacillus amyloliquefaciens*, *Bacillus brevis*, *Bacillus cereus*, *Bacillus circulans*, *Bacillus clausii*, *Bacillus coagulans*, *Bacillus fastidiosus*, *Bacillus firmus*, *Bacillus lautus*, *Bacillus lentus*, *Bacillus licheniformis*, *Bacillus macerans*, *Bacillus megaterium*, *Bacillus methanolicus*, *Bacillus pumilus*, *Bacillus sphaericus*, *Bacillus stearothermophilus*, *Bacillus subtilis*, and *Bacillus thuringiensis*; or a *Streptomyces* cell, e.g., *Streptomyces lividans* and *Streptomyces murinus*, or gram negative bacteria such as *E. coli* and *Pseudomonas* sp. In a preferred aspect, the bacterial host cell is a *Bacillus lentus*, *Bacillus licheniformis*, *Bacillus stearothermophilus*, or *Bacillus subtilis* cell. In another preferred aspect, the *Bacillus* cell is an alkalophilic *Bacillus*.

The introduction of a vector into a bacterial host cell may, for instance, be effected by protoplast transformation (see, e.g., Chang and Cohen, 1979, *Molecular General Genetics* 168: 111-115), using competent cells (see, e.g., Young and Spizizen, 1961, *Journal of Bacteriology* 81: 823-829, or Dubnau and Davidoff-Abelson, 1971, *Journal of Molecular Biology* 56: 209-221), electroporation (see, e.g., Shigekawa and Dower, 1988, *Biotechniques* 6: 742-751), or conjugation (see, e.g., Koehler and Thorne, 1987, *Journal of Bacteriology* 169: 5771-5278).

Methods of Production

The present invention also relates to methods for producing a biologically active substance of the present invention comprising (a) cultivating a strain, which in its wild-type form is capable of producing the biologically active substance, under conditions conducive for production of the biologically active substance; and (b) recovering the biologically active substance. Preferably, the strain is of the genus *Bacillus*, and more preferably *Bacillus licheniformis*.

The present invention also relates to methods for producing a biologically active substance of the present invention comprising (a) cultivating a host cell under conditions conducive for production of the biologically active substance; and (b) recovering the biologically active substance.

The present invention also relates to methods for producing a biologically active substance of the present invention comprising (a) cultivating a host cell under conditions conducive for production of the biologically active substance, wherein the host cell comprises a mutant polynucleotide comprising at least one mutation in the coding region of any of SEQ ID NOs: 2-4198, wherein the mutant polynucleotide encodes a biologically active substance which consists of SEQ ID NOs: 4199-8395, respectively, and (b) recovering the biologically active substance.

In the production methods of the present invention, the cells are cultivated in a nutrient medium suitable for production of the biologically active substance using methods known in the art. For example, the cell may be cultivated by shake flask cultivation, and small-scale or large-scale fermentation (including continuous, batch, fed-batch, or solid state fermentations) in laboratory or industrial fermentors performed in a suitable medium and under conditions allowing the biologically active substance to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). If the biologically active substance is secreted into the nutrient medium, the biologically active substance can be recovered directly from the medium. If the biologically active substance is not secreted, it can be recovered from cell lysates.

The biologically active substances may be detected using methods known in the art that are specific for the polypeptides. These detection methods may include use of specific antibodies, formation of an enzyme product, or disappearance of an enzyme substrate. For example, an enzyme assay may be used to determine the activity of an enzyme.

The resulting biologically active substances may be recovered by methods known in the art. For example, the biologically active substances may be recovered from the nutrient medium by conventional procedures including, but not limited to, centrifugation, filtration, extraction, spray-drying, evaporation, or precipitation.

The biologically active substances of the present invention may be purified by a variety of procedures known in the art including, but not limited to, chromatography (e.g., ion exchange, affinity, hydrophobic, chromatofocusing, and size exclusion), electrophoretic procedures (e.g., preparative isoelectric focusing), differential solubility (e.g., ammonium sulfate precipitation), SDS-PAGE, or extraction (see, e.g., *Protein Purification*, J.-C. Janson and Lars Ryden, editors, VCH Publishers, New York, 1989).

Plants

The present invention also relates to a transgenic plant, plant part, or plant cell which has been transformed with a gene encoding a biologically active substance of the present invention so as to express and produce the biologically active substance in recoverable quantities. The biologically active substance may be recovered from the plant or plant part. Alternatively, the plant or plant part containing the recombinant biologically active substance may be used as such for improving the quality of a food or feed, e.g., improving nutritional value, palatability, and rheological properties, or to destroy an antinutritive factor.

The transgenic plant can be dicotyledonous (a dicot) or monocotyledonous (a monocot). Examples of monocot plants are grasses, such as meadow grass (blue grass, *Poa*), forage grass such as *festuca, lolium*, temperate grass, such as *Agrostis*, and cereals, e.g., wheat, oats, rye, barley, rice, sorghum, and maize (corn).

Examples of dicot plants are tobacco, legumes, such as lupins, potato, sugar beet, pea, bean and soybean, and cruciferous plants (family Brassicaceae), such as cauliflower, rape seed, and the closely related model organism *Arabidopsis thaliana*.

Examples of plant parts are stem, callus, leaves, root, fruits, seeds, and tubers as well as the individual tissues comprising these parts, e.g., epidermis, mesophyll, parenchyme, vascular tissues, meristems. In the present context, also specific plant cell compartments, such as chloroplast, apoplast, mitochondria, vacuole, peroxisomes and cytoplasm are considered to be a plant part. Furthermore, any plant cell, whatever the tissue origin, is considered to be a plant part. Likewise, plant parts such as specific tissues and cells isolated to facilitate the utilisation of the invention are also considered plant parts e.g. embryos, endosperms, aleurone and seeds coats.

Also included within the scope of the present invention are the progeny of such plants, plant parts, and plant cells.

The transgenic plant or plant cell expressing a biologically active substance of the present invention may be constructed in accordance with methods known in the art. Briefly, the plant or plant cell is constructed by incorporating one or more expression constructs encoding a biologically active substance of the present invention into the plant host genome and propagating the resulting modified plant or plant cell into a transgenic plant or plant cell.

The expression construct is conveniently a nucleic acid construct which comprises a gene encoding a biologically active substance of the present invention operably linked with appropriate regulatory sequences required for expression of the nucleotide sequence in the plant or plant part of choice. Furthermore, the expression construct may comprise a selectable marker useful for identifying host cells into which the expression construct has been integrated and DNA sequences necessary for introduction of the construct into the plant in question (the latter depends on the DNA introduction method to be used).

The choice of regulatory sequences, such as promoter and terminator sequences and optionally signal or transit sequences is determined, for example, on the basis of when, where, and how the biologically active substance is desired to be expressed. For instance, the expression of the gene encoding a biologically active substance of the present invention may be constitutive or inducible, or may be developmental, stage or tissue specific, and the gene product may be targeted to a specific tissue or plant part such as seeds or leaves. Regulatory sequences are, for example, described by Tague et al., 1988, *Plant Physiology* 86: 506.

For constitutive expression the 35S-CaMV, the maize ubiquitin 1 and the rice actin 1 promoter may be used (Franck et al., 1980. *Cell* 21: 285-294, Christensen A H, Sharrock R A and Quail, 1992, *Plant Mo. Biol.* 18: 675-689.; Zhang W, McElroy D. and Wu R., 1991, *Plant Cell* 3: 1155-1165). Organ-specific promoters may be, for example, a promoter from storage sink tissues such as seeds, potato tubers, and fruits (Edwards and Coruzzi, 1990, *Ann. Rev. Genet.* 24: 275-303), or from metabolic sink tissues such as meristems (Ito et al., 1994, *Plant Mol. Biol.* 24: 863-878), a seed specific promoter such as the glutelin, prolamin, globulin, or albumin promoter from rice (Wu et al., 1998, *Plant and Cell Physiology* 39: 885-889), a *Vicia faba* promoter from the legumin B4 and the unknown seed protein gene from *Vicia faba* (Conrad et al., 1998, *Journal of Plant Physiology* 152: 708-711), a promoter from a seed oil body protein (Chen et al., 1998, Plant and Cell Physiology 39: 935-941), the storage protein napA promoter from *Brassica napus*, or any other seed specific promoter known in the art, e.g., as described in WO 91/14772. Furthermore, the promoter may be a leaf specific promoter such as the rbcs promoter from rice or tomato (Kyozuka et al., 1993, *Plant Physiology* 102: 991-1000, the chlorella virus adenine methyltransferase gene promoter (Mitra and Higgins, 1994, *Plant Molecular Biology* 26: 85-93), or the aldP gene promoter from rice (Kagaya et al., 1995, *Molecular and General Genetics* 248: 668-674), or a wound inducible promoter such as the potato pin2 promoter (Xu et al., 1993, *Plant Molecular Biology* 22: 573-588). Likewise, the promoter may inducible by abiotic treatments such as temperature, drought or alterations in salinity or induced by exogenously applied substances that activate the promoter, e.g., ethanol, oestrogens, plant hormones like ethylene, abscisic acid and gibberellic acid and heavy metals.

A promoter enhancer element may also be used to achieve higher expression of the enzyme in the plant. For instance, the promoter enhancer element may be an intron which is placed between the promoter and the nucleotide sequence encoding a biologically active substance of the present invention. For instance, Xu et al., 1993, supra disclose the use of the first intron of the rice actin 1 gene to enhance expression.

The selectable marker gene and any other parts of the expression construct may be chosen from those available in the art.

The nucleic acid construct is incorporated into the plant genome according to conventional techniques known in the art, including *Agrobacterium*-mediated transformation, virus-mediated transformation, microinjection, particle bombardment, biolistic transformation, and electroporation (Gasser et al, 1990, *Science* 244: 1293; Potrykus, 1990, *Bio/Technology* 8: 535; Shimamoto et al., 1989, *Nature* 338: 274).

Presently, *Agrobacterium tumefaciens*-mediated gene transfer is the method of choice for generating transgenic dicots (for a review, see Hooykas and Schilperoort, 1992, *Plant Molecular Biology* 19: 15-38). However it can also be used for transforming monocots, although other transformation methods are generally preferred for these plants. Presently, the method of choice for generating transgenic monocots is particle bombardment (microscopic gold or tungsten particles coated with the transforming DNA) of embryonic calli or developing embryos (Christou, 1992, *Plant Journal* 2: 275-281; Shimamoto, 1994, *Current Opinion Biotechnology* 5: 158-162; Vasil et al., 1992, *Bio/Technology* 10: 667-674). An alternative method for transformation of monocots is based on protoplast transformation as described by Omirulleh et al., 1993, *Plant Molecular Biology* 21: 415-428.

Following transformation, the transformants having incorporated therein the expression construct are selected and regenerated into whole plants according to methods well-known in the art. Often the transformation procedure is designed for the selective elimination of selection genes either during regeneration or in the following generations by using, for example, co-transformation with two separate T-DNA constructs or site specific excision of the selection gene by a specific recombinase.

The present invention also relates to methods for producing a biologically active substance of the present invention comprising (a) cultivating a transgenic plant or a plant cell comprising a gene encoding a biologically active substance of the present invention under conditions conducive for production of the biologically active substance; and (b) recovering the biologically active substance.

Removal or Reduction of Biologically Active Substance

The present invention also relates to methods for producing a mutant of a parent cell, which comprises disrupting or deleting all or a portion of a gene encoding a biologically active substance of the present invention, which results in the mutant cell producing less of the biologically active substance than the parent cell when cultivated under the same conditions.

The mutant cell may be constructed by reducing or eliminating expression of a gene encoding or regulatory synthesis of a biologically active substance of the present invention using methods well known in the art, for example, insertions, disruptions, replacements, or deletions. The gene to be modified or inactivated may be, for example, the coding region or a part thereof essential for activity, or a regulatory element of the gene required for the expression of the coding region. An example of such a regulatory or control sequence may be a promoter sequence or a functional part thereof, i.e., a part that is sufficient for affecting expression of the gene. Other control sequences for possible modification include, but are not limited to, a leader, propeptide sequence, signal peptide sequence, transcription terminator, and transcriptional activator.

Modification or inactivation of the gene may be performed by subjecting the parent cell to mutagenesis and selecting for mutant cells in which expression of the gene has been reduced or eliminated. The mutagenesis, which may be specific or random, may be performed, for example, by use of a suitable physical or chemical mutagenizing agent, by use of a suitable oligonucleotide, or by subjecting the DNA sequence to PCR generated mutagenesis. Furthermore, the mutagenesis may be performed by use of any combination of these mutagenizing agents.

Examples of a physical or chemical mutagenizing agent suitable for the present purpose include ultraviolet (UV) irradiation, hydroxylamine, N-methyl-N'-nitro-N-nitrosoguanidine (MNNG), O-methyl hydroxylamine, nitrous acid, ethyl methane sulphonate (EMS), sodium bisulphite, formic acid, and nucleotide analogues.

When such agents are used, the mutagenesis is typically performed by incubating the parent cell to be mutagenized in the presence of the mutagenizing agent of choice under suitable conditions, and screening and/or selecting for mutant cells exhibiting reduced or no expression of the gene.

Modification or inactivation of the nucleotide sequence may be accomplished by introduction, substitution, or removal of one or more nucleotides in the gene or a regulatory element required for the transcription or translation thereof. For example, nucleotides may be inserted or removed so as to result in the introduction of a stop codon, the removal of the start codon, or a change in the open reading frame. Such modification or inactivation may be accomplished by site-directed mutagenesis or PCR generated mutagenesis in accordance with methods known in the art. Although, in principle, the modification may be performed in vivo, i.e., directly on the cell expressing the nucleotide sequence to be modified, it is preferred that the modification be performed in vitro as exemplified below.

An example of a convenient way to eliminate or reduce expression of a nucleotide sequence by a cell of choice is based on techniques of gene replacement, gene deletion, or gene disruption. For example, in the gene disruption method, a nucleic acid sequence corresponding to the endogenous nucleotide sequence is mutagenized in vitro to produce a defective nucleic acid sequence which is then transformed into the parent cell to produce a defective gene. By homologous recombination, the defective nucleic acid sequence replaces the endogenous nucleotide sequence. It may be desirable that the defective nucleotide sequence also encodes a marker that may be used for selection of transformants in which the nucleotide sequence has been modified or destroyed. In a particularly preferred aspect, the nucleotide sequence is disrupted with a selectable marker such as those described herein.

Alternatively, modification or inactivation of the nucleotide sequence may be performed by established anti-sense techniques using a sequence complementary to the nucleotide sequence. More specifically, expression of the nucleotide sequence by a cell may be reduced or eliminated by introducing a sequence complementary to the nucleic acid sequence of the gene that may be transcribed in the cell and is capable of hybridizing to the mRNA produced in the cell. Under conditions allowing the complementary anti-sense nucleotide sequence to hybridize to the mRNA, the amount of protein translated is thus reduced or eliminated.

The present invention further relates to a mutant cell of a parent cell which comprises a disruption or deletion of a nucleotide sequence encoding the biologically active substance or a control sequence thereof, which results in the mutant cell producing less of the biologically active substance than the parent cell.

The biologically active substance-deficient mutant cells so created are particularly useful as host cells for the expression of homologous and/or heterologous substances, such as polypeptides. Therefore, the present invention further relates to methods for producing a homologous or heterologous substance comprising (a) cultivating the mutant cell under conditions conducive for production of the substance; and (b) recovering the substance. The term "heterologous substances" is defined herein as substances which are not native to the host cell, a native substance in which modifications have been made to alter the native sequence, or a native substance whose expression is quantitatively altered as a result of a manipulation of the host cell by recombinant DNA techniques.

In a further aspect, the present invention relates to a method for producing a protein product essentially free of a biologically active substance by fermentation of a cell which produces both a biologically active substance of the present invention as well as the protein product of interest by adding an effective amount of an agent capable of inhibiting activity of the biologically active substance to the fermentation broth before, during, or after the fermentation has been completed, recovering the product of interest from the fermentation broth, and optionally subjecting the recovered product to further purification.

In accordance with this aspect of the invention, it is possible to remove at least 60%, preferably at least 75%, more preferably at least 85%, still more preferably at least 95%, and most preferably at least 99% of the biologically active substance. Complete removal of biologically active substance may be obtained by use of this method.

The methods used for cultivation and purification of the product of interest may be performed by methods known in the art.

The methods of the present invention for producing an essentially biologically active substance-free product is of particular interest in the production of prokaryotic polypeptides, in particular bacterial proteins such as enzymes. The enzyme may be selected from, e.g., an amylolytic enzyme, lipolytic enzyme, proteolytic enzyme, cellulytic enzyme, oxidoreductase, or plant cell-wall degrading enzyme. Examples of such enzymes include an aminopeptidase, amylase, amyloglucosidase, carbohydrase, carboxypeptidase, catalase, cellulase, chitinase, cutinase, cyclodextrin glycosyltransferase, deoxyribonuclease, esterase, galactosidase, beta-galactosidase, glucoamylase, glucose oxidase, glucosidase, haloperoxidase, hemicellulase, invertase, isomerase, laccase, ligase, lipase, lyase, mannosidase, oxidase, pectinolytic enzyme, peroxidase, phytase, phenoloxidase, polyphenoloxidase, proteolytic enzyme, ribonuclease, transferase, transglutaminase, or xylanase. The biologically active substance-deficient cells may also be used to express heterologous proteins of pharmaceutical interest such as hormones, growth factors, receptors, and the like.

It will be understood that the term "prokaryotic polypeptides" includes not only native polypeptides, but also those polypeptides, e.g., enzymes, which have been modified by amino acid substitutions, deletions or additions, or other such modifications to enhance activity, thermostability, pH tolerance and the like.

In a further aspect, the present invention relates to a product of a protein or substance essentially free of a biologically active substance of the invention, produced by a method of the present invention.

Compositions

The present invention also relates to compositions comprising a biologically active substance of the present invention. Preferably, the compositions are enriched in the biologically active substance. The term "enriched" indicates that the biologically active substance of the composition has been increased, e.g., with an enrichment factor of 1.1.

The composition may comprise a biologically active substance of the invention as the major component, e.g., a mono-component composition. Alternatively, the composition may comprise multiple biologically active substances, for example, multiple enzymes, such as an aminopeptidase, amylase, carbohydrase, carboxypeptidase, catalase, cellulase, chitinase, cutinase, cyclodextrin glycosyltransferase, deoxyribonuclease, esterase, alpha-galactosidase, beta-galactosidase, glucoamylase, alpha-glucosidase, beta-glucosidase, haloperoxidase, invertase, laccase, lipase, mannosidase, oxidase, pectinolytic enzyme, peptidoglutaminase, peroxidase, phytase, polyphenoloxidase, proteolytic enzyme, ribonuclease, transglutaminase, or xylanase.

The compositions may be prepared in accordance with methods known in the art and may be in the form of a liquid or a dry composition. For instance, the composition may be in the form of a granulate or a microgranulate. The biologically active substance to be included in the composition may be stabilized in accordance with methods known in the art.

Methods for Using the *Bacillus licheniformis* Chromosome

The present invention also relates to methods for using the *Bacillus licheniformis* chromosome.

The chromosome of *Bacillus licheniformis* serves as a reservoir of new genes/proteins that have likely environmental, energy, health, and industrial applications (e.g., enzymes, antibiotics, biochemicals). A clear extension of this is that the newly discovered molecules can be used as starting points for further improvements via well-established gene shuffling, directed evolution, and protein engineering methods. Additionally, regions or motifs (e.g., signal peptides, active sites, substrate-binding regions) from the newly discovered molecules may be employed to derive novel chimeras with industrially advantageous properties.

The genes encoded in the chromosome may be used for monitoring global gene expression during the life cycle of the organism or during industrial fermentations (e.g., implemented on DNA microarrays). By monitoring global gene expression, for example, improved processes for industrial fermentation can be implemented with greater efficiency and economy.

The chromosome is useful in comparative evolutionary and ecological studies. For example, dozens of *Bacillus licheniformis* isolates can be readily compared on a global scale by hybridization of their genomic DNAs to a microarray fabricated from the reference strain presented in this case (so-called comparative genomic hybridization). Using this method, one can compare various isolates to look for similarities/differences among geographical and environmental niches or among biocontrol strains versus saprophytic isolates.

The chromosome sequence may be used to construct the metabolic blueprint for *Bacillus licheniformis* that includes all catabolic and anabolic pathways, signaling pathways, regulatory networks, growth substrates, biochemical intermediates, end products, electron donors/acceptors and others. In doing so, it is possible to modify the metabolic machinery of the organism by deleting unwanted pathways and/or adding enzymes/pathways from other organisms to generate useful chemicals and intermediates.

The pathways and components that contribute to production of extracellular and surface proteins in *Bacillus licheniformis* can be extracted from the chromosomal sequence. This affords opportunities for improved production of extracellular proteins by genetic manipulation of the secretion machinery.

The chromosome data allows deduction of the essential genes for *Bacillus licheniformis* (either by comparison to related bacteria such as *Bacillus subtilis* or by systematic gene-by-gene knock outs). Thus it has become possible to design custom-made strains which contain only the genes that are essential for production of specific proteins or metabolites (so-called cell factory concept).

The chromosome data may be used to construct interspecies hybrids between *Bacillus licheniformis* and other bacteria. Venter et al., 2003, *Proc. Nat. Acad. Sci. USA* 100, 15440-15445 have shown that it is possible to construct an entire virus genome from smaller DNA segments. Thus, segments of the *Bacillus licheniformis* chromosome may be employed to derive novel chromosomal segments or even entire chimeric chromosomes for specific applications.

In a preferred aspect, methods for using the *Bacillus licheniformis* chromosome include host improvement, e.g., secretion of a protein or metabolite, genome shuffling, construction of new genomes, metabolic engineering and pathway reconstruction, carrier for heterologous expression vectors, microarrays as described herein, identification of polypeptides in proteomics analyses, and comparative genomics with other *Bacillus* species or related organisms.

Methods for Isolating Genes

The present invention also relates to methods for isolating a gene encoding a biologically active substance from a microbial strain. The method comprises first the addition of a mixture of first labeled nucleic acid probes, isolated from a microbial strain cultured on medium without an inducing substrate, and a mixture of second labeled nucleic acid probes, isolated from the microbial strain cultured on medium with the inducing substrate, to an array of *Bacillus licheniformis* genes selected from the group consisting of nucleotides SEQ ID NOs: 2-4198, complementary strands of SEQ ID NOs: 2-4198, or fragments of SEQ ID NOs: 2-4198, under conditions where the labeled nucleic acid probes hybridize to complementary sequences of the *Bacillus licheniformis* genes on the array. The first nucleic acid probes are labeled with a first reporter and the second nucleic acid probes are labeled with a second reporter. The array is then examined under conditions wherein the relative expression of the genes of the microbial strain is determined by the observed hybridization reporter signal of each spot on the array in which (i) the *Bacillus licheniformis* genes on the array that hybridize to the first nucleic acid probes produce a distinct first hybridization reporter signal or to the second nucleic acid probes produce a distinct second hybridization reporter signal, and (ii) the *Bacillus licheniformis* genes on the array that hybridize to both the first and second nucleic acid probes produce a distinct combined hybridization reporter signal. The probe is then sequenced to isolate from the microbial strain the corresponding gene that encodes an enzyme that degrades or converts the substrate.

Enzymes. The gene of interest may encode any enzyme including an oxidoreductase, transferase, hydrolase, lyase, isomerase, or ligase. In a preferred aspect, the enzyme is an acylase, alpha-glucosidase, amidase, aminopeptidase, amylase, carbohydrase, carboxypeptidase, catalase, cellulase, chitinase, cutinase, cyclodextrin glycosyltransferase, deoxyribonuclease, dextrinase, endoglucanase, esterase, galactanase, alpha-galactosidase, beta-galactosidase, glucoamylase, glucanase, glucocerebrosidase, alpha-glucosidase, beta-glucosidase, hemicellulase, invertase, laccase, lignase, lipase, lysin, mannosidase, mutanase, oxidase, pectinolytic enzyme, peroxidase, phosphatase, phospholipase, phytase, polyphenoloxidase, proteolytic enzyme, pullulanase, ribonuclease, transglutaminase, urokinase, or xylanase.

Inducing Substrate. The inducing substrate may be any substrate that is subject to the action of an enzyme, i.e., that degrades or converts the substrate. In a preferred aspect, the inducing substrate is lignin or a lignin-containing material. In a more preferred aspect, the lignin-containing material is lignocellulose. In another preferred aspect, the inducing substrate is cellulose. In another preferred aspect, the inducing substrate is hemicellulose. In another preferred aspect, the inducing substrate is pectin. In another preferred aspect, the inducing substrate is a lipid. In another preferred aspect, the inducing substrate is phospholipid. In another preferred aspect, the inducing substrate is phytic acid. In another preferred aspect, the inducing substrate is protein. In another preferred aspect, the inducing substrate is a starch. In another preferred aspect, the inducing substrate is a medium that is low in nutrients such as amino acids, carbon, nitrogen, phosphate, or iron.

In a more preferred aspect, the protein substrate is blood, casein, egg, gelatin, gluten, milk protein, or soy protein. In another more preferred aspect, the lignin-containing material is hardwood thermomechanical pulp. In another more preferred aspect, the lignocellulose is corn stover. In another more preferred aspect, the lignocellulose is white poplar. In another more preferred aspect, the lignocellulose is rice straw. In another more preferred aspect, the lignocellulose is switch grass.

Microbial Strains. In the methods of the present invention, the microbial strain may be any microbial strain. The strain is cultured on a suitable nutrient medium with and without a substrate of interest. The strain cultured on medium without the substrate is used as a reference for identifying differences in expression of the same or similar complement of genes in the strain cultured on medium with substrate. The strain may be a wild-type, mutant, or recombinant strain.

In the methods of the present invention, the microbial strain is preferably a bacterium. In a more preferred aspect, the bacterium is a *Bacillus*, *Pseudomonas*, or *Streptomyces* strain or *E. coli*.

The *Bacillus* strain may be any *Bacillus* strain. In a preferred aspect, the *Bacillus* strain is *Bacillus alkalophilus*, *Bacillus amyloliquefaciens*, *Bacillus brevis*, *Bacillus cereus*, *Bacillus circulans*, *Bacillus clausii*, *Bacillus coagulans*, *Bacillus fastidiosus*, *Bacillus firmus*, *Bacillus lautus*, *Bacillus lentus*, *Bacillus licheniformis*, *Bacillus macerans*, *Bacillus megaterium*, *Bacillus methanolicus*, *Bacillus pumilus*, *Bacillus sphaericus*, *Bacillus stearothermophilus*, *Bacillus subtilis*, or *Bacillus thuringiensis*. It will be understood that the term "*Bacillus*" also encompasses relatives of *Bacillus* such as *Paenibacillus*, *Oceanobacillus*, and the like.

The *Pseudomonas* strain may be any *Pseudomonas* strain. In a preferred aspect, the *Pseudomonas* strain is *Pseudomonas acidovorans*, *Pseudomonas aeruginosa*, *Pseudomonas alcaligenes*, *Pseudomonas anguilliseptica*, *Pseudomonas abtimicrobica*, *Pseudomonas aurantiaca*, *Pseudomonas aureofaciens*, *Pseudomonas beijerinckii*, *Pseudomonas boreopolis*, *Pseudomonas chlororaphis*, *Pseudomonas citronellolis*, *Pseudomonas cocovenenans*, *Pseudomonas diminuta*, *Pseudomonas doudoroffii*, *Pseudomonas echinoides*, *Pseudomonas elongata*, *Pseudomonas fluorescens*, *Pseudomonas fragi*, *Pseudomonas halophobica*, *Pseudomonas huttiensis*, *Pseudomonas indigofera*, *Pseudomonas lanceolata*, *Pseudomonas lemoignei*, *Pseudomonas lundensis*, *Pseudomonas mendocina*, *Pseudomonas mephitica*, *Pseudomonas mucidolens*, *Pseudomonas oleovorans*, *Pseudomonas phenazinium*, *Pseudomonas pictorium*, *Pseudomonas putida*, *Pseudomonas resinovorans*, *Pseudomonas saccharophila*, *Pseudomonas stanieri*, *Pseudomonas stutzeri*, *Pseudomonas taetrolens*, or *Pseudomonas vesicularis*.

The *Streptomyces* strain may be any *Streptomyces* strain. In a preferred aspect, the *Streptomyces* strain is *Streptomyces lividans*. In another preferred aspect, the *Streptomyces* strain is *Streptomyces murinus*.

Microarrays. The term "an array of *Bacillus licheniformis* genes" is defined herein as a linear or two-dimensional array of preferably discrete elements of an array of *Bacillus licheniformis* genes selected from the group consisting of nucleotides SEQ ID NOs: 2-4198, complementary strands of SEQ ID NOs: 2-4198, or fragments of SEQ ID NOs: 2-4198 (e.g., synthetic oligonucleotides of, for example, 40-60 nucleotides), wherein each discrete element has a finite area, formed on the surface of a solid support. It shall be understood that the term "*Bacillus licheniformis* genes" encompasses nucleotides SEQ ID NOs: 2-4198, complementary strands of SEQ ID NOs: 2-4198, or fragments of SEQ ID NOs: 2-4198.

The term "microarray" is defined herein as an array of *Bacillus licheniformis* gene elements having a density of discrete of *Bacillus licheniformis* gene elements of at least about 100/cm$^2$, and preferably at least about 1000/cm$^2$. The *Bacillus licheniformis* gene elements in a microarray have typical dimensions, e.g., diameters, in the range of between about 10 to about 250 μm, preferably in the range of between about 10 to about 200 μm, more preferably in the range of between about 20 to about 150 μm, even more preferably in the range of between about 20 to about 100 μm, most preferably in the range of between about 50 to about 100 μm, and even most preferably in the range of between about 80 to about 100 μm, and are separated from other gene elements in the microarray by about the same distance.

Methods and instruments for forming microarrays on the surface of a solid support are well known in the art. See, for example, U.S. Pat. Nos. 5,807,522; 5,700,637; and 5,770,151. The instrument may be an automated device such as described in U.S. Pat. No. 5,807,522.

The term "a substrate containing an array of *Bacillus licheniformis* genes" is defined herein as a solid support having deposited on the surface of the support one or more of a plurality of *Bacillus licheniformis* genes, as described herein, for use in detecting binding of labeled nucleic acids to the *Bacillus licheniformis* genes.

The substrate may, in one aspect, be a glass support (e.g., glass slide) having a hydrophilic or hydrophobic coating on the surface of the support, and an array of distinct random nucleic acid fragments bound to the coating, where each distinct random nucleic acid fragment is disposed at a separate, defined position.

Each microarray in the substrate preferably contains at least 10$^3$ distinct *Bacillus licheniformis* in a surface area of less than about 5 or 6 cm$^2$. Each distinct *Bacillus licheniformis* gene (i) is disposed at a separate, defined position on the array, (ii) has a length of at least 50 bp, and (iii) is present in a defined amount between about 0.1 femtomoles and 100 nanomoles or higher if necessary.

For a hydrophilic coating, the glass slide is coated by placing a film of a polycationic polymer with a uniform thickness on the surface of the slide and drying the film to form a dried coating. The amount of polycationic polymer added should be sufficient to form at least a monolayer of polymers on the glass surface. The polymer film is bound to the surface via electrostatic binding between negative silyl-OH groups on the surface and charged cationic groups in the polymers. Such polycationic polymers include, but are not limited to, polylysine and polyarginine.

Another coating strategy employs reactive aldehydes to couple DNA to the slides (Schena et al., 1996, *Proceedings of the National Academy of Science USA* 93: 10614-10619; Heller at al., 1997, *Proceedings of the National Academy of Science USA* 94: 2150-2155).

Alternatively, the surface may have a relatively hydrophobic character, i.e., one that causes aqueous medium deposited on the surface to bead. A variety of known hydrophobic polymers, such as polystyrene, polypropylene, or polyethylene, have desirable hydrophobic properties, as do glass and a variety of lubricant or other hydrophobic films that may be applied to the support surface. A support surface is "hydrophobic" if an aqueous droplet applied to the surface does not spread out substantially beyond the area size of the applied droplet, wherein the surface acts to prevent spreading of the droplet applied to the surface by hydrophobic interaction with the droplet.

In another aspect, the substrate may be a multi-cell substrate where each cell contains a microarray of *Bacillus licheniformis* and preferably an identical microarray, formed on a porous surface. For example, a 96-cell array may typically have array dimensions between about 12 and 244 mm in width and 8 and 400 mm in length, with the cells in the array having width and length dimension of 1/12 and 1/8 the array width and length dimensions, respectively, i.e., between about 1 and 20 in width and 1 and 50 mm in length.

The solid support may include a water-impermeable backing such as a glass slide or rigid polymer sheet, or other non-porous material. Formed on the surface of the backing is a water-permeable film, which is formed of porous material. Such porous materials include, but are not limited to, nitrocellulose membrane nylon, polypropylene, and polyvinylidene difluoride (PVDF) polymer. The thickness of the film is preferably between about 10 and 1000 µm. The film may be applied to the backing by spraying or coating, or by applying a preformed membrane to the backing.

Alternatively, the solid support may be simply a filter composed of nitrocellulose, nylon, polypropylene, or polyvinylidene difluoride (PVDF) polymer, or, for that matter, any material suitable for use.

The film surface may be partitioned into a desirable array of cells by water-impermeable grid lines typically at a distance of about 100 to 2000 µm above the film surface. The grid lines can be formed on the surface of the film by laying down an uncured flowable resin or elastomer solution in an array grid, allowing the material to infiltrate the porous film down to the backing, and then curing the grid lines to form the cell-array substrate.

The barrier material of the grid lines may be a flowable silicone, wax-based material, thermoset material (e.g., epoxy), or any other useful material. The grid lines may be applied to the solid support using a narrow syringe, printing techniques, heat-seal stamping, or any other useful method known in the art.

Each well preferably contains a microarray of distinct *Bacillus licheniformis* genes. "Distinct *Bacillus licheniformis* genes" as applied to the genes forming a microarray is defined herein as an array member which is distinct from other array members on the basis of a different *Bacillus licheniformis* gene sequence or oligo sequence thereof, and/or different concentrations of the same or distinct *Bacillus licheniformis* genes and/or different mixtures of distinct *Bacillus licheniformis* genes or different-concentrations of *Bacillus licheniformis* genes. Thus an array of "distinct *Bacillus licheniformis* genes" may be an array containing, as its members, (i) distinct *Bacillus licheniformis* genes which may have a defined amount in each member, (ii) different, graded concentrations of a specific *Bacillus licheniformis* gene, and/or (iii) different-composition mixtures of two or more distinct *Bacillus licheniformis* genes.

It will be understood, however, that in the methods of the present invention, any type of substrate known in the art may be used.

The delivery of a known amount of a selected *Bacillus licheniformis* gene to a specific position on the support surface is preferably performed with a dispensing device equipped with one or more tips for insuring reproducible deposition and location of the *Bacillus licheniformis* genes and for preparing multiple arrays. Any dispensing device known in the art may be used in the methods of the present invention. See, for example, U.S. Pat. No. 5,807,522.

For liquid-dispensing on a hydrophilic surface, the liquid will have less of a tendency to bead, and the dispensed volume will be more sensitive to the total dwell time of the dispenser tip in the immediate vicinity of the support surface.

For liquid-dispensing on a hydrophobic surface, flow of fluid from the tip onto the support surface will continue from the dispenser onto the support surface until it forms a liquid bead. At a given bead size, i.e., volume, the tendency of liquid to flow onto the surface will be balanced by the hydrophobic surface interaction of the bead with the support surface, which acts to limit the total bead area on the surface, and by the surface tension of the droplet, which tends toward a given bead curvature. At this point, a given bead volume will have formed, and continued contact of the dispenser tip with the bead, as the dispenser tip is being withdrawn, will have little or no effect on bead volume.

The desired deposition volume, i.e., bead volume, formed is preferably in the range 2 pl (picoliters) to 2 nl (nanoliters), although volumes as high as 100 nl or more may be dispensed. It will be appreciated that the selected dispensed volume will depend on (i) the "footprint" of the dispenser tip(s), i.e., the size of the area spanned by the tip(s), (ii) the hydrophobicity of the support surface, and (iii) the time of contact with and rate of withdrawal of the tip(s) from the support surface. In addition, bead size may be reduced by increasing the viscosity of the medium, effectively reducing the flow time of liquid from the dispensing device onto the support surface. The drop size may be further constrained by depositing the drop in a hydrophilic region surrounded by a hydrophobic grid pattern on the support surface.

At a given tip size, bead volume can be reduced in a controlled fashion by increasing surface hydrophobicity, reducing time of contact of the tip with the surface, increasing rate of movement of the tip away from the surface, and/or increasing the viscosity of the medium. Once these parameters are fixed, a selected deposition volume in the desired picoliter to nanoliter range can be achieved in a repeatable fashion.

After depositing a liquid droplet of a *Bacillus licheniformis* gene sample at one selected location on a support, the tip may be moved to a corresponding position on a second support, the *Bacillus licheniformis* gene sample is deposited at that position, and this process is repeated until the random nucleic acid fragment sample has been deposited at a selected position on a plurality of supports.

This deposition process may then be repeated with another random nucleic acid fragment sample at another microarray position on each of the supports.

The diameter of each *Bacillus licheniformis* gene region is preferably between about 20-200 µm. The spacing between each region and its closest (non-diagonal) neighbor, measured from center-to-center, is preferably in the range of about 20-400 µm. Thus, for example, an array having a center-to-center spacing of about 250 µm contains about 40 regions/cm or 1,600 regions/cm$^2$. After formation of the array, the support is treated to evaporate the liquid of the droplet forming each region, to leave a desired array of dried, relatively flat *Bacillus licheniformis* gene or oligo thereof regions. This drying may be done by heating or under vacuum. The DNA can also be UV-crosslinked to the polymer coating.

Nucleic Acid Probes. In the methods of the present invention, the strains are cultivated in a nutrient medium with and without a substrate using methods well known in the art for isolation of nucleic acids to be used as probes. For example, the strains may be cultivated by shake flask cultivation, small-scale or large-scale fermentation (including continuous, batch, fed-batch, or solid state fermentations) in laboratory or industrial fermentors performed in a suitable medium. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection).

The nucleic acid probes from the microbial strains cultured on medium with and without substrate may be any nucleic acid including genomic DNA, cDNA, and RNA, and may be isolated using standard methods known in the art.

The populations of isolated nucleic acid probes may be labeled with detection reporters such as colorimetric, radioactive for example, $^{32}$P, $^{33}$P, or $^{35}$S), fluorescent reporters, or other reporters using methods known in the art (Chen et al., 1998, *Genomics* 51: 313-324; DeRisi et al., 1997, *Science* 278: 680-686; U.S. Pat. No. 5,770,367).

In a preferred aspect, the probes are labeled with fluorescent reporters. For example, the DNA probes may be labeled during reverse transcription from the respective RNA pools by incorporation of fluorophores as dye-labeled nucleotides (DeRisi et al., 1997, supra), e.g., Cy5-labeled deoxyuridine triphosphate, or the isolated cDNAs may be directly labeled with different fluorescent functional groups. Fluorescent-labeled nucleotides include, but are not limited to, fluorescein conjugated nucleotide analogs (green fluorescence), lissamine nucleotide analogs (red fluorescence). Fluorescent functional groups include, but are not limited to, Cy3 (a green fluorescent dye) and Cy5 (red fluorescent dye).

Array Hybridization. The labeled nucleic acids from the two strains cultivated with and without substrate are then added to an array of *Bacillus licheniformis* genes under conditions where the nucleic acid pools from the two strains hybridize to complementary sequences of the *Bacillus licheniformis* genes on the array. For purposes of the present invention, hybridization indicates that the labeled nucleic acids from the two strains hybridize to the *Bacillus licheniformis* genes under very low to very high stringency conditions.

A small volume of the labeled nucleic acids mixture is loaded onto the substrate. The solution will spread to cover the entire microarray. In the case of a multi-cell substrate, one or more solutions are loaded into each cell which stop at the barrier elements.

For nucleic acid probes of at least about 100 nucleotides in length, miroarray hybridization conditions described by Eisen and Brown, 1999, *Methods of Enzymology* 303: 179-205, may be used. Hybridization is conducted under a cover slip at 65° C. in 3×SSC for 4-16 hours followed by post-hybridization at room temperature after removal of the cover slip in 2×SSC, 0.1% SDS by washing the array two or three times in the solution, followed by successive washes in 1×SSC for 2 minutes and 0.2×SSC wash for two or more minutes.

Conventional conditions of very low to very high stringency conditions may also be used. Very low to very high stringency conditions are defined as prehybridization and hybridization at 42° C. in 5×SSPE, 0.3% SDS, 200 µg/ml sheared and denatured salmon sperm DNA, and either 25% formamide for very low and low stringencies, 35% formamide for medium and medium-high stringencies, or 50% formamide for high and very high stringencies, following standard Southern blotting procedures.

The carrier material is finally washed three times each for 15 minutes using 2×SSC, 0.2% SDS preferably at least at 45° C. (very low stringency), more preferably at least at 50° C. (low stringency), more preferably at least at 55° C. (medium stringency), more preferably at least at 60° C. (medium-high stringency), even more preferably at least at 65° C. (high stringency), and most preferably at least at 70° C. (very high stringency).

For shorter nucleic acid probes which are less than 50 nucleotides, microarray hybridization conditions described by Kane et al., 2000, *Nucleic Acids Research* 28: 4552-4557, may be used. Hybridization is conducted under a supported coverslip at 42° C. for 16-18 hours at high humidity in 50% formamide, 4.1× Denhardt's solution, 4.4×SSC, and 100 µg/ml of herring sperm DNA. Arrays are washed after removal of the coverslip in 4×SSC by immersion into 1×SSC, 0.1% SDS for 10 minutes, 0.1×SSC, 0.1% SDS twice for 10 minutes, and 0.1×SSC twice for 10 minutes.

For shorter nucleic acid probes which are about 50 nucleotides to about 100 nucleotides in length, conventional stringency conditions may be used. Such stringency conditions are defined as prehybridization, hybridization, and washing post-hybridization at 5° C. to 10° C. below the calculated $T_m$ using the calculation according to Bolton and McCarthy (1962, *Proceedings of the National Academy of Sciences USA* 48:1390) in 0.9 M NaCl, 0.09 M Tris-HCl pH 7.6, 6 mM EDTA, 0.5% NP-40, 1× Denhardt's solution, 1 mM sodium pyrophosphate, 1 mM sodium monobasic phosphate, 0.1 mM ATP, and 0.2 mg of yeast RNA per ml following standard Southern blotting procedures.

The carrier material is finally washed once in 6×SSC plus 0.1% SDS for 15 minutes and twice each for 15 minutes using 6×SSC at 5° C. to 10° C. below the calculated $T_m$.

The choice of hybridization conditions will depend on the degree of homology between the *Bacillus licheniformis* genes and the nucleic acid probes obtained from the strain cultured with and without inducing substrate. For example, where the nucleic acid probes and the *Bacillus licheniformis* genes are obtained from identical strains, high stringency conditions may be most suitable. Where the strains are from a genus or species different from which the *Bacillus licheniformis* genes were obtained, low or medium stringency conditions may be more suitable.

In a preferred aspect, the hybridization is conducted under low stringency conditions. In a more preferred aspect, the hybridization is conducted under medium stringency conditions. In a most preferred aspect, the hybridization is conducted under high stringency conditions.

The entire solid support is then reacted with detection reagents if needed and analyzed using standard colorimetric, radioactive, or fluorescent detection means. All processing and detection steps are performed simultaneously to all of the microarrays on the solid support ensuring uniform assay conditions for all of the microarrays on the solid support.

Detection. The most common detection method is laser-induced fluorescence detection using confocal optics (Cheung et al., 1998, *Nat. Genet.* 18: 225-230). The array is examined under fluorescence excitation conditions such that (i) the *Bacillus licheniformis* genes on the array that hybridize to the first nucleic acid probes obtained from the strain cultured without inducing substrate and to the second nucleic acid probes obtained from the strain cultured with inducing substrate produce a distinct first fluorescence emission color and a distinct second fluorescence emission color, respectively, and (ii) the *Bacillus licheniformis* genes on the array that hybridize to substantially equal numbers of nucleic acid probes obtained from the strain cultured without inducing substrate and from the strain cultured with inducing substrate produce a distinct combined fluorescence emission color; wherein the relative expression of the genes in the strains can be determined by the observed fluorescence emission color of each spot on the array.

The fluorescence excitation conditions are based on the selection of the fluorescence reporters. For example, Cy3 and Cy5 reporters are detected with solid state lasers operating at 532 nm and 632 nm, respectively.

However, other methods of detection well known in the art may be used such as standard photometric, calorimetric, or radioactive detection means, as described earlier.

Data Analysis. The data obtained from the scanned image may then be analyzed using any of the commercially available image analysis software. The software preferably identifies array elements, subtracts backgrounds, deconvolutes multi-color images, flags or removes artifacts, verifies that controls have performed properly, and normalizes the signals (Chen et al., 1997, *Journal of Biomedical Optics* 2: 364-374).

Several computational methods have been described for the analysis and interpretation of microarray-based expression profiles including cluster analysis (Eisen et al., 1998, *Proc. Nat. Acad. Sci. USA* 95: 14863-14868), parametric ordering of genes (Spellman et al., 1998, *Mol. Biol. Cell* 9: 3273-3297), and supervised clustering methods based on representative hand-picked or computer-generated expression profiles (Chu et al., 1998. *Science* 282: 699-705). Preferred methods for evaluating the results of the microarrays employ statistical analysis to determine the significance of the differences in expression levels. In the methods of the present invention, the difference in the detected expression level is at least about 10% or greater, preferably at least about 20% or greater, more preferably at least about 50% or greater, even more preferably at least about 75% or greater; and most preferably at least about 100% or greater.

One such preferred system is the Significance Analysis of Microarrays (SAM) (Tusher et al., 2001, *Proc. Natl. Acad. Sci. USA* 98: 5116-5121). Statistical analysis allows the determination of significantly altered expression of levels of about 50% or even less. The PAM (or predictive analysis for microarrays) represents another approach for analyzing the results of the microarrays (Tibshirani et al., 2002, *Proc. Natl. Acad. Sci. USA* 99: 6567-6572).

Cluster algorithms may also be used to analyze microarray expression data. From the analysis of the expression profiles it is possible to identify co-regulated genes that perform common metabolic or biosynthetic functions. Hierarchical clustering has been employed in the analysis of microarray expression data in order to place genes into clusters based on sharing similar patterns of expression (Eisen et al., 1998, supra). This method yields a graphical display that resembles a kind of phylogenetic tree where the relatedness of the expression behavior of each gene to every other gene is depicted by branch lengths. The programs Cluster and TreeView, both written by Michael Eisen (Eisen et al., 1998 *Proc. Nat. Acad. Sci. USA* 95: 14863-14868) are freely available. Genespring is a commercial program available for such analysis (Silicon Genetics, Redwood City, Calif.).

Self-organizing maps (SOMs), a non-hierarchical method, have also been used to analyze microarray expression data (Tamayo et al., 1999, *Proc. Natl. Acad. Sci. USA* 96: 2907-2912). This method involves selecting a geometry of nodes, where the number of nodes defines the number of clusters. Then, the number of genes analyzed and the number of experimental conditions that were used to provide the expression values of these genes are subjected to an iterative process (20,000-50,000 iterations) that maps the nodes and data points into multidimensional gene expression space. After the identification of significantly regulated genes, the expression level of each gene is normalized across experiments. As a result, the expression profile of the genome is highlighted in a manner that is relatively independent of each gene's expression magnitude. Software for the "GENECLUSTER" SOM program for microarray expression analysis can be obtained from the Whitehead/MIT Center for Genome Research. SOMs can also be constructed using the GeneSpring software package.

Isolation of Genes. Probes containing genes or portions thereof identified to be induced by the present of substrate in the medium are characterized by determining the sequence of the probe. Based on the sequence, the gene can then be isolated using methods well known in the art.

The techniques used to isolate or clone a gene include isolation from genomic DNA, preparation from cDNA, or a combination thereof. The cloning of the gene from such genomic DNA can be effected, e.g., by using the well known polymerase chain reaction (PCR) or antibody screening of expression libraries to detect cloned DNA fragments with shared structural features. See, e.g., Innis et al., 1990, *PCR: A Guide to Methods and Application*, Academic Press, New York. Other nucleic acid amplification procedures such as ligase chain reaction (LCR), ligated activated transcription (LAT) and nucleic acid sequence-based amplification (NASBA) may be used. The gene may be cloned from the strain of interest, or another or related organism and thus, for example, may be an allelic or species variant of the gene.

Methods for Monitoring Differential Expression of a Plurality of Genes

The present invention also relates to methods for monitoring differential expression of a plurality of genes in a first bacterial cell relative to expression of the same genes in one or more second bacterial cells, comprising:

(a) adding a mixture of detection reporter-labeled nucleic acids isolated from the bacterial cells to a substrate containing an array of *Bacillus licheniformis* genes selected from the group consisting of nucleotides SEQ ID NOs: 2-4198, complementary strands of SEQ ID NOs: 2-4198, or fragments of SEQ ID NOs: 2-4198, under conditions where the detection reporter-labeled nucleic acids hybridize to complementary sequences of the *Bacillus licheniformis* genes on the array, wherein the nucleic acids from the first bacterial cell and the one or more second bacterial cells are labeled with a first detection reporter and one or more different second detection reporters, respectively; and (b) examining the array under conditions wherein the relative expression of the genes in the bacterial cells is determined by the observed detection signal of each spot on the array in which (i) the *Bacillus licheniformis* genes on the array that hybridize to the nucleic acids obtained from either the first or the one or more second bacterial cells produce a distinct first detection signal or one or more second detection signals, respectively, and (ii) the *Bacillus licheniformis* genes on the array that hybridize to the nucleic acids obtained from both the first and one or more second bacterial produce a distinct combined detection signal.

The methods of the present invention may be used to monitor global expression of a plurality of genes from a *Bacillus* cell, discover new genes, identify possible functions of unknown open reading frames, and monitor gene copy number variation and stability. For example, the global view of changes in expression of genes may be used to provide a picture of the way in which *Bacillus* cells adapt to changes in culture conditions, environmental stress, or other physiological provocation. Other possibilities for monitoring global expression include spore morphogenesis, recombination, metabolic or catabolic pathway engineering.

The methods of the present invention are particularly advantageous since one spot on an array equals one gene or open reading frame because extensive follow-up characterization is unnecessary since sequence information is available, and the *Bacillus licheniformis* microarrays can be organized based on function of the gene products.

Microarrays. Methods for preparing the microarrays are described herein.

Bacterial Cells. In the methods of the present invention, the two or more *Bacillus* cells may be any *Bacillus* cell where one of the cells is used as a reference for identifying differences in expression of the same or similar complement of genes in the other cell(s). In one aspect, the two or more cells are the same cell. For example, they may be compared under different growth conditions, e.g., oxygen limitation, nutrition, and/or physiology. In another aspect, one or more cells are mutants of the reference cell. For example, the mutant(s) may have a different phenotype. In a further aspect, the two or more cells are of different species (e.g., *Bacillus clausii* and *Bacillus subtilis*). In another further aspect, the two or more cells are of different genera. In an even further aspect, one or more cells are transformants of the reference cell, wherein the one or more transformants exhibit a different property. For example, the transformants may have an improved phenotype relative to the reference cell and/or one of the other transformants. The term "phenotype" is defined herein as an observable or outward characteristic of a cell determined by its genotype and modulated by its environment. Such improved phenotypes may include, but are not limited to, improved secretion or production of a protein or compound, reduced or no secretion or production of a protein or compound, improved or reduced expression of a gene, desirable morphology, an altered growth rate under desired conditions, relief of overexpression mediated growth inhibition, or tolerance to low oxygen conditions.

The *Bacillus* cells may be any *Bacillus* cells, but preferably *Bacillus alkalophilus, Bacillus amyloliquefaciens, Bacillus brevis, Bacillus cereus, Bacillus circulans, Bacillus clausii, Bacillus coagulans, Bacillus fastidiosus, Bacillus firmus, Bacillus lautus, Bacillus lentus, Bacillus licheniformis, Bacillus macerans, Bacillus megaterium, Bacillus methanolicus, Bacillus pumilus, Bacillus sphaericus, Bacillus stearothermophilus, Bacillus subtilis,* or *Bacillus thuringiensis* cells.

In a preferred aspect, the *Bacillus* cells are *Bacillus alkalophilus* cells. In another preferred aspect, the *Bacillus* cells are *Bacillus amyloliquefaciens* cells. In another preferred aspect, the *Bacillus* cells are *Bacillus brevis* cells. In another preferred aspect, the *Bacillus* cells are *Bacillus cereus* cells In another preferred aspect, the *Bacillus* cells are *Bacillus circulans* cells. In another preferred aspect, the *Bacillus* cells are *Bacillus clausii* cells. In another preferred aspect, the *Bacillus* cells are *Bacillus coagulans* cells. In another preferred aspect, the *Bacillus* cells are *Bacillus fastidiosus* cells. In another preferred aspect, the *Bacillus* cells are *Bacillus firmus* cells. In another preferred aspect, the *Bacillus* cells are *Bacillus lautus* cells. In another preferred aspect, the *Bacillus* cells are *Bacillus lentus* cells. In another preferred aspect, the *Bacillus* cells are *Bacillus licheniformis* cells. In another preferred aspect, the *Bacillus* cells are *Bacillus macerans* cells. In another preferred aspect, the *Bacillus* cells are *Bacillus megaterium* cells. In another preferred aspect, the *Bacillus* cells are *Bacillus methanolicus* cells. In another preferred aspect, the *Bacillus* cells are *Bacillus pumilus* cells. In another preferred aspect, the *Bacillus* cells are *Bacillus sphaericus* cells. In another preferred aspect, the *Bacillus* cells are *Bacillus stearothermophilus* cells. In another preferred aspect, the *Bacillus* cells are *Bacillus subtilis* cells. In another preferred aspect, the *Bacillus* cells are *Bacillus thuringiensis* cells.

In a more preferred aspect, the *Bacillus* cells are *Bacillus licheniformis* cells. In a most preferred aspect, the *Bacillus licheniformis* cells are *Bacillus licheniformis* ATCC 14580 cells.

In another more preferred aspect, the *Bacillus* cells are *Bacillus clausii* cells. In another most preferred aspect, the *Bacillus clausii* cells are *Bacillus clausii* NCIB 10309 cells.

It will be understood that the term "*Bacillus*" also encompasses relatives of *Bacillus* such as *Paenibacillus, Oceanobacillus,* and the like.

In the methods of the present invention, the cells are cultivated in a nutrient medium suitable for growth using methods well known in the art for isolation of the nucleic acids to be used as probes. For example, the cells may be cultivated by shake flask cultivation, small-scale or large-scale fermentation (including continuous, batch, fed-batch, or solid state fermentations) in laboratory or industrial fermentors performed in a suitable medium. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection).

Nucleic Acid Probes. The nucleic acid probes from the two or more *Bacillus* cells may be any nucleic acid including genomic DNA, cDNA, and RNA, and may be isolated using standard methods known in the art, as described herein. The populations of isolated nucleic acid probes may be labeled with calorimetric, radioactive, fluorescent reporters, or other reporters using methods described herein.

In a preferred aspect, the probes are labeled with fluorescent reporters, e.g., Cy3 (a green fluorescent dye) and Cy5 (red fluorescent dye), as described herein.

Array Hybridization. The labeled nucleic acids from the two or more *Bacillus* cells are then added to a substrate containing an array of *Bacillus licheniformis* genes under conditions, as described herein, where the nucleic acid pools from the two or more *Bacillus* cells hybridize to complementary sequences of the *Bacillus licheniformis* genes on the array.

Detection and Data Analysis. The same methods as described herein are used for detection and data analysis.

Computer Readable Media and Computer-Based Systems

The *Bacillus licheniformis* chromosome and its genes described herein may be "provided" in a variety of media to facilitate their use. The term "provided" refers to a manufacture comprising an array of *Bacillus licheniformis* genes. Such manufactures provide the *Bacillus licheniformis* genes in a form which allows one skilled in the art to examine the manufacture using means not directly applicable to examining the chromosome or a subset thereof as it exists in nature or in purified form.

Thus, the present invention also relates to such a manufacture in the form of a computer readable medium comprising an array of *Bacillus licheniformis* genes selected from the group consisting of nucleotides SEQ ID NOs: 2-4198, complementary strands of SEQ ID NOs: 2-4198, or fragments of SEQ ID NOs: 2-4198.

In one application of this aspect, the *Bacillus licheniformis* genes of the present invention can be recorded on computer readable media. The term "computer readable media" is defined herein as any medium which can be read and accessed by a computer. Such computer readable media include, but are not limited to, magnetic storage media, e.g., floppy discs, hard disc storage medium, and magnetic tape; optical storage media, e.g., CD-ROM, DVD; electrical storage media, e.g., RAM and ROM; and hybrids of these categories, e.g., magnetic/optical storage media. One skilled in the art can readily appreciate how any of the presently known computer readable media can be used to create a manufacture comprising computer readable medium having recorded thereon a nucleotide sequence of the present invention. Likewise, it will be clear to those of skill how additional computer readable media that may be developed also can be used to create analogous manufactures having recorded thereon a nucleotide sequence of the present invention.

As used herein, "recorded" refers to a process for storing information on computer readable medium. One skilled in the art can readily adopt any of the presently known methods for recording information on computer readable medium to generate manufactures comprising the nucleotide sequence information of the present invention.

A variety of data storage structures are available for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data-processor structuring formats (e.g., text file or database) in order to obtain computer readable medium having recorded thereon the nucleotide sequence information of the present invention.

Various computer software programs are publicly available that allow a skilled artisan to access sequence information provided in a computer readable medium. Thus, by providing in computer readable form an array of *Bacillus licheniformis* genes selected from the group consisting of nucleotides SEQ ID NOs: 2-4198, complementary strands of SEQ ID NOs: 2-4198, or fragments of SEQ ID NOs: 2-4198, enables one skilled in the art to routinely access the provided sequence information for a wide variety of purposes.

Software utilizing the BLAST (Altschul et al., 1990, supra), BLAZE (Brutlag et al., 1993, *Comp. Chem.* 17: 203-207), GENEMARK (Lukashin and Borodovsky, 1998, *Nucleic Acids Research* 26: 1107-1115), GENSCAN (Burge and Karlin, 1997, *Journal of Molecular Biology* 268: 78-94), GLIMMER (Salzberg et al., 1998, *Nucleic Acids Research* 26: 544-548), and GRAIL (Xu et al., 1994, *Comput. Appl. Biosci.* 10: 613-623) search algorithms may be used to identify open reading frames (ORFs) within a genome of interest, which contain homology to ORFs or proteins from both *Bacillus licheniformis* and *Bacillus clausii* and from other organisms. Among the ORFs discussed herein are protein encoding fragments of the *Bacillus licheniformis* and *Bacillus clausii* genomes useful in producing commercially important proteins, such as enzymes used in fermentation reactions and in the production of commercially useful metabolites.

The present invention further provides systems, particularly computer-based systems, which contain the sequence information described herein. Such systems are designed to identify, among other things, genes and gene products—many of which could be products themselves or used to genetically modify an industrial expression host through increased or decreased expression of a specific gene sequence(s).

The term "a computer-based system" is herein defined as the hardware means, software means, and data storage means used to analyze the nucleotide sequence information of the present invention. The minimum hardware means of the computer-based systems of the present invention comprises a central processing unit (CPU), input means, output means, and data storage means. One skilled in the art can readily appreciate that any currently available computer-based system is suitable for use in the present invention.

As stated above, the computer-based systems of the present invention comprise a data storage means having stored therein a nucleotide sequence of the present invention and the necessary hardware means and software means for supporting and implementing a search means.

The term "data storage means" is defined herein as memory which can store nucleotide sequence information of the present invention, or a memory access means which can access manufactures having recorded thereon the nucleotide sequence information of the present invention.

The term "search means" refers is defined herein as one or more programs which are implemented on the computer-based system to compare a target sequence or target structural motif with the sequence information stored within the data storage means. Search means are used to identify fragments or regions of the present genomic sequences which match a particular target sequence or target motif. A variety of known algorithms are disclosed publicly and a variety of commercially available software for conducting search means are and can be used in the computer-based systems of the present invention. Examples of such software includes, but is not limited to, MacPattern (Fuchs, 1991, *Comput. Appl. Biosci.* 7: 105-106), BLASTN and BLASTX National Center for Biotechnology Information (NCBI). One skilled in the art can readily recognize that any one of the available algorithms or implementing software packages for conducting homology searches can be adapted for use in the present computer-based systems.

The term "target sequence" is defined here as any DNA (genomic DNA, cDNA) or amino acid sequence of six or more nucleotides or two or more amino acids. One skilled in the art can readily recognize that the longer a target sequence is, the less likely a target sequence will be present as a random occurrence in the database. The most preferred sequence length of a target sequence is from about 10 to 100 amino acids or from about 30 to 300 nucleotide residues. However, it is well recognized that searches for commercially important fragments, such as sequence fragments involved in gene expression and protein processing, may be of shorter length.

The term "a target structural motif" or "target motif" is defined herein as any rationally selected sequence or combination of sequences in which the sequence(s) are chosen based on a three-dimensional configuration which is formed upon the folding of the target motif. There are a variety of target motifs known in the art. Protein target motifs include, but are not limited to, enzyme active sites and signal sequences, substrate and cofactor binding domains, transmembrane domains, and sites for post-translational modifications. Nucleic acid target motifs include, but are not limited to, promoter sequences, hairpin structures and inducible expression elements (protein binding sequences), repeats, palindromes, dyad symmetries, and transcription and translation start and stop sites.

A variety of structural formats for the input and output means can be used to input and output the information in the computer-based systems of the present invention. A preferred format for an output means ranks fragments of the *Bacillus licheniformis* or *Bacillus clausii* genomic sequences possessing varying degrees of homology to the target sequence or target motif. Such presentation provides one skilled in the art with a ranking of sequences which contain various amounts of the target sequence or target motif and identifies the degree of homology contained in the identified fragment.

A variety of comparing means can be used to compare a target sequence or target motif with the data storage means to identify sequence fragments of the *Bacillus licheniformis* and *Bacillus clausii* genomes. For example, implementing software which utilize the BLAST and BLAZE algorithms, described in Altschul et al., 1990, supra, may be used to identify open reading frames within the *Bacillus licheniformis* or *Bacillus clausii* genome or the genomes of other organisms. A skilled artisan can readily recognize that any one of the publicly available homology search programs can be used as the search means for the computer-based systems of the present invention. Suitable proprietary systems that may be known to those of skill also may be employed in this regard.

Codon Usage Tables

The present invention further relates to methods for preparing a synthetic gene, comprising (a) generating a codon usage table based on codons used in one or more open reading frames or portions thereof of SEQ ID NO: 1, (b) constructing a synthetic gene or portion thereof that contains in place of one or more native codons one or more preferred codons from the codon usage table, and (c) recovering the synthetic gene. In a preferred aspect, the codon usage table is Table 4 and/or Table 5.

The *Bacillus licheniformis* chromosomal sequence of SEQ ID NO: 1 or portions thereof can be used to generate codon usage tables to design synthetic genes for their efficient heterologous expression in *Bacillus licheniformis* host cells. The codon usage tables can be based on (1) the codon used in all the open reading frames, (2) selected open reading frames, (3) fragments of the open reading frames, or (4) fragments of selected open reading frames. With a codon usage table, synthetic genes can be designed with only the most preferred codon for each amino acid; with a number of common codons for each amino acid; or with the same or a similar statistical average of codon usages found in the table of choice.

The synthetic gene can be constructed using any method such as site-directed mutagenesis or PCR generated mutagenesis in accordance with methods known in the art. Although, in principle, the modification may be performed in vivo, i.e., directly on the cell expressing the nucleotide sequence to be modified, it is preferred that the modification is performed in vitro.

The synthetic gene can be further modified by operably linking the synthetic gene to one or more control sequences which direct the expression of the coding sequence in a suitable host cell under conditions compatible with the control sequences using the methods described herein. Nucleic acid constructs, recombinant expression vectors, and recombinant host cells comprising the synthetic gene can also be prepared using the methods described herein.

The present invention also relates to methods for producing a polypeptide encoded by such a synthetic gene comprising (a) cultivating a host cell comprising the synthetic gene under conditions conducive for production of the polypeptide; and (b) recovering the polypeptide.

The present invention is further described by the following examples which should not be construed as limiting the scope of the invention.

EXAMPLES

Example 1

Shotgun DNA Sequencing and Genome Assembly

The genome of the type strain *Bacillus licheniformis* ATCC 14580 was sequenced by a combination of the whole genome shotgun method described by Wilson, R. K. and Mardis, E. R., 1997, In *Genome Analysis: A Laboratory Manual*, Vol. 1, eds. Birren, B., Green, E. D., Meyers, R. M., and Roskams, J. (Cold Spring Harbor Press, Cold Spring Harbor, N.Y.), pp. 397-454, and fosmid end sequencing (Kim, U. J., Shizuya, H., de Jong, P. J., Birren, B. and Simon, M. I., 1992, *Nucleic Acids Res.* 20: 1083-1085; Longmire, J. L. and Brown, N.C., 2003, *Biotechniques* 35: 50-54; Zhao, S., Malek, J., Mahairas, G., Fu, L., Nierman, W., Venter, J. C., and Adams, M. D., 2000, *Genomics* 63: 321-332).

Genomic DNA of *Bacillus licheniformis* ATCC 14580 was isolated using the following method: A single colony was used to inoculate 20 ml of LB broth (Davis, R. W., Botstein, D., and Roth, J. R. 1980, *Advanced Bacterial Genetics*, Cold Spring Harbor Press, Cold Spring Harbor, N.Y.) in a sterile 125 ml Erlenmeyer flask. The culture was incubated at 37° C. overnight with agitation at 240 rpm. The resulting cells were collected by centrifugation in a 45 ml Oak Ridge tube for 10 minutes at 6000×g, and the cell pellet was resuspended in 5 ml of Tris-glucose buffer (50 mM Tris-HCl, pH 8.0, 50 mM glucose, 10 mM EDTA). Lysozyme was added to a final concentration of 50 µg/ml and the suspension was incubated in a 37° C. water bath for 25 minutes. Next, 200 µl of 10% SDS was added and the tubes were gently inverted several times. Five milliliters of a second detergent mixture (1% Brij, 1% deoxycholate, 50 mM EDTA, pH 7.5) was added, and the tubes were inverted several times while incubating for 20 minutes at room temperature. An equal volume of phenol:chloroform (1:1 v/v) was added and the tubes were inverted gently at room temperature for 20-30 minutes. The tubes were centrifuged for 20 minutes at 12,000×g, 4° C. The top aqueous layer was carefully removed with a wide-bore pipette and placed in a clean 45 ml Oak Ridge tube. The phenol:chloroform extraction was repeated and 1/10 volume of 3 M sodium acetate pH 5.2 was added to the aqueous layer. Two volumes of cold ethanol were carefully layered on top and the DNA was spooled from the solution onto a sterile glass rod. Spooled DNA was carefully rinsed in 70% ethanol and resuspended in a suitable amount of TE buffer (10 mM Tris-HCl, pH 8.0, 1 mM EDTA).

Plasmid libraries were constructed using randomly-sheared and BamHI-digested genomic DNA that was enriched for 2-3 kb fragments by preparative agarose gel electrophoresis (Berka, R. M., Schneider, P., Golightly, E. J., Brown, S. H., Madden, M., Brown, K. M., Halkier, T., Mondorf, K., and Xu, F., 1997, *Appl. Environ. Microbiol.* 63: 3151-3157). Approximately 49,000 random clones were sequenced using dye-terminator chemistry (Applied Biosystems, Foster City, Calif.) with ABI 377 and ABI 3700 automated sequencers yielding approximately 6× coverage of the genome. A combination of methods was employed for gap closure including sequencing on fosmids (Kim, U. J., Shizuya, H., de Jong, P. J., Birren, B., and Simon, M. I., 1992, *Nucleic Acids Res.* 20: 1083-1085), primer walking on selected clones, and PCR-amplified DNA fragments. Fosmid libraries were constructed using a commercial kit from Epicentre (Madison. WI). Data from both ends of approximately 1975 fosmid clones with an average insert size of 40 kb were incorporated to aid in validation of the final assembly. In total, the number of input reads was 62,685 with 78.6% of these incorporated into the final assembly. Sequences were base called using TraceTuner 2.0 (Paracel, Inc., Pasadena, Calif.) and assembled using the Paracel Genome Assembler (Paracel, Inc., Pasadena, Calif.) with optimized parameters and the quality score set to >20. Phrap, Crossmatch, and Consed were used for sequence finishing (Gordon D., Abajian C., and Green P., 1998, *Genome Res.* 8: 195-202).

Example 2

Identification And Annotation of Open Reading Frames (ORFs)

Protein coding regions in the assembled genome sequence data were identified using EasyGene (Larsen, T. S., and Krogh, A., 2003, *BMC Bioinformatics* 4: 21), Glimmer (Delcher, A, L., Harmon, D., Kasif, S., White, O. and Salzberg, S. L., 1999, *Nucleic Acids Res.* 27, 4636-4641), and FrameD (Schiex, T., Gouzy, J., Moisan, A. and de Oliveira, Y., 2003, *Nucleic Acids Res.* 31, 3738-3741). Only EasyGene gene models with an R-value of less than 2 and log-odds score greater than −10 were used. Predicted proteins were compared to the non-redundant database PIR-NREF (Wu, C. H., Huang, H., Arminski, L., Castro-Alvear, J., Chen, Y., Hu, Z. Z., Ledley, R. S., Lewis, K. C., Mewes, H. W., Orcutt, B. C., 2002, *Nucleic Acids Research* 30: 35-37) and the *Bacillus subtilis* genome (SubtilList) using BLASTP with an E-value threshold of $10^{-5}$. InterProScan was used to predict putative function. (Zdobnov, E. M. and Apweiler, R., 2001, *Bioinformatics* 17, 847-848). The InterPro analysis included comparison to Pfam (Bateman, A., Coin, L., Durbin, R., Finn, R. D., Hollich, V., Griffiths-Jones, S., Khanna, A., Sonnhammer, E. L. et al., 2004, *Nucleic Acids Res.* 32, D138-D141), TIGRfam (Haft, D. J., Selengut, J. D. and White, O., 2003, *Nucleic Acids Res.* 31: 371-373), Interpro (Apweiler, R., Attwood, T. K., Bairock, A., Bateman, A., Birney, E., Biswas, M., Bucher, P., Cerutti, L., Corpet, F., Croning, M. D., et al., 2001, *Nucleic Acids Res.* 29: 37-40), signal peptide prediction using SignalP (Nielsen, H., Engelbrecht, J., Brunak, S., and von Heijne, G., 1997, *Protein Engineering* 10: 1-6), and trans-membrane domain prediction using TMHMM (Krogh, A., Larsson, B., von Heijne, G. and Sonnhammer, E. L. L., 2000, *J. Mol. Biol.* 305, 567-580).

These ORFs were assigned to functional categories based on the Cluster of Orthologous Groups (COG) database with manual verification as described (Tatusov, R. L., Koonin, E. V. and Lipman, D. J., 1997, *Science* 278: 631-637; Koonin, E. V. and Galperin, M. Y., 2002, Sequence-Evolution-Function: Computational Approaches in Comparative Genomics (Kluwer, Boston)). Transfer RNA genes were identified using tRNAscan-SE (Lowe, T. M. and Eddy, S. R., 1997, *Nucleic Acids Res.* 25: 955-964).

Example 3

General Features of the *Bacillus licheniformis* Genome

The genome of *Bacillus licheniformis* ATCC 14580 was determined to consist of a circular molecule of 4,222,336 bp with an average GC content of 46.2% (Table 2). No plasmids were found during the genome analysis, and none were found by agarose gel electrophoresis.

The genome contains 4208 predicted protein-coding genes with an average size of 873 bp, seven rRNA operons, and 81 tRNA genes. Using a combination of several gene-finding algorithms 4208 protein coding ORFs were predicted. These ORFs constitute 87% of the genome and have an average length of 873 bp. Approximately 48% of the ORFs are encoded on one DNA strand and 52% on the other strand. Among the protein coding ORFs, 3948 (94%) have significant similarity to proteins in PIR, and 3187 of these gene models contain Interpro motifs and 2895 contain protein motifs found in PFAM. The number of hypothetical and conserved hypothetical proteins in the *Bacillus licheniformis* genome with hits in the PIR database was 1318 (212 conserved hypothetical ORFs). Among the list of hypothetical and conserved hypothetical ORFs, 683 (52%) have protein motifs contained in PFAM (148 conserved hypothetical ORFs). There are 72 tRNA genes representing all 20 amino acids and 7 rRNA operons.

The likely origin of replication was identified by similarities to several features of *Bacillus subtilis* origin (Moriya, S., Fukuoka, T., Ogasawara, N., and Yoshikawa, H., 1988, *EMBO Journal* 7: 2911-2917; Ogasawara, N., Nakai, S., and Yoshikawa, H., 1994, DNA Res. 1, 1-14; Kadoya, R., Hassan, A. K., Kasahara, Y., Ogasawara, N., and Moriya, S., 2002, *Mol. Microbiol.* 45: 73-87; Tosato, V., Gjuracic, K., Vlahovicek, K., Pongor, S., Danchin, A., and Bruschi, C. V., 2003, *FEMS Microbiol. Lett* 218: 23-30). These included (a) colocalization of four genes (rpmH, dnaA, dnaN, and recF) found near the origin of the *Bacillus subtilis* chromosome, (b) GC nucleotide skew [(G−C)/(G+C)] analysis, and (c) the presence of multiple dnaA-boxes (Pedersen, A. G., Jensen, L. J., Brunak, S., Staerfeldt, H. H., and Ussery, D. W., 2000, *Mol. Biol.* 299: 907-930; Christensen, B. B., Atlung, T., and Hansen, F. G., 1999, *J. Bacteriol.* 181: 2683-2688; Majka, J., Jakimowicz, D., Messer, W., Schrempf, H., Lisowski, M., and Zakrzewska-Czerwińska, J., 1999, *Eur. J. Biochem.* 260: 325-335) and AT-rich sequences in the region immediately upstream of the dnaA gene. On the basis of these observations, a cytosine residue of the BstBI restriction site was assigned between the rpmH and dnaA genes to be the first nucleotide of the *Bacillus licheniformis* genome. The replication termination site was localized near 2.02 Mb by GC skew analysis. This region lies roughly opposite the origin of replication.

Unlike *Bacillus subtilis*, no apparent gene encoding a replication terminator protein (rtp) was found in *Bacillus licheniformis*. The *Bacillus halodurans* genome also lacks an rtp function (Takami, H., Nakasone, K., Takaki, Y., Maeno, G., Sasaki, R., Masui, N., Fuji, F., Hirama, C., Nakamura, Y., Ogasawara, N. et al., 2000, *Nucleic Acids Res.* 28: 4317-4331), and it seems likely that *Bacillus subtilis* acquired the rtp gene following its divergence from *Bacillus halodurans* and *Bacillus licheniformis*.

Transposable elements and prophages. The genome of *Bacillus licheniformis* ATCC 14580 was determined to contain nine identical copies of a 1285 bp insertion sequence element termed IS3BIi1 (Lapidus, A., Galleron, N., Andersen, J. T., Jørgensen, P. L. Ehrlich, S. D., and Sorokin, A., 2002, *FEMS Microbiol. Lett.* 209: 23-30). This sequence shares a number of features with other IS3 family elements including direct repeats of three to five bp, a ten bp left inverted repeat, and a nine bp right inverted repeat. IS3BIi1 encodes two predicted overlapping ORFs, designated orfA and orfB in relative translational reading frames of 0 and −1. The presence of a "slippery heptamer" motif, AAAAAAG, before the stop codon in orfA suggests that programmed translational frameshifting occurs between these two ORFs, resulting in a single gene product (Farabaugh, P., 1996, *Microbiol. Rev.* 60: 103-134). The orfB gene product harbors the DD[35]E[7]K motif, a highly conserved pattern among insertion sequences. Eight of the IS3BIi1 elements lie in intergenic regions, and one interrupts the comP gene. In addition to these insertion sequences, the genome encodes a putative transposase that is most closely related (E=1.8e−11) to one identified in the *Thermoanaerobacter tengcongensis* genome (Bao, Q., Tian, Y., Li, W., Xu, Z.; Xuan, Z., Hu, S., Dong, W., Yang, J., Chen, Y., Xue, Y., et al., 2002, *Genome Res.* 12: 689-700), however, similar genes are also found in the chromosomes of *Bacillus halodurans* (Takami, H., Nakasone, K., Takaki, Y., Maeno, G., Sasaki, R., Masui, N., Fuji, F., Hirama, C., Nakamura, Y., Ogasawara, N. et al., 2000, *Nucleic Acids Res.* 28: 4317-4331), *Oceanobacillus iheyensis* (Takami, H., Takaki, Y., and Uchiyama, I., 2002, *Nucleic Acids Res.* 30: 3927-3935.), *Streptococcus agalactiae* (Takahashi, S., Detrick, S., Whiting, A. A, Blaschke-Bonkowksy, A. J., Aoyagi, Y., Adderson, E. E., and Bohnsack, J. F., 2002, *J. Infect Dis.* 186: 1034-1038), and *Streptococcus pyogenes* (Smoot, J. C., Barbian, K. D., Van Gompel, J. J., Smoot, L. M., Chaussee, M. S., Sylva, G. L., Sturdevant, D. E., Ricklefs, S. M., Porcella, S. F., Parkins, L. D., et al., 2002, *Proc. Natl. Acad. Sci. U.S.A.* 99: 4668-4673).

The presence of several bacteriophage lysogens or prophage-like elements was revealed by Smith-Waterman comparisons to other bacterial genomes and by their AT-rich signatures. Prophage sequences, designated NZP1 and NZP3 (similar to PBSX and φ-105, respectively), were uncovered by noting the presence of nearby genes encoding the large subunit of terminase, a signature protein that is highly conserved among prophages (Casjens, S., 2003, *Mol. Microbiol.* 49: 277-300). A terminase gene was not observed in a third putative prophage, termed NZP2 (similarity to SPP1), however, its absence may be the result of genome deterioration during evolution. Regions were observed in which the GC content is less than 39% usually encoded proteins that have no *Bacillus subtilis* orthologue and share identity only to hypothetical and conserved hypothetical genes. Two of these AT-rich segments correspond to the NZP2 and NZP3 prophages.

An isochore plot also revealed the presence of a region with an atypically high (62%) G+C content. This segment contains two hypothetical ORFs whose sizes (3831 and 2865 bp) greatly exceed the size of an average gene in *Bacillus licheniformis*. The first protein encodes a protein of 1277 amino acids for which Interpro predicted 16 collagen triple helix repeats, and the amino acid pattern TGATGPT is repeated 75 times within the polypeptide. The second ORF is smaller, and encodes a protein with 11 collagen triple helix repeats, and the same TGATGPT motif recurs 56 times. Interestingly, the chromosomal region (19 kb) adjacent to these genes is clearly non-colinear with the *Bacillus subtilis* genome, and virtually all of the predicted ORFs are hypothetical or conserved hypothetical proteins. There are a number of bacterial proteins listed in PIR that contain collagen triple helix repeat regions including two from *Mesorhizobium loti* (accession numbers NF00607049 and NF00607035) and three from *Bacillus cereus* (accession numbers NF01692528, NF01269899, and NF01694666). These putative orthologs share 53-76% amino acid sequence identity with their counterparts in *Bacillus licheniformis*, although their functions are unknown.

Extracellular enzymes. In the *Bacillus licheniformis* genome, 689 of the 4208 gene models have signal peptides as forecasted by SignalP (Identification of prokaryotic and eukaryotic signal peptides and prediction of their cleavage sites. Henrik Nielsen, Jacob Engelbrecht, Søren Brunak and Gunnar von Heijne, 1997, *Protein Engineering* 10: 1-6). Of these, 309 have no trans-membrane domain as predicted with TMHMM (A. Krogh, B. Larsson, G. von Heijne, and E. L. L. Sonnhammer, 2000, *Journal of Molecular Biology* 305: 567-580) and 134 are hypothetical or conserved hypothetical genes. Based on a manual examination of the remaining 175 ORFs, at least 82 were determined to likely encode secreted proteins and enzymes. The sequence ID numbers for each of these genes are listed in Table 3.

Protein secretion, sporulation, and competence pathways. Kunst et al. (Kunst, F., Ogasawara, N, Mozser, I., Albertini, A. M., Alloni, G., Azebedo, V., Bertero, M. G., Bessieres, P., Bolotin, A., and Borchert, S., 1997, *Nature* 390: 249-256) listed 18 genes that play a major role in the secretion of extracellular enzymes by *Bacillus subtilis* 168. This list includes several chaperonins, signal peptidases, components of the signal recognition particle and protein translocase complexes. Thus, it is reasonable to expect that the central features of the secretory apparatus are conserved in *Bacillus subtilis* and *Bacillus licheniformis*.

From the list of 139 sporulation genes tabulated by Kunst et al. (Kunst, F., Ogasawara, N, Mozser, I., Albertini, A. M., Alloni, G., Azebedo, V., Bertero, M. G., Bessieres, P., Bolotin, A., and Borchert, S. et al., 1997, *Nature* 390: 249-256), all but six have obvious counterparts in *Bacillus licheniformis*. These six exceptions (spsABCEFG) comprise an operon involved in synthesis of spore coat polysaccharide in *Bacillus subtilis*. Additionally, the response regulator gene family (phrACEFGI) appears to have a low level of sequence conservation between *Bacillus subtilis* and *Bacillus licheniformis*.

Natural competence (the ability to take up and process exogenous DNA in specific growth conditions) is a feature of few *Bacillus licheniformis* strains (Gwinn, D. D. and Thorne, C. B., 1964, *J. Bacteriol.* 87: 519-526). The reasons for variability in competence phenotype have not been explored at the genetic level, but the genome data offered several possible explanations. Although the type strain genome encodes all of the late competence functions ascribed in *Bacillus subtilis* (e.g., comC, comEFG operons, comk, mecA), it lacks an obvious comS gene, and the comP gene is punctuated by an insertion sequence element, suggesting that the early stages of competence development have been preempted in *Bacillus licheniformis* ATCC 14580. Whether these early functions can be restored by introducing the corresponding genes from *Bacillus subtilis* is unknown. In addition to an apparent deficiency in DNA uptake, two Type I restriction-modification systems were discovered that may also contribute diminished transformation efficiencies. These are distinct from the ydiOPS genes of *Bacillus subtilis*, and could participate in degradation of improperly modified DNA from heterologous hosts used during construction of recombinant expression vectors. Lastly, the synthesis of a glutamyl polypeptide capsule has also been implicated as a potential barrier to transformation of *Bacillus licheniformis* strains (Thorne, C. B. and Stull, H. B., 1966, *J. Bacteriol.* 91: 1012-1020). Six genes were predicted (ywtABDEF and ywsC orthologues) that may be involved in the synthesis of this capsular material.

Antibiotics and secondary metabolites. Bacitracin is a cyclic peptide antibiotic that is synthesized non-ribosomally in *Bacillus licheniformis* (Katz, E. and Demain, A. L., 1977, *Bacteriol. Rev.* 41: 449-474). White there is variation in the prevalence of bacitracin synthase genes in laboratory strains of this species, one study suggested that up to 50% may harbor the bac operon (Ishihara, H., Takoh, M., Nishibayashi, R., and Sato, A., 2002, *Curr. Microbiol.* 45: 18-23). The bac operon was determined not to be present in the type strain (ATCC 14580) genome. Seemingly, the only non-ribosomal peptide synthase operon encoded by the *Bacillus licheniformis* type strain genome is that which is responsible for lichenysin biosynthesis. Lichenysin structurally resembles surfactin from *Bacillus subtilis* (Grangemard, I., Wallach, J., Maget-Dana, R., and Peypoux, F., 2001, *Appl. Biochem. Biotechnol.* 90: 199-210), and their respective biosynthetic operons are highly similar. No *Bacillus licheniformis* counterparts were found for the pps (plipastatin synthase) and polyketide synthase (pks) operons of *Bacillus subtilis*. Collectively, these two regions represent sizeable portions (80 kb and 38 kb, respectively) of the chromosome in *Bacillus subtilis*, although they are reportedly dispensable (Westers, H., Dorenbos, R., van Dijl, J. M., Kable, J., Flanagan, T., Devine, K. M., Jude, F., Séror, S. J., Beekman, A. C., Darmon, E., 2003, *Mol. Biol. Evol.* 20: 2076-2090). Unexpectedly, a gene cluster was found encoding a lantibiotic and associated processing and transport functions. This peptide of 69 amino acids was designated as lichenicidin, and its closest known orthologue is mersacidin from *Bacillus* sp. strain HIL-Y85/54728 (Altena, K., Guder, A., Cramer, C., and Bierbaum, G., 2000, *Appl. Environ. Microbiol.* 66: 2565-2571). Lantibiotics are ribosomally synthesized peptides that are modified post-translationally so that the final molecules contain rare thioether amino acids such as lanthionine and/or methyl-lanthionine (Pag, U. and Sahl, H. G., 2002, *Curr. Pharm. Des.* 8: 815-833). These antimicrobial compounds have attracted much attention in recent years as models for the design of new antibiotics (Hoffmann, A., Pag, U., Wiedemann, I., and Sahl, H. G., 2002, *Farmaco.* 57: 685-691).

Essential Genes. The gene models were also compared to the list of essential genes in *Bacillus subtilis* (Kobayashi, K., Ehrlich, S. D., Albertini, A., Amati, G., Andersen, K. K., Arnaud, M., Asai, K., Ashikaga, S., Aymerch, S., Bessieres, P., 2003, *Proc. Natl Acad. Sci. USA* 100: 4678-4683). All the essential genes in *Bacillus subtilis* have orthologues in *Bacillus licheniformis*, and most are present in a wide range of bacterial taxa (Pedersen, P. B., Bjørnvad, M. E., Rasmussen, M. D., and Petersen, J. N., 2002, *Reg. Toxicol. Pharmacol.* 36: 155-161).

Example 4

Comparison of *Bacillus licheniformis* Genome with Other Bacilli

VisualGenome software (Rational Genomics, San Francisco, Calif.) was used for GC-skew analysis and global homology comparisons of the *Bacillus licheniformis, Bacillus subtilis*, and *Bacillus halodurans* genomes with pre-computed BLAST results stored in a local database. In pairwise comparisons (E-score threshold of $10^{-5}$) 66% (2771/4208) of the predicted *Bacillus licheniformis* ORFs have orthologs in *Bacillus subtilis*, and 55% (2321/4208) of the gene models are represented by orthologous sequences in *Bacillus halodurans*. Using a reciprocal BLASTP analysis 1719 orthologs were found that are common to all three species (E-score threshold of $10^{-5}$).

As noted by Lapidus et al., (Lapidus, A., Galleron, N., Andersen, J. T., Jørgensen, P. L. Ehrlich, S. D., and Sorokin, A., 2002, *FEMS Microbiol. Lett.* 209: 23-30), there are broad regions of colinearity between the genomes of *Bacillus licheniformis* and *Bacillus subtilis*. Less conservation of genome organization exists between *Bacillus licheniformis* and *Bacillus halodurans*, and inversion of one or more large genomic segments is evident. Clearly this supports previous findings (Xu, D. and Côté, J. C., 2003, *Internat. J. Syst. Evol. Microbiol.* 53: 695-704) that *Bacillus subtilis* and *Bacillus licheniformis* are phylogenetically and evolutionarily closer than either species is to *Bacillus halodurans*. However, a number of important differences were also observed, both in the numbers and locations of prophages and transposable elements and in a number of biochemical pathways, which distinguish *Bacillus licheniformis* from *Bacillus subtilis*, including a region of more than 80 kb that comprises a cluster of polyketide synthase genes that are absent in *Bacillus licheniformis*.

Example 5

Codon Usage Tables

The evolution of codon bias, the unequal usage of synonomous codons, is thought to be due to natural selection for the use of preferred codons that match the most abundant species of isoaccepting tRNAs, resulting in increased translational efficiency and accuracy. The practical applications for utilizing codon bias information include optimizing expression of heterologous and mutant genes (Jiang and Mannervik, 1999, *Protein Expression and Purification* 15: 92-98), site-directed mutagenesis to derive variant polypeptides from a given gene (Wong et al., 1995, *J. Immunol.* 154: 3351-3358; Kaji, H. et al., 1999, *J. Biochem.* 126: 769-775), design and synthesis of synthetic genes (Libertini and Di Donato, 1992, *Protein Engineering* 5: 821-825; Feng et al., 2000, *Biochem.* 39: 15399-15409), and fine-tuning or reducing of translation efficiency of specific genes by introduction of non-preferred codons (Crombie, T. et al., 1992, *J. Mol. Biol.* 228: 7-12; Carlini and Stephan, 2003, *Genetics* 163: 239-243).

A codon usage table (Table 4) was generated from SEQ ID NO: 1 with CUSP, a software component of the EMBOSS package (Rice, Longden, and Bleasby, 2000, EMBOSS: The European Molecular Biology Open Software Suite. *Trends in Genetics* 16: 276-277) on all the predicted protein-coding genes of the *Bacillus licheniformis* chromosome. CUSP read the coding sequences and calculated the codon frequency table shown in Table 4.

A codon usage table (Table 5) was also generated based on the signal peptides of the 82 extracellular proteins described in Example 3.

TABLE 1

| | Predicted functions | | | |
|---|---|---|---|---|
| SEQ ID NO. | Description | UniRef Accession No. | Organism | *Bacillus subtilis* homolog (Gene Name) |
| 2 | Chromosomal replication initiator protein dnaA [*Bacillus subtilis*] | UniRef100_P05648 | *Bacillus subtilis* | DnaA |
| 3 | DNA polymerase III, beta chain [*Bacillus subtilis*] | UniRef100_P05649 | *Bacillus subtilis* | DnaN |
| 4 | | | | |
| 5 | DNA replication and repair protein recF [*Bacillus subtilis*] | UniRef100_P05651 | *Bacillus subtilis* | RecF |
| 6 | | | | |
| 7 | DNA gyrase subunit B [*Bacillus subtilis*] | UniRef100_P05652 | *Bacillus subtilis* | GyrB |

TABLE 1-continued

Predicted functions

| SEQ ID NO. | Description | UniRef Accession No. | Organism | Bacillus subtilis homolog (Gene Name) |
|---|---|---|---|---|
| 8 | DNA gyrase subunit A [*Bacillus subtilis*] | UniRef100_P05653 | *Bacillus subtilis* | GyrA |
| 9 | | | | YaaC |
| 10 | Inosine-5'-monophosphate dehydrogenase [*Bacillus subtilis*] | UniRef100_P21879 | *Bacillus subtilis* | GuaB |
| 11 | D-alanyl-D-alanine carboxypeptidase precursor [*Bacillus subtilis*] | UniRef100_P08750 | *Bacillus subtilis* | DacA |
| 12 | Pyridoxine biosynthesis protein pdx1 [*Bacillus subtilis*] | UniRef100_P37527 | *Bacillus subtilis* | YaaD |
| 13 | Hypothetical UPF0030 protein yaaE [*Bacillus subtilis*] | UniRef100_P37528 | *Bacillus subtilis* | YaaE |
| 14 | Seryl-tRNA synthetase [*Bacillus subtilis*] | UniRef100_P37464 | *Bacillus subtilis* | SerS |
| 15 | Glycerate kinase [*Bacillus subtilis*] | UniRef100_P42100 | *Bacillus subtilis* | YxaA |
| 16 | H+/gluconate symporter [*Vibrio vulnificus*] | UniRef100_Q7MHW6 | *Vibrio vulnificus* | YuiF |
| 17 | Sugar diacid utilization regulator [*Vibrio vulnificus*] | UniRef100_Q8DBZ9 | *Vibrio vulnificus* | YsfB |
| 18 | Hypothetical protein [*Bacillus thuringiensis*] | UniRef100_Q6HH43 | *Bacillus thuringiensis* | |
| 19 | Hypothetical protein yaaF [*Bacillus subtilis*] | UniRef100_P37529 | *Bacillus subtilis* | Dck |
| 20 | Hypothetical protein yaaG [*Bacillus subtilis*] | UniRef100_P37530 | *Bacillus subtilis* | Dgk |
| 21 | Hypothetical protein yaaH [*Bacillus subtilis*] | UniRef100_P37531 | *Bacillus subtilis* | YaaH |
| 22 | Hypothetical protein yaaI [*Bacillus subtilis*] | UniRef100_P37532 | *Bacillus subtilis* | YaaI |
| 23 | | | | YaaJ |
| 24 | | | | DnaX |
| 25 | Hypothetical UPF0133 protein yaaK [*Bacillus subtilis*] | UniRef100_P24281 | *Bacillus subtilis* | YaaK |
| 26 | Recombination protein recR [*Bacillus subtilis*] | UniRef100_P24277 | *Bacillus subtilis* | RecR |
| 27 | Hypothetical protein yaaL [*Bacillus subtilis*] | UniRef100_P37533 | *Bacillus subtilis* | |
| 28 | Sigma-K factor processing regulatory protein BOFA [*Bacillus subtilis*] | UniRef100_P24282 | *Bacillus subtilis* | |
| 29 | CsfB protein [*Bacillus subtilis*] | UniRef100_P37534 | *Bacillus subtilis* | |
| 30 | XpaC protein [*Bacillus subtilis*] | UniRef100_P37467 | *Bacillus subtilis* | XpaC |
| 31 | Hypothetical protein yaaN [*Bacillus subtilis*] | UniRef100_P37535 | *Bacillus subtilis* | YaaN |
| 32 | | | | YaaO |
| 33 | Thymidylate kinase [*Bacillus subtilis*] | UniRef100_P37537 | *Bacillus subtilis* | Tmk |
| 34 | Hypothetical protein yaaQ [*Bacillus subtilis*] | UniRef100_P37538 | *Bacillus subtilis* | YaaQ |
| 35 | | | | |
| 36 | DNA polymerase III, delta' subunit [*Bacillus subtilis*] | UniRef100_P37540 | *Bacillus subtilis* | HolB |
| 37 | Hypothetical protein yaaT [*Bacillus subtilis*] | UniRef100_P37541 | *Bacillus subtilis* | YaaT |
| 38 | Hypothetical protein yabA [*Bacillus subtilis*] | UniRef100_P37542 | *Bacillus subtilis* | YabA |
| 39 | Hypothetical protein yabB [*Bacillus subtilis*] | UniRef100_P37543 | *Bacillus subtilis* | YabB |
| 40 | Hypothetical UPF0213 protein yazA [*Bacillus subtilis*] | UniRef100_O31414 | *Bacillus subtilis* | |
| 41 | Hypothetical UPF0011 protein yabC [*Bacillus subtilis*] | UniRef100_P37544 | *Bacillus subtilis* | YabC |
| 42 | Transition state regulatory protein abrB [*Bacillus subtilis*] | UniRef100_P08874 | *Bacillus subtilis* | |
| 43 | Methionyl-tRNA synthetase [*Bacillus subtilis*] | UniRef100_P37465 | *Bacillus subtilis* | MetS |
| 44 | Putative deoxyribonuclease yabD [*Bacillus subtilis*] | UniRef100_P37545 | *Bacillus subtilis* | YabD |
| 45 | | | | YabE |
| 46 | Hypothetical protein yabF [*Bacillus subtilis*] | UniRef100_P37547 | *Bacillus subtilis* | RnmV |
| 47 | Dimethyladenosine transferase (EC 2.1.1.—) (S-adenosylmethionine-6-N', N'-adenosyl(rRNA) dimethyltransferase) [*Bacillus subtilis*] | UniRef100_P37468 | *Bacillus subtilis* | KsgA |

TABLE 1-continued

Predicted functions

| SEQ ID NO. | Description | UniRef Accession No. | Organism | Bacillus subtilis homolog (Gene Name) |
|---|---|---|---|---|
| 48 | Hypothetical protein yabG [Bacillus subtilis] | UniRef100_P37548 | Bacillus subtilis | YabG |
| 49 | Veg protein [Bacillus subtilis] | UniRef100_P37466 | Bacillus subtilis | |
| 50 | SspF protein [Bacillus subtilis] | UniRef100_P37549 | Bacillus subtilis | |
| 51 | | | | IspE |
| 52 | Pur operon repressor [Bacillus subtilis] | UniRef100_P37551 | Bacillus subtilis | PurR |
| 53 | UPF0076 protein yabJ [Bacillus subtilis] | UniRef100_P37552 | Bacillus subtilis | YabJ |
| 54 | Stage V sporulation protein G [Bacillus subtilis] | UniRef100_P28015 | Bacillus subtilis | |
| 55 | Bifunctional gcaD protein (TMS protein) [Includes: UDP-N-acetylglucosamine pyrophosphorylase (EC 2.7.7.23) (N-acetylglucosamine-1-phosphate uridyltransferase); Glucosamine-1-phosphate N-acetyltransferase (EC 2.3.1.157)] [Bacillus subtilis] | UniRef100_P14192 | Includes: UDP-N-acetylglucosamine pyrophosphorylase (EC 2.7.7.23) (N-acetylglucosamine-1-phosphate uridyltransferase); Glucosamine-1-phosphate N-acetyltransferase (EC 2.3.1.157) | GcaD |
| 56 | Ribose-phosphate pyrophosphokinase [Bacillus subtilis] | UniRef100_P14193 | Bacillus subtilis | Prs |
| 57 | General stress protein ctc [Bacillus subtilis] | UniRef100_P14194 | Bacillus subtilis | Ctc |
| 58 | Peptidyl-tRNA hydrolase [Bacillus subtilis] | UniRef100_P37470 | Bacillus subtilis | SpoVC |
| 59 | Hypothetical protein yabK [Bacillus subtilis] | UniRef100_P37553 | Bacillus subtilis | |
| 60 | Transcription-repair coupling factor [Bacillus subtilis] | UniRef100_P37474 | Bacillus subtilis | Mfd |
| 61 | Stage V sporulation protein T [Bacillus subtilis] | UniRef100_P37554 | Bacillus subtilis | SpoVT |
| 62 | Hypothetical protein yabM [Bacillus subtilis] | UniRef100_P37555 | Bacillus subtilis | YabM |
| 63 | Hypothetical protein yabN [Bacillus subtilis] | UniRef100_P37556 | Bacillus subtilis | YabN |
| 64 | Hypothetical protein yabO [Bacillus subtilis] | UniRef100_P37557 | Bacillus subtilis | |
| 65 | Hypothetical protein yabP [Bacillus subtilis] | UniRef100_P37558 | Bacillus subtilis | YabP |
| 66 | Hypothetical protein yabQ [Bacillus subtilis] | UniRef100_P37559 | Bacillus subtilis | YabQ |
| 67 | Cell division protein divIC [Bacillus subtilis] | UniRef100_P37471 | Bacillus subtilis | DivIC |
| 68 | Hypothetical protein yabR [Bacillus subtilis] | UniRef100_P37560 | Bacillus subtilis | YabR |
| 69 | Stage II sporulation protein E [Bacillus subtilis] | UniRef100_P37475 | Bacillus subtilis | SpoIIE |
| 70 | Hypothetical protein yabS [Bacillus subtilis] | UniRef100_P37561 | Bacillus subtilis | YabS |
| 71 | Probable serine/threonine-protein kinase yabT [Bacillus subtilis] | UniRef100_P37562 | Bacillus subtilis | YabT |
| 72 | Hypothetical UPF0072 protein yacA [Bacillus subtilis] | UniRef100_P37563 | Bacillus subtilis | YacA |
| 73 | Hypoxanthine-guanine phosphoribosyltransferase [Bacillus subtilis] | UniRef100_P37472 | Bacillus subtilis | HprT |
| 74 | Cell division protein ftsH homolog [Bacillus subtilis] | UniRef100_P37476 | Bacillus subtilis | FtsH |
| 75 | Putative 32 kDa replication protein [Bacillus stearothermophilus] | UniRef100_Q9F985 | Bacillus stearothermophilus | YacB |
| 76 | 33 kDa chaperonin [Bacillus subtilis] | UniRef100_P37565 | Bacillus subtilis | YacC |
| 77 | | | | YacD |
| 78 | | | | CysK |
| 79 | Para-aminobenzoate synthase component I [Bacillus subtilis] | UniRef100_P28820 | Bacillus subtilis | PabB |
| 80 | Para-aminobenzoate/anthranilate synthase glutamine amidotransferase | UniRef100_P28819 | Includes: Para-aminobenzoate | PabA |

TABLE 1-continued

Predicted functions

| SEQ ID NO. | Description | UniRef Accession No. | Organism | Bacillus subtilis homolog (Gene Name) |
|---|---|---|---|---|
| | component II [Includes: Para-aminobenzoate synthase glutamine amidotransferase component II (EC 6.3.5.8) (ADC synthase); Anthranilate synthase component II (EC 4.1.3.27)] [*Bacillus* subtil | | synthase glutamine amidotransferase component II (EC 6.3.5.8) (ADC synthase); Anthranilate synthase component II (EC 4.1.3.27) | |
| 81 | Aminodeoxychorismate lyase [*Bacillus subtilis*] | UniRef100_P28821 | *Bacillus subtilis* | PabC |
| 82 | Dihydropteroate synthase [*Bacillus subtilis*] | UniRef100_P28822 | *Bacillus subtilis* | SuI |
| 83 | Dihydroneopterin aldolase [*Bacillus subtilis*] | UniRef100_P28823 | *Bacillus subtilis* | FolB |
| 84 | 2-amino-4-hydroxy-6-hydroxymethyldihydropteridine pyrophosphokinase [*Bacillus subtilis*] | UniRef100_P29252 | *Bacillus subtilis* | FolK |
| 85 | YazB protein [*Bacillus subtilis*] | UniRef100_O31417 | *Bacillus subtilis* | |
| 86 | Probable tRNA-dihydrouridine synthase 1 [*Bacillus subtilis*] | UniRef100_P37567 | *Bacillus subtilis* | YacF |
| 87 | Lysyl-tRNA synthetase [*Bacillus subtilis*] | UniRef100_P37477 | *Bacillus subtilis* | LysS |
| 88 | Transcriptional regulator ctsR [*Bacillus subtilis*] | UniRef100_P37568 | *Bacillus subtilis* | CtsR |
| 89 | Hypothetical protein yacH [*Bacillus subtilis*] | UniRef100_P37569 | *Bacillus subtilis* | McsA |
| 90 | Hypothetical ATP: guanido phosphotransferase yacI [*Bacillus subtilis*] | UniRef100_P37570 | *Bacillus subtilis* | McsB |
| 91 | Negative regulator of genetic competence clpC/mecB [*Bacillus subtilis*] | UniRef100_P37571 | *Bacillus subtilis* | ClpC |
| 92 | | | | RadA |
| 93 | Hypothetical protein yacK [*Bacillus subtilis*] | UniRef100_P37573 | *Bacillus subtilis* | YacK |
| 94 | Hypothetical protein yacL [*Bacillus subtilis*] | UniRef100_Q06754 | *Bacillus subtilis* | YacL |
| 95 | 2-C-methyl-D-erythritol 4-phosphate cytidylyltransferase [*Bacillus subtilis*] | UniRef100_Q06755 | *Bacillus subtilis* | YacM |
| 96 | 2-C-methyl-D-erythritol 2,4-cyclodiphosphate synthase [*Bacillus subtilis*] | UniRef100_Q06756 | *Bacillus subtilis* | YacN |
| 97 | Glutamyl-tRNA synthetase [*Bacillus subtilis*] | UniRef100_P22250 | *Bacillus subtilis* | GltX |
| 98 | Serine acetyltransferase [*Bacillus subtilis*] | UniRef100_Q06750 | *Bacillus subtilis* | CysE |
| 99 | Cysteinyl-tRNA synthetase [*Bacillus subtilis*] | UniRef100_Q06752 | *Bacillus subtilis* | CysS |
| 100 | YazC protein [*Bacillus subtilis*] | UniRef100_O31418 | *Bacillus subtilis* | YazC |
| 101 | Hypothetical tRNA/rRNA methyltransferase yacO [*Bacillus subtilis*] | UniRef100_Q06753 | *Bacillus subtilis* | YacO |
| 102 | Hypothetical protein yacP [*Bacillus subtilis*] | UniRef100_P37574 | *Bacillus subtilis* | YacP |
| 103 | RNA polymerase sigma-H factor [*Bacillus subtilis*] | UniRef100_P17869 | *Bacillus subtilis* | SigH |
| 104 | Preprotein translocase secE subunit [*Bacillus subtilis*] | UniRef100_Q06799 | *Bacillus subtilis* | |
| 105 | | | | NusG |
| 106 | 50S ribosomal protein L11 [*Bacillus subtilis*] | UniRef100_Q06796 | *Bacillus subtilis* | RplK |
| 107 | 50S ribosomal protein L1 [*Bacillus subtilis*] | UniRef100_Q06797 | *Bacillus subtilis* | RplA |
| 108 | 50S ribosomal protein L10 [*Bacillus subtilis*] | UniRef100_P42923 | *Bacillus subtilis* | RplJ |
| 109 | 50S ribosomal protein L7/L12 [*Bacillus subtilis*] | UniRef100_P02394 | *Bacillus subtilis* | RplL |
| 110 | Hypothetical protein ybxB [*Bacillus subtilis*] | UniRef100_P37872 | *Bacillus subtilis* | YbxB |

TABLE 1-continued

Predicted functions

| SEQ ID NO. | Description | UniRef Accession No. | Organism | Bacillus subtilis homolog (Gene Name) |
|---|---|---|---|---|
| 111 | DNA-directed RNA polymerase beta chain [*Bacillus subtilis*] | UniRef100_P37870 | *Bacillus subtilis* | RpoB |
| 112 | DNA-directed RNA polymerase beta' chain [*Bacillus subtilis*] | UniRef100_P37871 | *Bacillus subtilis* | RpoC |
| 113 | Putative ribosomal protein L7Ae-like [*Bacillus subtilis*] | UniRef100_P46350 | *Bacillus subtilis* | |
| 114 | 30S ribosomal protein S12 [*Bacillus subtilis*] | UniRef100_P21472 | *Bacillus subtilis* | RpsL |
| 115 | 30S ribosomal protein S7 [*Bacillus subtilis*] | UniRef100_P21469 | *Bacillus subtilis* | RpsG |
| 116 | Elongation factor G [*Bacillus subtilis*] | UniRef100_P80868 | *Bacillus subtilis* | FusA |
| 117 | Elongation factor Tu [*Bacillus subtilis*] | UniRef100_P33166 | *Bacillus subtilis* | TufA |
| 118 | 30S ribosomal protein S10 [*Bacillus halodurans*] | UniRef100_Q9Z9L5 | *Bacillus halodurans* | RpsJ |
| 119 | 50S ribosomal protein L3 [*Bacillus subtilis*] | UniRef100_P42920 | *Bacillus subtilis* | RplC |
| 120 | 50S ribosomal protein L4 [*Bacillus subtilis*] | UniRef100_P42921 | *Bacillus subtilis* | RplD |
| 121 | 50S ribosomal protein L23 [*Bacillus subtilis*] | UniRef100_P42924 | *Bacillus subtilis* | |
| 122 | 50S ribosomal protein L2 [*Bacillus subtilis*] | UniRef100_P42919 | *Bacillus subtilis* | RplB |
| 123 | 30S ribosomal protein S19 [*Bacillus subtilis*] | UniRef100_P21476 | *Bacillus subtilis* | |
| 124 | 50S ribosomal protein L22 [*Bacillus subtilis*] | UniRef100_P42060 | *Bacillus subtilis* | RplV |
| 125 | 30S ribosomal protein S3 [*Bacillus subtilis*] | UniRef100_P21465 | *Bacillus subtilis* | RpsC |
| 126 | 50S ribosomal protein L16 [*Bacillus subtilis*] | UniRef100_P14577 | *Bacillus subtilis* | RplP |
| 127 | 50S ribosomal protein L29 [*Bacillus subtilis*] | UniRef100_P12873 | *Bacillus subtilis* | |
| 128 | 30S ribosomal protein S17 [*Bacillus subtilis*] | UniRef100_P12874 | *Bacillus subtilis* | |
| 129 | | | | |
| 130 | 50S ribosomal protein L24 [*Bacillus subtilis*] | UniRef100_P12876 | *Bacillus subtilis* | RplX |
| 131 | 50S ribosomal protein L5 [*Bacillus subtilis*] | UniRef100_P12877 | *Bacillus subtilis* | RplE |
| 132 | Ribosomal protein S14 [*Bacillus cereus* ZK] | UniRef100_Q63H77 | *Bacillus cereus* ZK | |
| 133 | 30S ribosomal protein S8 [*Bacillus subtilis*] | UniRef100_P12879 | *Bacillus subtilis* | RpsH |
| 134 | 50S ribosomal protein L6 [*Bacillus subtilis*] | UniRef100_P46898 | *Bacillus subtilis* | RplF |
| 135 | 50S ribosomal protein L18 [*Bacillus subtilis*] | UniRef100_P46899 | *Bacillus subtilis* | RplR |
| 136 | 30S ribosomal protein S5 [*Bacillus subtilis*] | UniRef100_P21467 | *Bacillus subtilis* | RpsE |
| 137 | 50S ribosomal protein L30 [*Bacillus subtilis*] | UniRef100_P19947 | *Bacillus subtilis* | |
| 138 | 50S ribosomal protein L15 [*Bacillus subtilis*] | UniRef100_P19946 | *Bacillus subtilis* | RplO |
| 139 | | | | SecY |
| 140 | Adenylate kinase [*Bacillus subtilis*] | UniRef100_P16304 | *Bacillus subtilis* | Adk |
| 141 | Methionine aminopeptidase [*Bacillus subtilis*] | UniRef100_P19994 | *Bacillus subtilis* | Map |
| 142 | C-125 initiation factor IF-I, RNA polymerase alpha subunit and ribosomal proteins, partial and complete cds [*Bacillus halodurans*] | UniRef100_O50629 | *Bacillus halodurans* | |
| 143 | Translation initiation factor IF-1 [*Bacillus subtilis*] | UniRef100_P20458 | *Bacillus subtilis* | |
| 144 | | | | |
| 145 | | | | RpsM |
| 146 | 30S ribosomal protein S11 [*Bacillus subtilis*] | UniRef100_P04969 | *Bacillus subtilis* | RpsK |
| 147 | DNA-directed RNA polymerase alpha chain [*Bacillus subtilis*] | UniRef100_P20429 | *Bacillus subtilis* | RpoA |
| 148 | 50S ribosomal protein L17 [*Bacillus subtilis*] | UniRef100_P20277 | *Bacillus subtilis* | RplQ |

TABLE 1-continued

Predicted functions

| SEQ ID NO. | Description | UniRef Accession No. | Organism | Bacillus subtilis homolog (Gene Name) |
|---|---|---|---|---|
| 149 | Hypothetical ABC transporter ATP-binding protein ybxA [*Bacillus subtilis*] | UniRef100_P40735 | *Bacillus subtilis* | YbxA |
| 150 | Hypothetical protein orf5 [*Bacillus subtilis*] | UniRef100_P70970 | *Bacillus subtilis* | YbaE |
| 151 | YbaF protein [*Bacillus subtilis*] | UniRef100_P70972 | *Bacillus subtilis* | YbaF |
| 152 | tRNA pseudouridine synthase A [*Bacillus subtilis*] | UniRef100_P70973 | *Bacillus subtilis* | TruA |
| 153 | 50S ribosomal protein L13 [*Bacillus subtilis*] | UniRef100_P70974 | *Bacillus subtilis* | RplM |
| 154 | 30S ribosomal protein S9 [*Bacillus subtilis*] | UniRef100_P21470 | *Bacillus subtilis* | RpsI |
| 155 | Hypothetical protein [*Bacillus cereus*] | UniRef100_Q737T6 | *Bacillus cereus* | YizA |
| 156 | Hypothetical protein ybaK [*Bacillus subtilis*] | UniRef100_P50862 | *Bacillus subtilis* | YbaK |
| 157 | Germination-specific N-acetylmuramoyl-L-alanine amidase [*Bacillus subtilis*] | UniRef100_P50864 | *Bacillus subtilis* | CwlD |
| 158 | | | | YbaL |
| 159 | Spore germination protein gerD precursor [*Bacillus subtilis*] | UniRef100_P16450 | *Bacillus subtilis* | GerD |
| 160 | KinB signaling pathway activation protein [*Bacillus subtilis*] | UniRef100_P16449 | *Bacillus subtilis* | KbaA |
| 161 | Hypothetical protein ybaN precursor [*Bacillus subtilis*] | UniRef100_P50865 | *Bacillus subtilis* | YbaN |
| 162 | Penicillin-binding protein [*Bacillus subtilis*] | UniRef100_O31773 | *Bacillus subtilis* | PbpX |
| 163 | | | | |
| 164 | Hypothetical protein ybaS [*Bacillus subtilis*] | UniRef100_P55190 | *Bacillus subtilis* | YbaS |
| 165 | Hypothetical protein yxaJ [*Bacillus subtilis*] | UniRef100_P42109 | *Bacillus subtilis* | YxaJ |
| 166 | Phenazine biosynthetic protein [*Halobacterium* sp.] | UniRef100_Q9HHG6 | *Halobacterium* sp. | YfhB |
| 167 | Hypothetical protein ybbC precursor [*Bacillus subtilis*] | UniRef100_P40407 | *Bacillus subtilis* | YbbC |
| 168 | Hypothetical lipoprotein ybbD precursor [*Bacillus subtilis*] | UniRef100_P40406 | *Bacillus subtilis* | YbbD |
| 169 | Hypothetical UPF0214 protein ybbE precursor [*Bacillus subtilis*] | UniRef100_O05213 | *Bacillus subtilis* | YbbE |
| 170 | YbbF protein [*Bacillus subtilis*] | UniRef100_Q797S1 | *Bacillus subtilis* | YbbF |
| 171 | Putative HTH-type transcriptional regulator ybbH [*Bacillus subtilis*] | UniRef100_Q45581 | *Bacillus subtilis* | YbbH |
| 172 | Hypothetical protein ybbI [*Bacillus subtilis*] | UniRef100_Q45582 | *Bacillus subtilis* | YbbI |
| 173 | Hypothetical protein ybbK [*Bacillus subtilis*] | UniRef100_Q45584 | *Bacillus subtilis* | YbbK |
| 174 | Arginase [*Bacillus caldovelox*] | UniRef100_P53608 | *Bacillus caldovelox* | RocF |
| 175 | RNA polymerase sigma factor sigW [*Bacillus subtilis*] | UniRef100_Q45585 | *Bacillus subtilis* | SigW |
| 176 | YbbM protein [*Bacillus subtilis*] | UniRef100_Q45588 | *Bacillus subtilis* | YbbM |
| 177 | YbbP protein [*Bacillus subtilis*] | UniRef100_Q45589 | *Bacillus subtilis* | YbbP |
| 178 | YbbR protein [*Bacillus subtilis*] | UniRef100_O34659 | *Bacillus subtilis* | YbbR |
| 179 | YbbT protein [*Bacillus subtilis*] | UniRef100_O34824 | *Bacillus subtilis* | YbbT |
| 180 | Glucosamine--fructose-6-phosphate aminotransferase [isomerizing] [*Bacillus subtilis*] | UniRef100_P39754 | isomerizing | GlmS |
| 181 | | | | |
| 182 | Hypothetical protein [*Bacillus thuringiensis*] | UniRef100_Q6HH47 | *Bacillus thuringiensis* | |
| 183 | UPI00003CBF92 UniRef100 entry | | UniRef100_UPI00003CBF92 | YtrB |
| 184 | Transcriptional regulator [*Bacillus halodurans*] | UniRef100_Q9KF35 | *Bacillus halodurans* | YtrA |
| 185 | | | | |
| 186 | YbcL protein [*Bacillus subtilis*] | UniRef100_O34663 | *Bacillus subtilis* | YbcL |
| 187 | BH0186 protein [*Bacillus halodurans*] | UniRef100_Q9KGB8 | *Bacillus halodurans* | |
| 188 | ABC transporter [*Bacillus halodurans*] | UniRef100_Q9KEY6 | *Bacillus halodurans* | YvcC |
| 189 | Hypothetical protein ywbO [*Bacillus subtilis*] | UniRef100_P39598 | *Bacillus subtilis* | YwbO |
| 190 | | | | |

TABLE 1-continued

Predicted functions

| SEQ ID NO. | Description | UniRef Accession No. | Organism | Bacillus subtilis homolog (Gene Name) |
|---|---|---|---|---|
| 191 | BH0695 protein [*Bacillus halodurans*] | UniRef100_Q9KF04 | *Bacillus halodurans* | |
| 192 | Aminoglycoside 6-adenylyltransferase [*Enterococcus faecium*] | UniRef100_Q6V4U6 | *Enterococcus faecium* | AadK |
| 193 | Hypothetical conserved protein [*Oceanobacillus iheyensis*] | UniRef100_Q8ERX2 | *Oceanobacillus iheyensis* | |
| 194 | YfnB [*Bacillus subtilis*] | UniRef100_O06480 | *Bacillus subtilis* | YfnB |
| 195 | Hypothetical transport protein ybxG [*Bacillus subtilis*] | UniRef100_P54425 | *Bacillus subtilis* | YbxG |
| 196 | Mg(2+)/citrate complex secondary transporter [*Bacillus subtilis*] | UniRef100_P55069 | *Bacillus subtilis* | CitM |
| 197 | YflP protein [*Bacillus subtilis*] | UniRef100_O034439 | *Bacillus subtilis* | YflP |
| 198 | | | | CitT |
| 199 | Sensor protein citS [*Bacillus subtilis*] | UniRef100_O34427 | *Bacillus subtilis* | CitS |
| 200 | Transcriptional regulator [*Thermoanaerobacter tengcongensis*] | UniRef100_Q8RB37 | *Thermoanaerobacter tengcongensis* | YwfK |
| 201 | Complete genome; segment 8/17 [*Photorhabdus luminescens*] | UniRef100_Q7N4W7 | *Photorhabdus luminescens* | YwfE |
| 202 | Multidrug resistance protein B [*Bacillus cereus*] | UniRef100_Q81AF0 | *Bacillus cereus* | YqjV |
| 203 | Sigma-G-dependent sporulation specific SASP protein [*Bacillus subtilis*] | UniRef100_P54379 | *Bacillus subtilis* | |
| 204 | Hypothetical protein ybxH [*Bacillus subtilis*] | UniRef100_P54426 | *Bacillus subtilis* | |
| 205 | YbyB protein [*Bacillus subtilis*] | UniRef100_O31441 | *Bacillus subtilis* | |
| 206 | Hypothetical protein yyaL [*Bacillus subtilis*] | UniRef100_P37512 | *Bacillus subtilis* | YyaL |
| 207 | Hypothetical protein yyaO [*Bacillus subtilis*] | UniRef100_P37509 | *Bacillus subtilis* | |
| 208 | Threonyl-tRNA synthetase 2 [*Bacillus subtilis*] | UniRef100_P18256 | *Bacillus subtilis* | ThrZ |
| 209 | | | | |
| 210 | | | | YttB |
| 211 | Hypothetical protein [*Acinetobacter* sp.] | UniRef100_Q6FDN0 | *Acinetobacter* sp. | |
| 212 | Hypothetical UPF0053 protein yrkA [*Bacillus subtilis*] | UniRef100_P54428 | *Bacillus subtilis* | YrkA |
| 213 | | | | YdeG |
| 214 | | | | YbaJ |
| 215 | | | | |
| 216 | | | | YqeW |
| 217 | YubF protein [*Bacillus subtilis*] | UniRef100_O32082 | *Bacillus subtilis* | |
| 218 | | | | YbfF |
| 219 | Hypothetical protein [Bacteroides fragilis] | UniRef100_Q64UG6 | *Bacteroides fragilis* | |
| 220 | Hypothetical transport protein ybhF [*Bacillus subtilis*] | UniRef100_O31448 | *Bacillus subtilis* | YbfH |
| 221 | YbfI protein [*Bacillus subtilis*] | UniRef100_O31449 | *Bacillus subtilis* | YbfI |
| 222 | | | | |
| 223 | UPI00003CBC98 UniRef100 entry | | UniRef100_UPI00003CBC98 | |
| 224 | | | | |
| 225 | Oxidoreductase [*Lactococcus lactis*] | UniRef100_Q9CFC5 | *Lactococcus lactis* | |
| 226 | Methyl-accepting chemotaxis protein [*Oceanobacillus iheyensis*] | UniRef100_Q8EST3 | *Oceanobacillus iheyensis* | YvaQ |
| 227 | D-xylose-binding protein [*Thermoanaerobacter ethanolicus*] | UniRef100_O68456 | *Thermoanaerobacter ethanolicus* | RbsB |
| 228 | Hypothetical protein OB0544 [*Oceanobacillus iheyensis*] | UniRef100_Q8ESS4 | *Oceanobacillus iheyensis* | YomI |
| 229 | Hypothetical protein [*Bacillus cereus*] | UniRef100_Q81IR4 | *Bacillus cereus* | |
| 230 | Streptogramin B lactonase [*Staphylococcus cohnii*] | UniRef100_O87275 | *Staphylococcus cohnii* | |
| 231 | Hypothetical protein ycbP [*Bacillus subtilis*] | UniRef100_P42248 | *Bacillus subtilis* | YcbP |
| 232 | YbgF protein [*Bacillus subtilis*] | UniRef100_O31462 | *Bacillus subtilis* | YbgF |
| 233 | YbgG protein [*Bacillus subtilis*] | UniRef100_O31463 | *Bacillus subtilis* | YbgG |
| 234 | | | | |
| 235 | PTS system, n-acetylglucosamine-specific enzyme II, ABC component [*Bacillus halodurans*] | UniRef100_Q9KF24 | *Bacillus halodurans* | NagP |
| 236 | UPI00003CBDBC UniRef100 entry | | UniRef100_UPI00003CBDBC | Mta |
| 237 | Hypothetical protein [*Bacillus thuringiensis*] | UniRef100_Q6HIW0 | *Bacillus thuringiensis* | YdfS |

TABLE 1-continued

Predicted functions

| SEQ ID NO. | Description | UniRef Accession No. | Organism | Bacillus subtilis homolog (Gene Name) |
|---|---|---|---|---|
| 238 | Carbonic anhydrase [*Methanosarcina mazei*] | UniRef100_Q8PSJ1 | *Methanosarcina mazei* | YtoA |
| 239 | Hypothetical protein yjgA [*Bacillus thuringiensis*] | UniRef100_Q6HHU2 | *Bacillus thuringiensis* | YjgA |
| 240 | Amino acid carrier protein [*Bacillus thuringiensis*] | UniRef100_Q6HGU4 | *Bacillus thuringiensis* | YbgH |
| 241 | Probable glutaminase ybgJ [*Bacillus subtilis*] | UniRef100_O31465 | *Bacillus subtilis* | YbgJ |
| 242 | Two-component sensor kinase ycbA [*Bacillus cereus*] | UniRef100_Q81BN8 | *Bacillus cereus* | YcbA |
| 243 | Hypothetical sensory transduction protein ycbB [*Bacillus subtilis*] | UniRef100_P40759 | *Bacillus subtilis* | YcbB |
| 244 | | | | YoaA |
| 245 | | | | YbxI |
| 246 | | | | |
| 247 | Beta-lactamase precursor (EC 3.5.2.6) (Penicillinase) [Contains: Large exopenicillinase; Small exopenicillinase] [*Bacillus licheniformis*] | UniRef100_P00808 | Contains: Large exopenicillinase; Small exopenicillinase | PenP |
| 248 | Alkaline phosphatase D precursor [*Bacillus subtilis*] | UniRef100_P42251 | *Bacillus subtilis* | PhoD |
| 249 | | | | |
| 250 | Hypothetical protein ycbT [*Bacillus subtilis*] | UniRef100_P42252 | *Bacillus subtilis* | TatCD |
| 251 | | | | YcbC |
| 252 | Probable aldehyde dehydrogenase ycbD [*Bacillus subtilis*] | UniRef100_P42236 | *Bacillus subtilis* | YcbD |
| 253 | Probable glucarate transporter [*Bacillus subtilis*] | UniRef100_P42237 | *Bacillus subtilis* | YcbE |
| 254 | Probable glucarate dehydratase [*Bacillus subtilis*] | UniRef100_P42238 | *Bacillus subtilis* | YcbF |
| 255 | Hypothetical transcriptional regulator ycbG [*Bacillus subtilis*] | UniRef100_P42239 | *Bacillus subtilis* | YcbG |
| 256 | Probable D-galactarate dehydratase [*Bacillus subtilis*] | UniRef100_P42240 | *Bacillus subtilis* | YcbH |
| 257 | Hypothetical sensory transduction protein ycbL [*Bacillus subtilis*] | UniRef100_P42244 | *Bacillus subtilis* | YcbL |
| 258 | Sensor histidine kinase [*Bacillus cereus* ZK] | UniRef100_Q633Q6 | *Bacillus cereus* ZK | |
| 259 | Hypothetical ABC transporter ATP-binding protein ycbN [*Bacillus subtilis*] | UniRef100_P42246 | *Bacillus subtilis* | YcbN |
| 260 | Hypothetical protein ycbO [*Bacillus subtilis*] | UniRef100_P42247 | *Bacillus subtilis* | YcbO |
| 261 | | | | YcbO |
| 262 | YfnK [*Bacillus subtilis*] | UniRef100_O06490 | *Bacillus subtilis* | YetN |
| 263 | Hypothetical protein ybdO [*Bacillus subtilis*] | UniRef100_O31437 | *Bacillus subtilis* | YbdO |
| 264 | Hypothetical protein ycbJ [*Bacillus subtilis*] | UniRef100_P42242 | *Bacillus subtilis* | YcbJ |
| 265 | Hypothetical protein ywhA [*Bacillus subtilis*] | UniRef100_P70993 | *Bacillus subtilis* | YwhA |
| 266 | | | | YdaB |
| 267 | AlI0778 protein [*Anabaena* sp.] | UniRef100 Q8YYR8 | *Anabaena* sp. | |
| 268 | BH1298 protein [*Bacillus halodurans*] | UniRef100_Q9KDB5 | *Bacillus halodurans* | YbdN |
| 269 | BH1299 protein [*Bacillus halodurans*] | UniRef100_Q9KDB4 | *Bacillus halodurans* | |
| 270 | Transcriptional activator tipA, putative [*Bacillus anthracis*] | UniRef100_Q81XN3 | *Bacillus anthracis* | Mta |
| 271 | | | | |
| 272 | Transcriptional regulator, PadR family [*Bacillus cereus*] | UniRef100_Q81BZ0 | *Bacillus cereus* | |
| 273 | Hypothetical protein [*Bacillus cereus* ZK] | UniRef100_Q639U7 | *Bacillus cereus* ZK | |
| 274 | Tryptophan RNA-binding attenuator protein-inhibitory protein [*Bacillus subtilis*] | UniRef100_O31466 | *Bacillus subtilis* | |
| 275 | Hypothetical transport protein ycbK [*Bacillus subtilis*] | UniRef100_P42243 | *Bacillus subtilis* | YcbK |
| 276 | | | | YczC |
| 277 | Hypothetical protein yccF [*Bacillus subtilis*] | UniRef100_O34478 | *Bacillus subtilis* | YccF |

TABLE 1-continued

Predicted functions

| SEQ ID NO. | Description | UniRef Accession No. | Organism | Bacillus subtilis homolog (Gene Name) |
|---|---|---|---|---|
| 278 | SpaF [*Bacillus subtilis*] | UniRef100_Q45404 | *Bacillus subtilis* | YhcH |
| 279 | SpaE [*Bacillus subtilis*] | UniRef100_O52853 | *Bacillus subtilis* | |
| 280 | Putative SpaG [*Bacillus subtilis*] | UniRef100_Q93GG9 | *Bacillus subtilis* | |
| 281 | Subtilin biosynthesis regulatory protein spaR [*Bacillus subtilis*] | UniRef100_P33112 | *Bacillus subtilis* | YycF |
| 282 | Putative histidine kinase [*Bacillus subtilis*] | UniRef100_Q93GG7 | *Bacillus subtilis* | ResE |
| 283 | UPI00003CA401 UniRef100 entry | | UniRef100_UPI00003CA401 | YtlI |
| 284 | YusQ protein [*Bacillus subtilis*] | UniRef100_O32183 | *Bacillus subtilis* | YusQ |
| 285 | Complete genome; segment 6/17 [*Photorhabdus luminescens*] | UniRef100_Q7N6K9 | *Photorhabdus luminescens* | YusR |
| 286 | Methyltransferase [*Bacillus thuringiensis*] | UniRef100_Q6HK82 | *Bacillus thuringiensis* | |
| 287 | Hypothetical lipoprotein ycdA precursor [*Bacillus subtilis*] | UniRef100_O34538 | *Bacillus subtilis* | YcdA |
| 288 | UPI00003CB481 UniRef100 entry | | UniRef100_UPI00003CB481 | YcgA |
| 289 | Hypothetical conserved protein [*Oceanobacillus iheyensis*] | UniRef100_Q8ESQ2 | *Oceanobacillus iheyensis* | YtnL |
| 290 | Hypothetical conserved protein [*Oceanobacillus iheyensis*] | UniRef100_Q8ET83 | *Oceanobacillus iheyensis* | YvbK |
| 291 | | | | GatA |
| 292 | Oligoendopeptidase F, putative [*Bacillus anthracis*] | UniRef100_Q81JJ8 | *Bacillus anthracis* | YjbG |
| 293 | | | | |
| 294 | UPI00003CC42D UniRef100 entry | | UniRef100_UPI00003CC42D | PbpX |
| 295 | Hypothetical protein ysfD [*Bacillus subtilis*] | UniRef100_P94534 | *Bacillus subtilis* | YsfD |
| 296 | Hypothetical protein ysfC [*Bacillus subtilis*] | UniRef100_P94535 | *Bacillus subtilis* | YsfC |
| 297 | PTS system, cellobiose-specific enzyme II, B component [*Bacillus halodurans*] | UniRef100_Q9KEE3 | *Bacillus halodurans* | |
| 298 | PTS system, cellobiose-specific enzyme II, A component [*Bacillus halodurans*] | UniRef100_Q9KEE2 | *Bacillus halodurans* | LicA |
| 299 | PTS system, cellobiose-specific enzyme II, C component [*Oceanobacillus iheyensis*] | UniRef100_Q8EP43 | *Oceanobacillus iheyensis* | YwbA |
| 300 | 6-phospho-beta-glucosidase [*Bacillus halodurans*] | UniRef100_Q9KEE0 | *Bacillus halodurans* | LicH |
| 301 | Transcriptional regulator [*Bacillus halodurans*] | UniRef100_Q9KED8 | *Bacillus halodurans* | YbgA |
| 302 | | | | |
| 303 | | | | YvbX |
| 304 | Chitinase precursor [*Streptomyces olivaceoviridis*] | UniRef100_Q9L3E8 | *Streptomyces olivaceoviridis* | |
| 305 | Extracellular metalloprotease precursor [*Bacillus subtilis*] | UniRef100_P39790 | *Bacillus subtilis* | Mpr |
| 306 | Glucose 1-dehydrogenase II [*Bacillus subtilis*] | UniRef100_P80869 | *Bacillus subtilis* | YcdF |
| 307 | Hypothetical protein OB0244 [*Oceanobacillus iheyensis*] | UniRef100_Q8ETL6 | *Oceanobacillus iheyensis* | |
| 308 | Hypothetical protein ycdC [*Bacillus subtilis*] | UniRef100_O34772 | *Bacillus subtilis* | YcdC |
| 309 | | | | |
| 310 | Cell wall hydrolase cwlJ [*Bacillus subtilis*] | UniRef100_P42249 | *Bacillus subtilis* | CwlJ |
| 311 | Hypothetical protein yceB [*Bacillus subtilis*] | UniRef100_O34504 | *Bacillus subtilis* | YceB |
| 312 | Hypothetical protein yvcE [*Bacillus subtilis*] | UniRef100_P40767 | *Bacillus subtilis* | YvcE |
| 313 | ABC transporter, permease [*Bacillus cereus* ZK] | UniRef100_Q637N2 | *Bacillus cereus* ZK | YfiM |
| 314 | ABC transporter, ATP-binding protein [*Bacillus cereus*] | UniRef100_Q733P8 | *Bacillus cereus* | YfiL |
| 315 | UPI00003CC482 UniRef100 entry | | UniRef100_UPI00003CC482 | YsiA |
| 316 | Hypothetical protein OB3113 [*Oceanobacillus iheyensis*] | UniRef100_Q8ELV2 | *Oceanobacillus iheyensis* | |
| 317 | BH3953 protein [*Bacillus halodurans*] | UniRef100_Q9K5Y3 | *Bacillus halodurans* | |
| 318 | BH3951 protein [*Bacillus halodurans*] | UniRef100_Q9K5Y4 | *Bacillus halodurans* | PadR |

TABLE 1-continued

Predicted functions

| SEQ ID NO. | Description | UniRef Accession No. | Organism | Bacillus subtilis homolog (Gene Name) |
|---|---|---|---|---|
| 319 | Stress response protein SCP2 [Bacillus subtilis] | UniRef100_P81100 | Bacillus subtilis | YceC |
| 320 | General stress protein 16U [Bacillus subtilis] | UniRef100_P80875 | Bacillus subtilis | YceD |
| 321 | Hypothetical protein yceE [Bacillus subtilis] | UniRef100_O34384 | Bacillus subtilis | YceE |
| 322 | Hypothetical protein yceF [Bacillus subtilis] | UniRef100_O34447 | Bacillus subtilis | YceF |
| 323 | Hypothetical protein [Bacillus cereus] | UniRef100_Q72YD0 | Bacillus cereus | |
| 324 | YceG [Bacillus subtilis] | UniRef100_O34809 | Bacillus subtilis | YceG |
| 325 | Hypothetical protein yceH [Bacillus subtilis] | UniRef100_O34833 | Bacillus subtilis | YceH |
| 326 | UPI00003CB694 UniRef100 entry | | UniRef100_UPI00003CB694 | CcdA |
| 327 | Hypothetical conserved protein [Oceanobacillus iheyensis] | UniRef100_Q8ELB4 | Oceanobacillus iheyensis | YdiL |
| 328 | | | | Mta |
| 329 | Nitrate transporter [Bacillus subtilis] | UniRef100_P42432 | Bacillus subtilis | NasA |
| 330 | L-lactate dehydrogenase [Bacillus subtilis] | UniRef100_P13714 | Bacillus subtilis | Ldh |
| 331 | L-lactate permease [Bacillus subtilis] | UniRef100_P55910 | Bacillus subtilis | LctP |
| 332 | YcgF protein [Bacillus subtilis] | UniRef100_P94381 | Bacillus subtilis | YcgF |
| 333 | Homologue of aromatic amino acids transport protein of E. coli [Bacillus subtilis] | UniRef100_P94383 | Bacillus subtilis | YcgH |
| 334 | NH(3)-dependent NAD(+) synthetase [Bacillus subtilis] | UniRef100_P08164 | Bacillus subtilis | NadE |
| 335 | Shikimate kinase [Bacillus subtilis] | UniRef100_P37944 | Bacillus subtilis | AroK |
| 336 | YcgL protein [Bacillus subtilis] | UniRef100_P94389 | Bacillus subtilis | YcgL |
| 337 | Proline dehydrogenase [Bacillus subtilis] | UniRef100_Q8RL79 | Bacillus subtilis | YcgM |
| 338 | 1-pyrroline-5-carboxylate dehydrogenase 2 [Bacillus subtilis] | UniRef100_P94391 | Bacillus subtilis | YcgN |
| 339 | Homologue of proline permease of E. coli [Bacillus subtilis] | UniRef100_P94392 | Bacillus subtilis | YcgO |
| 340 | Hypothetical protein ycgP [Bacillus subtilis] | UniRef100_P94393 | Bacillus subtilis | YcgP |
| 341 | YcgQ protein [Bacillus subtilis] | UniRef100_P94394 | Bacillus subtilis | YcgQ |
| 342 | | | | YcgR |
| 343 | Cephalosporin-C deacetylase [Bacillus subtilis] | UniRef100_Q59233 | Bacillus subtilis | Cah |
| 344 | Transcriptional regulator [Bacillus halodurans] | UniRef100_Q9KF41 | Bacillus halodurans | YdgG |
| 345 | | | | |
| 346 | | | | |
| 347 | Probable amino-acid ABC transporter permease protein yckA [Bacillus subtilis] | UniRef100_P42399 | Bacillus subtilis | YckA |
| 348 | Probable ABC transporter extracellular binding protein yckB precursor [Bacillus subtilis] | UniRef100_P42400 | Bacillus subtilis | YckB |
| 349 | NAD(P)H dehydrogenase (Quinone); possible modulator of drug activity B [Bacillus cereus ZK] | UniRef100_Q63FG6 | Bacillus cereus ZK | YwrO |
| 350 | BH0315 protein [Bacillus halodurans] | UniRef100_Q9KG01 | Bacillus halodurans | |
| 351 | Probable beta-glucosidase [Bacillus subtilis] | UniRef100_P42403 | Bacillus subtilis | YckE |
| 352 | Nin [Bacillus amyloliquefaciens] | UniRef100_Q70KK3 | Bacillus amyloliquefaciens | Nin |
| 353 | DNA-entry nuclease [Bacillus subtilis] | UniRef100_P12667 | Bacillus subtilis | NucA |
| 354 | | | | YbdM |
| 355 | Methyl-accepting chemotaxis protein tlpC [Bacillus subtilis] | UniRef100_P39209 | Bacillus subtilis | TlpC |
| 356 | Hypothetical protein yqcG [Bacillus subtilis] | UniRef100_P45942 | Bacillus subtilis | YqcG |
| 357 | Hydantoin utilization protein A [Bordetella bronchiseptica] | UniRef100_Q7WCS3 | Bordetella bronchiseptica | |
| 358 | Hydantoin utilization protein B [Rhizobium loti] | UniRef100_Q987J6 | Rhizobium loti | |
| 359 | UPI000027D233 UniRef100 entry | | UniRef100_UPI000027D233 | YvfK |
| 360 | 358aa long hypothetical transporter ATP-binding protein [Aeropyrum pernix] | UniRef100_Q9YB65 | Aeropyrum pernix | MsmX |

TABLE 1-continued

Predicted functions

| SEQ ID NO. | Description | UniRef Accession No. | Organism | Bacillus subtilis homolog (Gene Name) |
|---|---|---|---|---|
| 361 | AttA2-like ABC transporter, permease protein [*Rhizobium meliloti*] | UniRef100_Q92ZH0 | *Rhizobium meliloti* | YesP |
| 362 | | | | YurM |
| 363 | | | | SrfAA |
| 364 | | | | SrfAB |
| 365 | | | | SrfAC |
| 366 | | | | SrfAD |
| 367 | | | | YcxC |
| 368 | | | | YcxD |
| 369 | 4'-phosphopantetheinyl transferase sfp [*Bacillus subtilis*] | UniRef100_P39135 | *Bacillus subtilis* | Sfp |
| 370 | Predicted esterase of alpha/beta hydrolase superfamily, YBBA *B. subtilis* ortholog [*Clostridium acetobutylicum*] | UniRef100_Q97HP7 | *Clostridium acetobutylicum* | YbbA |
| 371 | Transcriptional regulator [*Clostridium acetobutylicum*] | UniRef100_Q97LX8 | *Clostridium acetobutylicum* | YdeE |
| 372 | YczE [*Bacillus subtilis*] | UniRef100_Q9F4F8 | *Bacillus subtilis* | YczE |
| 373 | Hypothetical protein [*Symbiobacterium thermophilum*] | UniRef100_Q67MZ7 | *Symbiobacterium thermophilum* | |
| 374 | | | | YfiL |
| 375 | | | | |
| 376 | Hypothetical protein [*Symbiobacterium thermophilum*] | UniRef100_Q67MZ9 | *Symbiobacterium thermophilum* | |
| 377 | | | | |
| 378 | | | | |
| 379 | Methyl-accepting chemotaxis protein [*Bacillus thuringiensis*] | UniRef100_Q6HJV7 | *Bacillus thuringiensis* | TlpB |
| 380 | YckI [*Bacillus subtilis*] | UniRef100_Q9F4F9 | *Bacillus subtilis* | YckI |
| 381 | YckJ [*Bacillus subtilis*] | UniRef100_Q9F4G0 | *Bacillus subtilis* | YckJ |
| 382 | | | | YckK |
| 383 | | | | RocR |
| 384 | Ornithine aminotransferase [*Bacillus subtilis*] | UniRef100_P38021 | *Bacillus subtilis* | RocD |
| 385 | Amino-acid permease rocE [*Bacillus subtilis*] | UniRef100_P39137 | *Bacillus subtilis* | RocE |
| 386 | Arginase [*Bacillus subtilis*] | UniRef100_P39138 | *Bacillus subtilis* | RocF |
| 387 | Homologue of als operon regulatory protein AlsR of *B. subtilis* [*Bacillus subtilis*] | UniRef100_P94403 | *Bacillus subtilis* | YclA |
| 388 | Probable aromatic acid decarboxylase [*Bacillus subtilis*] | UniRef100_P94404 | *Bacillus subtilis* | YclB |
| 389 | Hypothetical protein yclC [*Bacillus subtilis*] | UniRef100_P94405 | *Bacillus subtilis* | YclC |
| 390 | YclD protein [*Bacillus subtilis*] | UniRef100_P94406 | *Bacillus subtilis* | YclD |
| 391 | | | | |
| 392 | | | | |
| 393 | | | | |
| 394 | Hypothetical protein [*Bacillus thuringiensis*] | UniRef100_Q6HMQ9 | *Bacillus thuringiensis* | |
| 395 | Hypothetical protein OB2810 [*Oceanobacillus iheyensis*] | UniRef100_Q8EMN2 | *Oceanobacillus iheyensis* | |
| 396 | | | | |
| 397 | | | | YxiD |
| 398 | | | | |
| 399 | | | | YxiB |
| 400 | Sugar ABC transporter [*Bacillus halodurans*] | UniRef100_Q9K7B8 | *Bacillus halodurans* | RbsB |
| 401 | Two-component sensor histidine kinase [*Bacillus halodurans*] | UniRef100_Q9K7B9 | *Bacillus halodurans* | YesM |
| 402 | | | | YesN |
| 403 | Multiple sugar transport system [*Bacillus halodurans*] | UniRef100_Q9K7C2 | *Bacillus halodurans* | RbsB |
| 404 | L-arabinose transport ATP-binding protein araG [*Bacillus stearothermophilus*] | UniRef100_Q9S472 | *Bacillus stearothermophilus* | RbsA |
| 405 | L-arabinose membrane permease [*Bacillus stearothermophilus*] | UniRef100_Q9S471 | *Bacillus stearothermophilus* | RbsC |
| 406 | Transporter [*Bacillus halodurans*] | UniRef100_Q9K9F3 | *Bacillus halodurans* | YbfB |
| 407 | YbfA protein [*Bacillus subtilis*] | UniRef100_O31443 | *Bacillus subtilis* | YbfA |

TABLE 1-continued

Predicted functions

| SEQ ID NO. | Description | UniRef Accession No. | Organism | Bacillus subtilis homolog (Gene Name) |
|---|---|---|---|---|
| 408 | Beta-D-galactosidase [Bacillus circulans] | UniRef100_Q45093 | Bacillus circulans | LacA |
| 409 | | | | Phy |
| 410 | Hypothetical transporter yclF [Bacillus subtilis] | UniRef100_P94408 | Bacillus subtilis | YclF |
| 411 | YclG protein [Bacillus subtilis] | UniRef100_P94409 | Bacillus subtilis | YclG |
| 412 | | | | |
| 413 | | | | GerKA |
| 414 | Spore germination protein KC precursor [Bacillus subtilis] | UniRef100_P49941 | Bacillus subtilis | GerKC |
| 415 | Spore germination protein KB [Bacillus subtilis] | UniRef100_P49940 | Bacillus subtilis | GerKB |
| 416 | | | | Mta |
| 417 | Hypothetical protein yclH [Bacillus subtilis] | UniRef100_P94411 | Bacillus subtilis | YclH |
| 418 | Hypothetical protein yclI [Bacillus subtilis] | UniRef100_P94412 | Bacillus subtilis | YclI |
| 419 | Hypothetical sensory transduction protein yclJ [Bacillus subtilis] | UniRef100_P94413 | Bacillus subtilis | YclJ |
| 420 | Hypothetical sensor-like histidine kinase yclK [Bacillus subtilis] | UniRef100_P94414 | Bacillus subtilis | YclK |
| 421 | Methyl-accepting chemotaxis protein [Bacillus halodurans] | UniRef100_Q9K632 | Bacillus halodurans | TlpA |
| 422 | Probable aspartokinase [Bacillus subtilis] | UniRef100_P94417 | Bacillus subtilis | YclM |
| 423 | Homologue of ferric anguibactin transport system permerase protein FatD of V. anguillarum [Bacillus subtilis] | UniRef100_P94418 | Bacillus subtilis | YclN |
| 424 | Homologue of ferric anguibactin transport system permerase protein FatC of V. anguillarum [Bacillus subtilis] | UniRef100_P94419 | Bacillus subtilis | YclO |
| 425 | Homologue of iron dicitrate transport ATP-binding protein FecE of E. coli [Bacillus subtilis] | UniRef100_P94420 | Bacillus subtilis | YclP |
| 426 | Ferric anguibactin-binding protein precursor FatB of V. anguillarum [Bacillus subtilis] | UniRef100_P94421 | Bacillus subtilis | YclQ |
| 427 | Homologue of multidrug resistance protein B, EmrB, of E. coli [Bacillus subtilis] | UniRef100_P94422 | Bacillus subtilis | YcnB |
| 428 | YcnC protein [Bacillus subtilis] | UniRef100_P94423 | Bacillus subtilis | YcnC |
| 429 | Hypothetical protein [Bacillus cereus ZK] | UniRef100_Q636R0 | Bacillus cereus ZK | YqiQ |
| 430 | Hypothetical oxidoreductase ycnD [Bacillus subtilis] | UniRef100_P94424 | Bacillus subtilis | YcnD |
| 431 | Hypothetical protein ycnE [Bacillus subtilis] | UniRef100_P94425 | Bacillus subtilis | |
| 432 | YczG protein [Bacillus subtilis] | UniRef100_O31480 | Bacillus subtilis | |
| 433 | Homologue of regulatory protein MocR of R. meliloti [Bacillus subtilis] | UniRef100_P94426 | Bacillus subtilis | GabR |
| 434 | Probable 4-aminobutyrate aminotransferase (EC 2.6.1.19) ((S)-3-amino-2-methylpropionate transaminase) [Bacillus subtilis] | UniRef100_P94427 | Bacillus subtilis | GabT |
| 435 | Cationic amino acid transporter [Oceanobacillus iheyensis] | UniRef100_Q8ESX7 | Oceanobacillus iheyensis | YhdG |
| 436 | Homologue of succinate semialdehyde dehydrogenase GabD of E. coli [Bacillus subtilis] | UniRef100_P94428 | Bacillus subtilis | GabD |
| 437 | | | | YwfM |
| 438 | | | | |
| 439 | YcnI protein [Bacillus subtilis] | UniRef100_P94431 | Bacillus subtilis | YcnI |
| 440 | Homologue of copper export protein PcoD of E. coli [Bacillus subtilis] | UniRef100_P94432 | Bacillus subtilis | YcnJ |
| 441 | YcnK protein [Bacillus subtilis] | UniRef100_P94433 | Bacillus subtilis | YcnK |
| 442 | Assimilatory nitrate reductase electron transfer subunit [Bacillus subtilis] | UniRef100_P42433 | Bacillus subtilis | NasB |
| 443 | Assimilatory nitrate reductase catalytic subunit [Bacillus subtilis] | UniRef100_P42434 | Bacillus subtilis | NasC |

TABLE 1-continued

Predicted functions

| SEQ ID NO. | Description | UniRef Accession No. | Organism | Bacillus subtilis homolog (Gene Name) |
|---|---|---|---|---|
| 444 | Nitrite reductase [NAD(P)H] [*Bacillus subtilis*] | UniRef100_P42435 | NAD(P)H | NasD |
| 445 | Assimilatory nitrite reductase [NAD(P)H] small subunit [*Bacillus subtilis*] | UniRef100_P42436 | NAD(P)H | NasE |
| 446 | Uroporphyrin-III C-methyltransferase [*Bacillus subtilis*] | UniRef100_P42437 | *Bacillus subtilis* | NasF |
| 447 | Hypothetical transcriptional regulator ydhC [*Bacillus subtilis*] | UniRef100_O05494 | *Bacillus subtilis* | YdhC |
| 448 | Sodium-dependent transporter [*Oceanobacillus iheyensis*] | UniRef100_Q8ENE3 | *Oceanobacillus iheyensis* | YflS |
| 449 | Hypothetical protein ycsD [*Bacillus subtilis*] | UniRef100_P42961 | *Bacillus subtilis* | |
| 450 | UPI00003CC424 UniRef100 entry | UniRef100_UPI00003CC424 | | |
| 451 | Possible transcriptional antiterminator, bglG family [*Bacillus cereus* ZK] | UniRef100_Q63A16 | *Bacillus cereus* ZK | MtlR |
| 452 | Putative sugar-specific PTS component EIIB [*Lactococcus raffinolactis*] | UniRef100_Q7X1N9 | *Lactococcus raffinolactis* | |
| 453 | SgaT protein [*Mannheimia succiniciproducens* MBEL55E] | UniRef100_Q65WA2 | *Mannheimia succiniciproducens* MBEL55E | |
| 454 | Transketolase, N-terminal subunit [*Streptococcus agalactiae*] | UniRef100_Q8E202 | *Streptococcus agalactiae* | Tkt |
| 455 | Putative transketolase [*Salmonella typhimurium*] | UniRef100_Q8ZND5 | *Salmonella typhimurium* | Dxs |
| 456 | Hypothetical protein ycsE [*Bacillus subtilis*] | UniRef100_P42962 | *Bacillus subtilis* | YcsE |
| 457 | Hypothetical UPF0271 protein ycsF [*Bacillus subtilis*] | UniRef100_P42963 | *Bacillus subtilis* | YcsF |
| 458 | Hypothetical protein ycsG [*Bacillus subtilis*] | UniRef100_P42964 | *Bacillus subtilis* | YcsG |
| 459 | Hypothetical UPF0317 protein ycsI [*Bacillus subtilis*] | UniRef100_P42966 | *Bacillus subtilis* | YcsI |
| 460 | Kinase A inhibitor [*Bacillus subtilis*] | UniRef100_P60495 | *Bacillus subtilis* | KipI |
| 461 | KipI antagonist [*Bacillus subtilis*] | UniRef100_Q7WY77 | *Bacillus subtilis* | KipA |
| 462 | HTH-type transcriptional regulator kipR [*Bacillus subtilis*] | UniRef100_P42968 | *Bacillus subtilis* | KipR |
| 463 | Hypothetical protein ycsK [*Bacillus subtilis*] | UniRef100_P42969 | *Bacillus subtilis* | YcsK |
| 464 | PTS system, mannitol-specific IIABC component [*Bacillus subtilis*] | UniRef100_P42956 | *Bacillus subtilis* | MtlA |
| 465 | Mannitol-1-phosphate 5-dehydrogenase [*Bacillus subtilis*] | UniRef100_P42957 | *Bacillus subtilis* | MtlD |
| 466 | YdaA protein [*Bacillus subtilis*] | UniRef100_P96574 | *Bacillus subtilis* | MtlR |
| 467 | General stress protein 39 [*Bacillus subtilis*] | UniRef100_P80873 | *Bacillus subtilis* | YdaD |
| 468 | Hypothetical protein ydaE [*Bacillus subtilis*] | UniRef100_P96578 | *Bacillus subtilis* | YdaE |
| 469 | Hypothetical protein [*Bacillus anthracis*] | UniRef100_Q81U55 | *Bacillus anthracis* | |
| 470 | General stress protein 26 [*Bacillus subtilis*] | UniRef100_P80238 | *Bacillus subtilis* | YdaG |
| 471 | YdaH protein [*Bacillus subtilis*] | UniRef100_P96581 | *Bacillus subtilis* | YdaH |
| 472 | Lin0463 protein [*Listeria innocua*] | UniRef100_Q92EJ6 | *Listeria innocua* | YvhJ |
| 473 | YdzA protein [*Bacillus subtilis*] | UniRef100_O31485 | *Bacillus subtilis* | |
| 474 | BH0424 protein [*Bacillus halodurans*] | UniRef100_Q9KFQ4 | *Bacillus halodurans* | |
| 475 | HTH-type transcriptional regulator lrpC [*Bacillus subtilis*] | UniRef100_P96582 | *Bacillus subtilis* | LrpC |
| 476 | PROBABLE DNA TOPOISOMERASE III [*Bacillus subtilis*] | UniRef100_P96583 | *Bacillus subtilis* | TopB |
| 477 | | | | |
| 478 | | | | |
| 479 | | | | |
| 480 | | | | YdaO |
| 481 | | | | YdaO |
| 482 | YdaP protein [*Bacillus subtilis*] | UniRef100_P96591 | *Bacillus subtilis* | YdaP |
| 483 | | | | |
| 484 | UPI00003CC069 UniRef100 entry | UniRef100_UPI00003CC069 | | |
| 485 | IS1627s1-related, transposase [*Bacillus anthracis* str. A2012] | UniRef100_Q7CMD0 | *Bacillus anthracis* str. A2012 | |
| 486 | | | | |

TABLE 1-continued

Predicted functions

| SEQ ID NO. | Description | UniRef Accession No. | Organism | Bacillus subtilis homolog (Gene Name) |
|---|---|---|---|---|
| 487 | Similar to ribosomal-protein-serine N-acetyltransferase [*Staphylococcus aureus*] | UniRef100_Q99WN5 | *Staphylococcus aureus* | YdaF |
| 488 | Manganese transport protein mntH [*Bacillus subtilis*] | UniRef100_P96593 | *Bacillus subtilis* | MntH |
| 489 | | | | |
| 490 | | | | AnsB |
| 491 | | | | YojK |
| 492 | YdaT protein [*Bacillus subtilis*] | UniRef100_P96595 | *Bacillus subtilis* | YdaT |
| 493 | Hypothetical protein ydbA [*Bacillus subtilis*] | UniRef100_P96596 | *Bacillus subtilis* | YdbA |
| 494 | Na+/H+ antiporter NhaC [*Bacillus cereus*] | UniRef100_Q81FX8 | *Bacillus cereus* | NhaC |
| 495 | YdbB protein [*Bacillus subtilis*] | UniRef100_P96597 | *Bacillus subtilis* | YdbB |
| 496 | Glucose starvation-inducible protein B [*Bacillus subtilis*] | UniRef100_P26907 | *Bacillus subtilis* | GsiB |
| 497 | Hypothetical UPF0118 protein ydbI [*Bacillus subtilis*] | UniRef100_P96604 | *Bacillus subtilis* | YdbI |
| 498 | | | | GltT |
| 499 | YdbJ protein [*Bacillus subtilis*] | UniRef100_P96605 | *Bacillus subtilis* | YdbJ |
| 500 | YdbK protein [*Bacillus subtilis*] | UniRef100_P96606 | *Bacillus subtilis* | YdbK |
| 501 | Hypothetical protein ydbL [*Bacillus subtilis*] | UniRef100_P96607 | *Bacillus subtilis* | YdbL |
| 502 | YdbM protein [*Bacillus subtilis*] | UniRef100_P96608 | *Bacillus subtilis* | YdbM |
| 503 | | | | |
| 504 | | | | |
| 505 | YdbP protein [*Bacillus subtilis*] | UniRef100_P96611 | *Bacillus subtilis* | YdbP |
| 506 | D-alanine--D-alanine ligase [*Bacillus subtilis*] | UniRef100_P96612 | *Bacillus subtilis* | Ddl |
| 507 | | | | MurF |
| 508 | Esterase [*Oceanobacillus iheyensis*] | UniRef100_Q8ESM0 | *Oceanobacillus iheyensis* | YvaK |
| 509 | YdbR protein [*Bacillus subtilis*] | UniRef100_P96614 | *Bacillus subtilis* | YdbR |
| 510 | YdbS protein [*Bacillus subtilis*] | UniRef100_P96615 | *Bacillus subtilis* | YdbS |
| 511 | YdbT protein [*Bacillus subtilis*] | UniRef100_P96616 | *Bacillus subtilis* | YdbT |
| 512 | YdcA protein [*Bacillus subtilis*] | UniRef100_P96617 | *Bacillus subtilis* | YdcA |
| 513 | | | | YdcC |
| 514 | | | | Alr |
| 515 | | | | |
| 516 | YdcE protein [*Bacillus subtilis*] | UniRef100_P96622 | *Bacillus subtilis* | YdcE |
| 517 | | | | RsbR |
| 518 | | | | RsbS |
| 519 | | | | RsbT |
| 520 | | | | RsbU |
| 521 | | | | RsbV |
| 522 | | | | RsbW |
| 523 | | | | SigB |
| 524 | | | | RsbX |
| 525 | YdcI protein [*Bacillus subtilis*] | UniRef100_O31489 | *Bacillus subtilis* | YdcI |
| 526 | Transcriptional regulator, TetR family [*Bacillus thuringiensis*] | UniRef100_Q6HGY5 | *Bacillus thuringiensis* | YxbF |
| 527 | Lin1189 protein [*Listeria innocua*] | UniRef100_Q92CI2 | *Listeria innocua* | YdgH |
| 528 | | | | |
| 529 | Protein sprT-like [*Bacillus subtilis*] | UniRef100_P96628 | *Bacillus subtilis* | YdcK |
| 530 | Possible transporter, EamA family [*Bacillus cereus* ZK] | UniRef100_Q638K5 | *Bacillus cereus* ZK | |
| 531 | | | | |
| 532 | Hypothetical protein ORF00034 [*Lactococcus lactis*] | UniRef100_O87235 | *Lactococcus lactis* | |
| 533 | Delta5 acyl-lipid desaturase [*Bacillus cereus*] | UniRef100_Q81C02 | *Bacillus cereus* | Des |
| 534 | Cold shock protein cspC [*Bacillus subtilis*] | UniRef100_P39158 | *Bacillus subtilis* | |
| 535 | | | | YogA |
| 536 | Membrane protein, putative [*Bacillus cereus*] | UniRef100_Q734Y0 | *Bacillus cereus* | YyaS |
| 537 | Transcriptional regulator, MarR family [*Bacillus cereus*] | UniRef100_Q734X9 | *Bacillus cereus* | YybA |
| 538 | Acetyltransferase, GNAT family [*Bacillus cereus*] | UniRef100_Q734X8 | *Bacillus cereus* | PaiA |

TABLE 1-continued

Predicted functions

| SEQ ID NO. | Description | UniRef Accession No. | Organism | Bacillus subtilis homolog (Gene Name) |
|---|---|---|---|---|
| 539 | Protease synthase and sporulation negative regulatory protein PAI 2 [*Bacillus cereus*] | UniRef100_Q734X7 | *Bacillus cereus* | PaiB |
| 540 | BH0654 protein [*Bacillus halodurans*] | UniRef100_Q9KF33 | *Bacillus halodurans* | RocF |
| 541 | | | | |
| 542 | YdeO protein [*Bacillus subtilis*] | UniRef100_P96672 | *Bacillus subtilis* | YdeO |
| 543 | Transporter, LysE family [*Bacillus cereus*] | UniRef100_Q81D17 | *Bacillus cereus* | YrhP |
| 544 | | | | YwqM |
| 545 | | | | |
| 546 | Permease, putative [*Bacillus anthracis*] | UniRef100_Q81QY7 | *Bacillus anthracis* | YvqJ |
| 547 | Putative cyclase [*Rhodopseudomonas palustris*] | UniRef100_Q6N497 | *Rhodopseudomonas palustris* | |
| 548 | Hypothetical transport protein ydgF [*Bacillus subtilis*] | UniRef100_P96704 | *Bacillus subtilis* | YdgF |
| 549 | | | | |
| 550 | | | | YknW |
| 551 | RNA polymerase sigma factor sigV [*Bacillus subtilis*] | UniRef100_O05404 | *Bacillus subtilis* | SigV |
| 552 | Putative anti-SigV factor [*Bacillus subtilis*] | UniRef100_O05403 | *Bacillus subtilis* | YrhM |
| 553 | Hypothetical protein yrhL [*Bacillus subtilis*] | UniRef100_O05402 | *Bacillus subtilis* | YrhL |
| 554 | | | | YdgK |
| 555 | | | | YwpD |
| 556 | | | | LytT |
| 557 | Collagen adhesion protein [*Bacillus cereus* ZK] | UniRef100_Q630P2 | *Bacillus cereus* ZK | |
| 558 | Lin0929 protein [*Listeria innocua*] | UniRef100_Q92D88 | *Listeria innocua* | |
| 559 | | | | |
| 560 | Metabolite transport protein [*Bacillus subtilis*] | UniRef100_O34718 | *Bacillus subtilis* | YdjK |
| 561 | Thiamine-monophosphate kinase [*Bacillus subtilis*] | UniRef100_O05514 | *Bacillus subtilis* | ThiL |
| 562 | Hypothetical UPF0079 protein ydiB [*Bacillus subtilis*] | UniRef100_O05515 | *Bacillus subtilis* | YdiB |
| 563 | YdiC protein [*Bacillus subtilis*] | UniRef100_O05516 | *Bacillus subtilis* | YdiC |
| 564 | YdiD protein [*Bacillus subtilis*] | UniRef100_O005517 | *Bacillus subtilis* | YdiD |
| 565 | Probable O-sialoglycoprotein endopeptidase [*Bacillus subtilis*] | UniRef100_O05518 | *Bacillus subtilis* | Gcp |
| 566 | | | | YdiF |
| 567 | | | | YdiF |
| 568 | Molybdenum cofactor biosynthesis protein C [*Bacillus subtilis*] | UniRef100_O05520 | *Bacillus subtilis* | YdiG |
| 569 | Redox-sensing transcriptional repressor rex [*Bacillus subtilis*] | UniRef100_O05521 | *Bacillus subtilis* | YdiH |
| 570 | YdiI [*Bacillus halodurans*] | UniRef100_Q9Z9P5 | *Bacillus halodurans* | |
| 571 | | | | TatCY |
| 572 | Hypothetical lipoprotein ydiK precursor [*Bacillus subtilis*] | UniRef100_O05524 | *Bacillus subtilis* | |
| 573 | | | | YdiL |
| 574 | 10 kDa chaperonin [*Bacillus subtilis*] | UniRef100_P28599 | *Bacillus subtilis* | |
| 575 | 60 kDa chaperonin [*Bacillus subtilis*] | UniRef100_P28598 | *Bacillus subtilis* | GroEL |
| 576 | | | | |
| 577 | | | | |
| 578 | Hypothetical protein yolD [Bacteriophage SPBc2] | UniRef100_O64030 | Bacteriophage SPBc2 | |
| 579 | | | | |
| 580 | | | | |
| 581 | YoaR [*Bacillus subtilis*] | UniRef100_O34611 | *Bacillus subtilis* | YoaR |
| 582 | Hypothetical protein yfmQ [*Bacillus subtilis*] | UniRef100_O06475 | *Bacillus subtilis* | YfmQ |
| 583 | | | | |
| 584 | YoqW protein [Bacteriophage SPBc2] | UniRef100_O64131 | Bacteriophage SPBc2 | YoqW |
| 585 | Lin2076 protein [*Listeria innocua*] | UniRef100_Q92A46 | *Listeria innocua* | YerO |
| 586 | PEP synthase [*Bacillus subtilis*] | UniRef100_O34309 | *Bacillus subtilis* | Pps |
| 587 | Hypothetical protein yoaF [*Bacillus subtilis*] | UniRef100_O31829 | *Bacillus subtilis* | |

TABLE 1-continued

Predicted functions

| SEQ ID NO. | Description | UniRef Accession No. | Organism | Bacillus subtilis homolog (Gene Name) |
|---|---|---|---|---|
| 588 | Hypothetical protein [*Staphylococcus aureus*] | UniRef100_Q6GK76 | *Staphylococcus aureus* | |
| 589 | Short-chain dehydrodenase [*Clostridium acetobutylicum*] | UniRef100_Q97LM1 | *Clostridium acetobutylicum* | DltE |
| 590 | Type B carboxylesterase [*Bacillus* sp. BP-7] | UniRef100_Q9L378 | *Bacillus* sp. BP-7 | PnbA |
| 591 | Inositol transport protein [*Oceanobacillus iheyensis*] | UniRef100_Q8E5X2 | *Oceanobacillus iheyensis* | IolF |
| 592 | Phage shock protein A homolog [*Bacillus subtilis*] | UniRef100_P54617 | *Bacillus subtilis* | PspA |
| 593 | YdjG protein [*Bacillus subtilis*] | UniRef100_O34434 | *Bacillus subtilis* | YdjG |
| 594 | YdjH protein [*Bacillus subtilis*] | UniRef100_O35004 | *Bacillus subtilis* | YdjH |
| 595 | YdjI protein [*Bacillus subtilis*] | UniRef100_O34789 | *Bacillus subtilis* | YdjI |
| 596 | Putative oxidoreductase [*Symbiobacterium thermophilum*] | UniRef100_Q67S08 | *Symbiobacterium thermophilum* | YtmO |
| 597 | YrhO [*Bacillus subtilis*] | UniRef100_O05405 | *Bacillus subtilis* | YrhO |
| 598 | | | | YrhP |
| 599 | Helix-turn-helix domain protein [*Bacillus cereus*] | UniRef100_Q73C00 | *Bacillus cereus* | |
| 600 | Stage V sporulation protein E [*Bacillus halodurans*] | UniRef100_Q9K7T4 | *Bacillus halodurans* | SpoVE |
| 601 | Stage V sporulation protein E [*Bacillus halodurans*] | UniRef100_Q9K7T3 | *Bacillus halodurans* | FtsW |
| 602 | | | | |
| 603 | Hypothetical protein [*Bacillus cereus*] | UniRef100_Q72Z89 | *Bacillus cereus* | |
| 604 | BH1889 protein [*Bacillus halodurans*] | UniRef100_Q9KBN6 | *Bacillus halodurans* | YobV |
| 605 | | | | YjeA |
| 606 | | | | YjeA |
| 607 | | | | TreA |
| 608 | Putative HTH-type transcriptional regulator yvdE [*Bacillus subtilis*] | UniRef100_O06987 | *Bacillus subtilis* | YvdE |
| 609 | Hypothetical protein yvdF [*Bacillus subtilis*] | UniRef100_O06988 | *Bacillus subtilis* | YvdF |
| 610 | Hypothetical protein yvdG [*Bacillus subtilis*] | UniRef100_O06989 | *Bacillus subtilis* | YvdG |
| 611 | Hypothetical protein yvdH [*Bacillus subtilis*] | UniRef100_O06990 | *Bacillus subtilis* | YvdH |
| 612 | Hypothetical protein yvdI [*Bacillus subtilis*] | UniRef100_O06991 | *Bacillus subtilis* | YvdI |
| 613 | Hypothetical protein yvdJ [*Bacillus subtilis*] | UniRef100_O06992 | *Bacillus subtilis* | YvdJ |
| 614 | Hypothetical glycosyl hydrolase yvdK [*Bacillus subtilis*] | UniRef100_O06993 | *Bacillus subtilis* | YvdK |
| 615 | Oligo-1,6-glucosidase [*Bacillus subtilis*] | UniRef100_O06994 | *Bacillus subtilis* | MalL |
| 616 | Putative beta-phosphoglucomutase [*Bacillus subtilis*] | UniRef100_O06995 | *Bacillus subtilis* | PgcM |
| 617 | Tyrosyl-tRNA synthetase 2 [*Bacillus subtilis*] | UniRef100_P25151 | *Bacillus subtilis* | TyrZ |
| 618 | Putative HTH-type transcriptional regulator ywaE [*Bacillus subtilis*] | UniRef100_P25150 | *Bacillus subtilis* | YwaE |
| 619 | | | | |
| 620 | Hypothetical protein SE2399 [*Staphylococcus epidermidis*] | UniRef100_Q8CQM7 | *Staphylococcus epidermidis* | |
| 621 | Hypothetical protein ydjM [*Bacillus subtilis*] | UniRef100_P40775 | *Bacillus subtilis* | YdjM |
| 622 | YdjN protein [*Bacillus subtilis*] | UniRef100_O34353 | *Bacillus subtilis* | YdjN |
| 623 | Hypothetical protein [*Bacillus cereus*] | UniRef100_Q81AT6 | *Bacillus cereus* | YeaA |
| 624 | | | | |
| 625 | Signal peptidase I [*Bacillus cereus*] | UniRef100_Q73C25 | *Bacillus cereus* | SipS |
| 626 | | | | |
| 627 | Hypothetical protein yhfK [*Bacillus subtilis*] | UniRef100_O07609 | *Bacillus subtilis* | YhfK |
| 628 | Transcriptional regulator [*Bacillus halodurans*] | UniRef100_Q9K766 | *Bacillus halodurans* | YdeE |
| 629 | Spore coat protein A [*Bacillus subtilis*] | UniRef100_P07788 | *Bacillus subtilis* | CotA |
| 630 | | | | YkrP |
| 631 | Extracellular protein [*Lactobacillus plantarum*] | UniRef100_Q88T27 | *Lactobacillus plantarum* | YcdA |
| 632 | Hypothetical UPF0018 protein yeaB [*Bacillus subtilis*] | UniRef100_P46348 | *Bacillus subtilis* | YeaB |

TABLE 1-continued

Predicted functions

| SEQ ID NO. | Description | UniRef Accession No. | Organism | Bacillus subtilis homolog (Gene Name) |
|---|---|---|---|---|
| 633 | YeaC [*Bacillus subtilis*] | UniRef100_P94474 | *Bacillus subtilis* | YeaC |
| 634 | Hypothetical protein [*Bacillus cereus*] | UniRef100_Q739D8 | *Bacillus cereus* | YeaD |
| 635 | YebA [*Bacillus subtilis*] | UniRef100_P94476 | *Bacillus subtilis* | YebA |
| 636 | GMP synthase [glutamine-hydrolyzing] [*Bacillus subtilis*] | UniRef100_P29727 | glutamine-hydrolyzing | GuaA |
| 637 | Hypoxanthine/guanine permease [*Bacillus subtilis*] | UniRef100_O34987 | *Bacillus subtilis* | PbuG |
| 638 | | | | YebC |
| 639 | Hypothetical UPF0316 protein yebE [*Bacillus subtilis*] | UniRef100_O34624 | *Bacillus subtilis* | YebE |
| 640 | YebG protein [*Bacillus subtilis*] | UniRef100_O34700 | *Bacillus subtilis* | |
| 641 | Phosphoribosylaminoimidazole carboxylase catalytic subunit [*Bacillus subtilis*] | UniRef100_P12044 | *Bacillus subtilis* | PurE |
| 642 | | | | PurK |
| 643 | Adenylosuccinate lyase [*Bacillus subtilis*] | UniRef100_P12047 | *Bacillus subtilis* | PurB |
| 644 | Phosphoribosylaminoimidazole-succinocarboxamide synthase [*Bacillus subtilis*] | UniRef100_P12046 | *Bacillus subtilis* | PurC |
| 645 | Hypothetical UPF0062 protein yexA [*Bacillus subtilis*] | UniRef100_P12049 | *Bacillus subtilis* | |
| 646 | Phosphoribosylformylglycinamidine synthase I [*Bacillus subtilis*] | UniRef100_P12041 | *Bacillus subtilis* | PurQ |
| 647 | Phosphoribosylformylglycinamidine synthase II [*Bacillus subtilis*] | UniRef100_P12042 | *Bacillus subtilis* | PurL |
| 648 | Amidophosphoribosyltransferase precursor [*Bacillus subtilis*] | UniRef100_P00497 | *Bacillus subtilis* | PurF |
| 649 | | | | PurM |
| 650 | Phosphoribosylglycinamide formyltransferase [*Bacillus subtilis*] | UniRef100_P12040 | *Bacillus subtilis* | PurN |
| 651 | Bifunctional purine biosynthesis protein purH [Includes: Phosphoribosylaminoimidazolecarboxamide formyltransferase (EC 2.1.2.3) (AICAR transformylase); IMP cyclohydrolase (EC 3.5.4.10) (Inosinicase) (IMP synthetase) (ATIC)] [*Bacillus subtilis*] | UniRef100_P12048 | Includes: Phosphoribosylaminoimidazolecarboxamide formyltransferase (EC 2.1.2.3) (AICAR transformylase); IMP cyclohydrolase (EC 3.5.4.10) (Inosinicase) (IMP synthetase) (ATIC) | PurH |
| 652 | Phosphoribosylamine--glycine ligase [*Bacillus subtilis*] | UniRef100_P12039 | *Bacillus subtilis* | PurD |
| 653 | | | | YxbF |
| 654 | Putative cytochrome P450 yjiB [*Bacillus subtilis*] | UniRef100_O34374 | *Bacillus subtilis* | YjiB |
| 655 | | | | |
| 656 | Hypothetical lipoprotein yybP precursor [*Bacillus subtilis*] | UniRef100_P37488 | *Bacillus subtilis* | YybP |
| 657 | Transposase [*Thermoanaerobacter tengcongensis*] | UniRef100_Q8RCM3 | *Thermoanaerobacter tengcongensis* | |
| 658 | Hypothetical protein [*Bacillus anthracis*] | UniRef100_Q81ZG4 | *Bacillus anthracis* | |
| 659 | Putative adenine deaminase yerA [*Bacillus subtilis*] | UniRef100_O34909 | *Bacillus subtilis* | YerA |
| 660 | YerB protein [*Bacillus subtilis*] | UniRef100_O34968 | *Bacillus subtilis* | YerB |
| 661 | YecD [*Bacillus subtilis*] | UniRef100_Q7BVT7 | *Bacillus subtilis* | YerC |
| 662 | PcrB protein homolog [*Bacillus subtilis*] | UniRef100_O34790 | *Bacillus subtilis* | PcrB |
| 663 | ATP-dependent DNA helicase pcrA [*Bacillus subtilis*] | UniRef100_O34580 | *Bacillus subtilis* | PcrA |
| 664 | DNA ligase [*Bacillus subtilis*] | UniRef100_O31498 | *Bacillus subtilis* | LigA |
| 665 | YerH protein [*Bacillus subtilis*] | UniRef100_O34629 | *Bacillus subtilis* | YerH |
| 666 | BH0586 protein [*Bacillus halodurans*] | UniRef100_Q9KF99 | *Bacillus halodurans* | |
| 667 | | | | |
| 668 | | | | |
| 669 | BH0589 protein [*Bacillus halodurans*] | UniRef100_Q9KF96 | *Bacillus halodurans* | |
| 670 | Phosphotriesterase homology protein [*Escherichia coli*] | UniRef100_P45548 | *Escherichia coli* | |

TABLE 1-continued

Predicted functions

| SEQ ID NO. | Description | UniRef Accession No. | Organism | Bacillus subtilis homolog (Gene Name) |
|---|---|---|---|---|
| 671 | Similar to unknown protein YhfS of Escherichia coli [Photorhabdus luminescens] | UniRef100_Q7N5F2 | Photorhabdus luminescens | Csd |
| 672 | Phosphopentomutase [Symbiobacterium thermophilum] | UniRef100_Q67S06 | Symbiobacterium thermophilum | Drm |
| 673 | Putative alanine racemase [Symbiobacterium thermophilum] | UniRef100_Q67S05 | Symbiobacterium thermophilum | |
| 674 | Glucosamine-6-phosphate deaminase [Oceanobacillus iheyensis] | UniRef100_Q8ESL6 | Oceanobacillus iheyensis | NagB |
| 675 | SapB protein [Bacillus subtilis] | UniRef100_Q45514 | Bacillus subtilis | SapB |
| 676 | | | | OpuE |
| 677 | Glutamyl-tRNA(Gln) amidotransferase subunit C [Bacillus subtilis] | UniRef100_O06492 | Bacillus subtilis | |
| 678 | Glutamyl-tRNA(Gln) amidotransferase subunit A [Bacillus subtilis] | UniRef100_O06491 | Bacillus subtilis | GatA |
| 679 | | | | GatB |
| 680 | Hypothetical protein [Bacillus megaterium] | UniRef100_Q848Y2 | Bacillus megaterium | |
| 681 | | | | |
| 682 | | | | YdhT |
| 683 | | | | |
| 684 | Putative HTH-type transcriptional regulator yerO [Bacillus subtilis] | UniRef100_O31500 | Bacillus subtilis | YerO |
| 685 | Swarming motility protein swrC [Bacillus subtilis] | UniRef100_O31501 | Bacillus subtilis | YerP |
| 686 | | | | YjcK |
| 687 | Inosine-uridine preferring nucleoside hydrolase [Bacillus cereus] | UniRef100_Q81DM6 | Bacillus cereus | |
| 688 | YerQ protein [Bacillus subtilis] | UniRef100_O31502 | Bacillus subtilis | YerQ |
| 689 | Hypothetical RNA methyltransferase yefA [Bacillus subtilis] | UniRef100_O31503 | Bacillus subtilis | YefA |
| 690 | Type I restriction-modification system specificity subunit [Bacillus cereus] | UniRef100_Q817S1 | Bacillus cereus | |
| 691 | Type I restriction-modification system methylation subunit [Bacillus cereus] | UniRef100_Q817S2 | Bacillus cereus | |
| 692 | Type IC specificity subunit [Streptococcus thermophilus] | UniRef100_Q9RNW0 | Streptococcus thermophilus | |
| 693 | Type I restriction-modification system restriction subunit [Bacillus cereus] | UniRef100_Q817S4 | Bacillus cereus | |
| 694 | | | | |
| 695 | Beta-glucosides PTS, EIIBCA [Lactobacillus plantarum] | UniRef100_Q88T54 | Lactobacillus plantarum | BglP |
| 696 | 6-phospho-beta-glucosidase [Lactobacillus plantarum] | UniRef100_Q88T55 | Lactobacillus plantarum | BglH |
| 697 | | | | LicT |
| 698 | Response regulator aspartate phosphatase K [Bacillus subtilis] | UniRef100_O34930 | Bacillus subtilis | RapK |
| 699 | | | | |
| 700 | Methyltransferase [Bacillus cereus ZK] | UniRef100_Q639N2 | Bacillus cereus ZK | |
| 701 | Hypothetical UPF0082 protein BCE0595 [Bacillus cereus] | UniRef100_P62032 | Bacillus cereus | YeeI |
| 702 | Putative HTH-type transcriptional regulator AF1627 [Archaeoglobus fulgidus] | UniRef100_O28646 | Archaeoglobus fulgidus | |
| 703 | | | | |
| 704 | YfmT [Bacillus subtilis] | UniRef100_O06478 | Bacillus subtilis | YfmT |
| 705 | YfmS [Bacillus subtilis] | UniRef100_O06477 | Bacillus subtilis | YfmS |
| 706 | | | | YflS |
| 707 | YfmR [Bacillus subtilis] | UniRef100_O06476 | Bacillus subtilis | YfmR |
| 708 | | | | |
| 709 | YciA protein [Bacillus subtilis] | UniRef100_P94398 | Bacillus subtilis | YciA |
| 710 | UPI00002BDF65 UniRef100 entry | UniRef100_UPI00002BDF65 | UniRef100_UPI00002BDF65 | YpdA |
| 711 | Ferrusion transporter protein [Klebsiella pneumoniae] | UniRef100_Q6U5S9 | Klebsiella pneumoniae | |
| 712 | | | | |
| 713 | YciC protein [Bacillus amyloliquefaciens] | UniRef100_Q70KK8 | Bacillus amyloliquefaciens | YciC |
| 714 | | | | BioW |
| 715 | Adenosylmethionine-8-amino-7-oxononanoate aminotransferase [Bacillus subtilis] | UniRef100_P53555 | Bacillus subtilis | BioA |

TABLE 1-continued

Predicted functions

| SEQ ID NO. | Description | UniRef Accession No. | Organism | Bacillus subtilis homolog (Gene Name) |
|---|---|---|---|---|
| 716 | 8-amino-7-oxononanoate synthase [*Bacillus subtilis*] | UniRef100_P53556 | *Bacillus subtilis* | BioF |
| 717 | BioD protein [*Bacillus amyloliquefaciens*] | UniRef100_Q70JZ0 | *Bacillus amyloliquefaciens* | BioD |
| 718 | BioB protein [*Bacillus amyloliquefaciens*] | UniRef100_Q70JZ1 | *Bacillus amyloliquefaciens* | BioB |
| 719 | BioI protein [*Bacillus amyloliquefaciens*] | UniRef100_Q70JZ2 | *Bacillus amyloliquefaciens* | BioI |
| 720 | BH1501 protein [*Bacillus halodurans*] | UniRef100_Q9KCR8 | *Bacillus halodurans* | |
| 721 | | | | YfmP |
| 722 | Multidrug efflux protein yfmO [*Bacillus subtilis*] | UniRef100_O06473 | *Bacillus subtilis* | YfmO |
| 723 | YfmM protein [*Bacillus subtilis*] | UniRef100_O34512 | *Bacillus subtilis* | YfmM |
| 724 | YfmL protein [*Bacillus subtilis*] | UniRef100_O34750 | *Bacillus subtilis* | YfmL |
| 725 | YfmJ protein [*Bacillus subtilis*] | UniRef100_O34812 | *Bacillus subtilis* | YfmJ |
| 726 | Hypothetical protein yfmB [*Bacillus subtilis*] | UniRef100_O34626 | *Bacillus subtilis* | YfmB |
| 727 | General stress protein 17M [*Bacillus subtilis*] | UniRef100_P80241 | *Bacillus subtilis* | YfIT |
| 728 | | | | YfIS |
| 729 | | | | YfIS |
| 730 | Putative permease [*Clostridium tetani*] | UniRef100_Q895A0 | *Clostridium tetani* | |
| 731 | Possible Zn-dependent hydrolase, beta-lactamase superfamily [*Bacillus thuringiensis*] | UniRef100_Q6HKH5 | *Bacillus thuringiensis* | YqgX |
| 732 | YflN protein [*Bacillus subtilis*] | UniRef100_O34409 | *Bacillus subtilis* | YflN |
| 733 | Zink-carboxypeptidase [*Clostridium tetani*] | UniRef100_Q898E1 | *Clostridium tetani* | |
| 734 | Nitric oxide synthase oxygenase [*Bacillus subtilis*] | UniRef100_O34453 | *Bacillus subtilis* | YflM |
| 735 | Membrane protein, putative [*Bacillus cereus*] | UniRef100_Q72YN4 | *Bacillus cereus* | YvaZ |
| 736 | Transcriptional regulator, ArsR family [*Bacillus cereus* ZK] | UniRef100_Q632K6 | *Bacillus cereus* ZK | |
| 737 | Putative acylphosphatase [*Bacillus subtilis*] | UniRef100_O35031 | *Bacillus subtilis* | |
| 738 | YflK protein [*Bacillus subtilis*] | UniRef100_O34542 | *Bacillus subtilis* | YflK |
| 739 | | | | |
| 740 | | | | |
| 741 | YflG protein [*Bacillus subtilis*] | UniRef100_O34484 | *Bacillus subtilis* | YflG |
| 742 | | | | YflE |
| 743 | Hypothetical protein yflB [*Bacillus subtilis*] | UniRef100_O34887 | *Bacillus subtilis* | |
| 744 | | | | YflA |
| 745 | Probable PTS system, trehalose-specific IIBC component [*Bacillus subtilis*] | UniRef100_P39794 | *Bacillus subtilis* | TreP |
| 746 | Alpha-glucosidase [*Bacillus* sp. DG0303] | UniRef100_Q9L872 | *Bacillus* sp. DG0303 | TreA |
| 747 | Trehalose operon transcriptional repressor [*Bacillus subtilis*] | UniRef100_P39796 | *Bacillus subtilis* | TreR |
| 748 | Acetyltransferases [*Thermoanaerobacter tengcongensis*] | UniRef100_Q8RBZ9 | *Thermoanaerobacter tengcongensis* | YvfD |
| 749 | | | | |
| 750 | | | | |
| 751 | Predicted pyridoxal phosphate-dependent enzyme apparently involved in regulation of cell wall biogenesis [*Thermoanaerobacter tengcongensis*] | UniRef100_Q8RBY7 | *Thermoanaerobacter tengcongensis* | SpsC |
| 752 | | | | YkuQ |
| 753 | UPI000029FB28 UniRef100 entry | | UniRef100_UPI000029FB28 | YtcB |
| 754 | Hypothetical protein MA2181 [*Methanosarcina acetivorans*] | UniRef100_Q8TNU7 | *Methanosarcina acetivorans* | |
| 755 | | | | |
| 756 | Beta 1,4 glucosyltransferase [*Bacillus cereus*] | UniRef100_Q81GJ1 | *Bacillus cereus* | YojJ |
| 757 | Predicted pyridoxal phosphate-dependent enzyme apparently involved in regulation of cell wall biogenesis [*Thermoanaerobacter tengcongensis*] | UniRef100_Q8RC02 | *Thermoanaerobacter tengcongensis* | SpsC |

TABLE 1-continued

Predicted functions

| SEQ ID NO. | Description | UniRef Accession No. | Organism | Bacillus subtilis homolog (Gene Name) |
|---|---|---|---|---|
| 758 | Predicted dehydrogenases and related proteins [*Thermoanaerobacter tengcongensis*] | UniRef100_Q8RC00 | *Thermoanaerobacter tengcongensis* | YrbE |
| 759 | UDP-glucose: GDP-mannose dehydrogenase [*Oceanobacillus iheyensis*] | UniRef100_Q8CXB6 | *Oceanobacillus iheyensis* | TuaD |
| 760 | Hypothetical protein [*Bacillus cereus* ZK] | UniRef100_Q635H5 | *Bacillus cereus* ZK | YqkD |
| 761 | Hypothetical UPF0087 protein ydeP [*Bacillus subtilis*] | UniRef100_P96673 | *Bacillus subtilis* | YdeP |
| 762 | Putative NAD(P)H nitroreductase yfkO [*Bacillus subtilis*] | UniRef100_O34475 | *Bacillus subtilis* | YfkO |
| 763 | | | | YfkN |
| 764 | General stress protein 18 [*Bacillus subtilis*] | UniRef100_P80876 | *Bacillus subtilis* | YfkM |
| 765 | YfkK protein [*Bacillus subtilis*] | UniRef100_O35019 | *Bacillus subtilis* | |
| 766 | Amino acid transporter [*Bacillus halodurans*] | UniRef100_Q9K5Q5 | *Bacillus halodurans* | YflA |
| 767 | YfkJ protein [*Bacillus subtilis*] | UniRef100_O35016 | *Bacillus subtilis* | YfkJ |
| 768 | Hypothetical protein yfkL precursor [*Bacillus subtilis*] | UniRef100_O34418 | *Bacillus subtilis* | YfkL |
| 769 | YfkH protein [*Bacillus subtilis*] | UniRef100_O34437 | *Bacillus subtilis* | YfkH |
| 770 | YfkF protein [*Bacillus subtilis*] | UniRef100_O34929 | *Bacillus subtilis* | YfkF |
| 771 | Hypothetical conserved protein [*Oceanobacillus iheyensis*] | UniRef100_Q8ELS1 | *Oceanobacillus iheyensis* | |
| 772 | YfkE protein [*Bacillus subtilis*] | UniRef100_O34840 | *Bacillus subtilis* | YfkE |
| 773 | YfkD protein [*Bacillus subtilis*] | UniRef100_O34579 | *Bacillus subtilis* | YfkD |
| 774 | Thioredoxin-like oxidoreductases [*Bacillus cereus*] | UniRef100_Q81IC7 | *Bacillus cereus* | YfkA |
| 775 | YfjT protein [*Bacillus subtilis*] | UniRef100_O35041 | *Bacillus subtilis* | |
| 776 | | | | YfjS |
| 777 | UPI000029390C UniRef100 entry | | UniRef100_UPI000029390C | AraM |
| 778 | | | | |
| 779 | YfjQ protein [*Bacillus subtilis*] | UniRef100_O31543 | *Bacillus subtilis* | YfjQ |
| 780 | YfjP protein [*Bacillus subtilis*] | UniRef100_O31544 | *Bacillus subtilis* | YfjP |
| 781 | | | | YfjO |
| 782 | YfjM protein [*Bacillus subtilis*] | UniRef100_O31547 | *Bacillus subtilis* | YfjM |
| 783 | | | | |
| 784 | Hypothetical protein yfjL [*Bacillus subtilis*] | UniRef100_P40773 | *Bacillus subtilis* | YfjL |
| 785 | UPI00003CB259 UniRef100 entry | | UniRef100_UPI00003CB259 | YvkB |
| 786 | YdhE protein [*Bacillus subtilis*] | UniRef100_O05496 | *Bacillus subtilis* | YdhE |
| 787 | Hypothetical protein yckD precursor [*Bacillus subtilis*] | UniRef100_P42402 | *Bacillus subtilis* | |
| 788 | Hypothetical metabolite transport protein ycel [*Bacillus subtilis*] | UniRef100_O34691 | *Bacillus subtilis* | Ycel |
| 789 | | | | SacX |
| 790 | Levansucrase and sucrase synthesis operon antiterminator [*Bacillus subtilis*] | UniRef100_P15401 | *Bacillus subtilis* | SacY |
| 791 | Hypothetical protein [Bacillus anthracis] | UniRef100_Q81NL1 | *Bacillus anthracis* | YbcF |
| 792 | Hypothetical protein ybcD [*Bacillus cereus* ZK] | UniRef100_Q639F7 | *Bacillus cereus* ZK | YbcD |
| 793 | Potential NADH-quinone oxidoreductase subunit 5 [*Bacillus subtilis*] | UniRef100_P39755 | *Bacillus subtilis* | NdhF |
| 794 | YbcI protein [*Bacillus subtilis*] | UniRef100_O34380 | *Bacillus subtilis* | YbcI |
| 795 | | | | YraA |
| 796 | TPP-dependent acetoin dehydrogenase E1 alpha-subunit [*Bacillus anthracis*] | UniRef100_Q81PM6 | *Bacillus anthracis* | AcoA |
| 797 | TPP-dependent acetoin dehydrogenase E1 beta-subunit [*Bacillus cereus*] | UniRef100_Q736U7 | *Bacillus cereus* | AcoB |
| 798 | Dihydrolipoyllysine-residue acetyltransferase component of acetoin cleaving system [*Bacillus subtilis*] | UniRef100_O31550 | *Bacillus subtilis* | AcoC |
| 799 | Dihydrolipoyl dehydrogenase [*Bacillus subtilis*] | UniRef100_O34324 | *Bacillus subtilis* | AcoL |
| 800 | Acetoin operon transcriptional activator, putative [*Bacillus cereus*] | UniRef100_Q736V6 | *Bacillus cereus* | AcoR |

TABLE 1-continued

Predicted functions

| SEQ ID NO. | Description | UniRef Accession No. | Organism | Bacillus subtilis homolog (Gene Name) |
|---|---|---|---|---|
| 801 | Hypothetical UPF0060 protein yfjF [Bacillus subtilis] | UniRef100_O31553 | Bacillus subtilis | YfjF |
| 802 | Maltose-6'-phosphate glucosidase [Bacillus subtilis] | UniRef100_P54716 | Bacillus subtilis | MalA |
| 803 | HTH-type transcriptional regulator glvR [Bacillus subtilis] | UniRef100_P54717 | Bacillus subtilis | YfiA |
| 804 | PTS system, arbutin-like IIBC component [Bacillus subtilis] | UniRef100_P54715 | Bacillus subtilis | MalP |
| 805 | UPI00003651CF UniRef100 entry | | UniRef100_UPI00003651CF | |
| 806 | UPI000034AA1D UniRef100 entry | | UniRef100_UPI000034AA1D | |
| 807 | Transcriptional regulator, MarR family [Bacillus cereus ZK] | UniRef100_Q638I2 | Bacillus cereus ZK | YvaP |
| 808 | | | | YfiD |
| 809 | Hypothetical protein yfiE [Bacillus subtilis] | UniRef100_P54721 | Bacillus subtilis | YfiE |
| 810 | Xylosidase/arabinosidase [Bacteroides thetaiotaomicron] | UniRef100_Q8A036 | Bacteroides thetaiotaomicron | XynB |
| 811 | Xylan beta-1,4-xylosidase [Bacillus halodurans] | UniRef100_Q9K6P5 | Bacillus halodurans | XynB |
| 812 | Trancriptional regulator of AraC family [Clostridium acetobutylicum] | UniRef100_Q97FW8 | Clostridium acetobutylicum | YbfI |
| 813 | | | | YtcQ |
| 814 | NAD(P)H dehydrogenase, quinone family [Bacilius cereus ZK] | UniRef100_Q638S8 | Bacillus cereus ZK | |
| 815 | Mutator MutT protein [Bacillus halodurans] | UniRef100_Q9K8B7 | Bacillus halodurans | YjhB |
| 816 | YfiT protein [Bacillus subtilis] | UniRef100_O31562 | Bacillus subtilis | YfiT |
| 817 | YfiX [Bacillus subtilis] | UniRef100_O52961 | Bacillus subtilis | YfiX |
| 818 | Hypothetical protein yfhB [Bacillus subtilis] | UniRef100_O31570 | Bacillus subtilis | YfhB |
| 819 | YfhC protein [Bacillus subtilis] | UniRef100_O31571 | Bacillus subtilis | YfhC |
| 820 | Hypothetical protein yfhD [Bacillus subtilis] | UniRef100_O31572 | Bacillus subtilis | |
| 821 | | | | |
| 822 | BH0923 homolog [Bacillus cereus] | UniRef100_Q81IA0 | Bacillus cereus | |
| 823 | Hypothetical UPF0105 protein yfhF [Bacillus subtilis] | UniRef100_O31574 | Bacillus subtilis | YfhF |
| 824 | Regulatory protein recX [Bacillus subtilis] | UniRef100_O31575 | Bacillus subtilis | YfhG |
| 825 | YfhH protein [Bacillus subtilis] | UniRef100_O31576 | Bacillus subtilis | YfhH |
| 826 | | | | |
| 827 | YfhJ protein [Bacillus subtilis] | UniRef100_O31578 | Bacillus subtilis | |
| 828 | CsbB protein [Bacillus subtilis] | UniRef100_Q45539 | Bacillus subtilis | CsbB |
| 829 | Hypothetical protein SE1997 [Staphylococcus epidermidis] | UniRef100_Q8CR87 | Staphylococcus epidermidis | |
| 830 | YfhO protein [Bacillus subtilis] | UniRef100_O31582 | Bacillus subtilis | YfhO |
| 831 | YfhP protein [Bacillus subtilis] | UniRef100_O31583 | Bacillus subtilis | YfhP |
| 832 | YfhQ protein [Bacillus subtilis] | UniRef100_O31584 | Bacillus subtilis | YfhQ |
| 833 | YfhS protein [Bacillus subtilis] | UniRef100_O31585 | Bacillus subtilis | |
| 834 | Unidentfied dehydrogenase [Bacillus subtilis] | UniRef100_P71079 | Bacillus subtilis | FabL |
| 835 | | | | |
| 836 | Hypothetical protein ygaB [Bacillus subtilis] | UniRef100_P71080 | Bacillus subtilis | |
| 837 | YgaC protein [Bacillus subtilis] | UniRef100_Q796Z1 | Bacillus subtilis | YgaC |
| 838 | Unidentified transporter-ATP binding [Bacillus subtilis] | UniRef100_P71082 | Bacillus subtilis | YgaD |
| 839 | Oligopeptide ABC transporter [Bacillus halodurans] | UniRef100_Q9K6T0 | Bacillus halodurans | AppD |
| 840 | Oligopeptide ABC transporter [Bacillus halodurans] | UniRef100_Q9K6T1 | Bacillus halodurans | AppF |
| 841 | Dipeptide transporter protein DppA [Bacillus firmus] | UniRef100_P94310 | Bacillus firmus | OppA |
| 842 | Dipeptide ABC transporter [Bacillus halodurans] | UniRef100_Q9K6T3 | Bacillus halodurans | AppB |
| 843 | Dipeptide transport system permease protein dppC [Bacillus pseudofirmus] | UniRef100_P94312 | Bacillus pseudofirmus | AppC |
| 844 | Hypothetical 40.7 kd protein [Bacillus subtilis] | UniRef100_P71083 | Bacillus subtilis | YgaE |
| 845 | Glutamate-1-semialdehyde 2,1-aminomutase 2 [Bacillus subtilis] | UniRef100_P71084 | Bacillus subtilis | GsaB |

TABLE 1-continued

Predicted functions

| SEQ ID NO. | Description | UniRef Accession No. | Organism | Bacillus subtilis homolog (Gene Name) |
|---|---|---|---|---|
| 846 | YgaF protein [*Bacillus subtilis*] | UniRef100_Q796Y8 | *Bacillus subtilis* | YgaF |
| 847 | Peroxide operon regulator [*Bacillus subtilis*] | UniRef100_P71086 | *Bacillus subtilis* | PerR |
| 848 | | | | |
| 849 | Hypothetical protein ygxA [*Bacillus subtilis*] | UniRef100_Q04385 | *Bacillus subtilis* | YgxA |
| 850 | | | | RapD |
| 851 | | | | |
| 852 | | | | |
| 853 | | | | |
| 854 | | | | |
| 855 | | | | |
| 856 | Hypothetical protein [*Bacillus thuringiensis*] | UniRef100_Q6HH72 | *Bacillus thuringiensis* | |
| 857 | | | | YxiD |
| 858 | Hypothetical protein [uncultured archaeon GZfos18F2] | UniRef100_Q64DF2 | uncultured archaeon GZfos18F2 | |
| 859 | | | | |
| 860 | | | | YxiD |
| 861 | | | | RapE |
| 862 | Putative membrane protein [*Streptomyces avermitilis*] | UniRef100_Q82NM0 | *Streptomyces avermitilis* | |
| 863 | 3-dehydroquinate dehydratase [*Listeria monocytogenes*] | UniRef100_Q8Y9N4 | *Listeria monocytogenes* | AroC |
| 864 | | | | ThiC |
| 865 | Putative aliphatic sulfonates transport ATP-binding protein ssuB [*Bacillus subtilis*] | UniRef100_P97027 | *Bacillus subtilis* | SsuB |
| 866 | Putative aliphatic sulfonates binding protein precursor [*Bacillus subtilis*] | UniRef100_P40400 | *Bacillus subtilis* | SsuA |
| 867 | Putative aliphatic sulfonates transport permease protein ssuC [*Bacillus subtilis*] | UniRef100_P40401 | *Bacillus subtilis* | SsuC |
| 868 | | | | SsuD |
| 869 | | | | SsuD |
| 870 | Hypothetical lipoprotein ygaO precursor [*Bacillus subtilis*] | UniRef100_P97029 | *Bacillus subtilis* | YgaO |
| 871 | DNA-binding protein [*Bacillus anthracis*] | UniRef100_Q81V18 | *Bacillus anthracis* | |
| 872 | | | | |
| 873 | ABC-type multidrug transport system, ATPase component [*Thermoanaerobacter tengcongensis*] | UniRef100_Q8RBH0 | *Thermoanaerobacter tengcongensis* | YhaQ |
| 874 | | | | |
| 875 | | | | |
| 876 | | | | |
| 877 | | | | |
| 878 | 30S ribosomal protein S14-2 [*Bacillus subtilis*] | UniRef100_O31587 | *Bacillus subtilis* | |
| 879 | Hypothetical protein yhzB [*Bacillus subtilis*] | UniRef100_O31588 | *Bacillus subtilis* | YhzB |
| 880 | Hypothetical 48.5 kd protein [*Bacillus subtilis*] | UniRef100_P97030 | *Bacillus subtilis* | YhbA |
| 881 | Hypothetical 35.8 kd protein [*Bacillus subtilis*] | UniRef100_P97031 | *Bacillus subtilis* | YhbB |
| 882 | CspR [*Bacillus subtilis*] | UniRef100_Q45512 | *Bacillus subtilis* | CspR |
| 883 | Hypothetical 27 kd protein [*Bacillus subtilis*] | UniRef100_P97032 | *Bacillus subtilis* | YhbD |
| 884 | Hypothetical Cytosolic Protein [*Bacillus cereus*] | UniRef100_Q813H1 | *Bacillus cereus* | YhbE |
| 885 | Hypothetical protein [*Bacillus anthracis*] | UniRef100_Q81PD2 | *Bacillus anthracis* | YhbF |
| 886 | | | | |
| 887 | PrkA protein [*Bacillus subtilis*] | UniRef100_P39134 | *Bacillus subtilis* | PrkA |
| 888 | Stress response UPF0229 protein yhbH [*Bacillus subtilis*] | UniRef100_P45742 | *Bacillus subtilis* | YhbH |
| 889 | YhbJ protein [*Bacillus subtilis*] | UniRef100_O31593 | *Bacillus subtilis* | YhbJ |
| 890 | Hypothetical transport protein yhcA [*Bacillus subtilis*] | UniRef100_P54585 | *Bacillus subtilis* | YhcA |
| 891 | Hypothetical protein yhcB [*Bacillus subtilis*] | UniRef100_P54586 | *Bacillus subtilis* | YhcB |

TABLE 1-continued

Predicted functions

| SEQ ID NO. | Description | UniRef Accession No. | Organism | Bacillus subtilis homolog (Gene Name) |
|---|---|---|---|---|
| 892 | | | | YhcC |
| 893 | | | | |
| 894 | Hypothetical ABC transporter ATP-binding protein yhcG [Bacillus subtilis] | UniRef100_P54591 | Bacillus subtilis | |
| 895 | Hypothetical ABC transporter ATP-binding protein yhcH [Bacillus subtilis] | UniRef100_P54592 | Bacillus subtilis | YhcH |
| 896 | Hypothetical protein yhcI [Bacillus subtilis] | UniRef100_P54593 | Bacillus subtilis | YhcI |
| 897 | Cold shock protein cspB [Bacillus subtilis] | UniRef100_P32081 | Bacillus subtilis | |
| 898 | ABC transporter, ATP-binding protein [Bacillus thuringiensis] | UniRef100_Q6HP89 | Bacillus thuringiensis | YusC |
| 899 | MW0417 protein [Staphylococcus aureus] | UniRef100_Q8NY20 | Staphylococcus aureus | YusB |
| 900 | ABC transporter substrate-binding protein [Bacillus cereus] | UniRef100_Q81IN6 | Bacillus cereus | YhcJ |
| 901 | Hypothetical symporter yhcL [Bacillus subtilis] | UniRef100_P54596 | Bacillus subtilis | YhcL |
| 902 | Hypothetical protein yhcM [Bacillus subtilis] | UniRef100_P54597 | Bacillus subtilis | YhcM |
| 903 | Acylamino-acid-releasing enzyme [Oceanobacillus iheyensis] | UniRef100_Q8CXN6 | Oceanobacillus iheyensis | YuxL |
| 904 | Lipoprotein yhcN precursor [Bacillus subtilis] | UniRef100_P54598 | Bacillus subtilis | YhcN |
| 905 | Hypothetical protein yhcP [Bacillus subtilis] | UniRef100_P54600 | Bacillus subtilis | YhcP |
| 906 | Hypothetical protein yhcQ [Bacillus subtilis] | UniRef100_P54601 | Bacillus subtilis | YhcQ |
| 907 | Two-component sensor histidine kinase [Bacillus subtilis] | UniRef100_O31661 | Bacillus subtilis | KinE |
| 908 | Hypothetical protein yhcR precursor [Bacillus subtilis] | UniRef100_P54602 | Bacillus subtilis | YhcR |
| 909 | Hypothetical protein yhcS [Bacillus subtilis] | UniRef100_P54603 | Bacillus subtilis | YhcS |
| 910 | Hypothetical pseudouridine synthase yhcT [Bacillus subtilis] | UniRef100_P54604 | Bacillus subtilis | YhcT |
| 911 | Hypothetical protein yhcU [Bacillus subtilis] | UniRef100_P54605 | Bacillus subtilis | YhcU |
| 912 | Hypothetical protein yhcV [Bacillus subtilis] | UniRef100_P54606 | Bacillus subtilis | YhcV |
| 913 | Hypothetical protein yhcW [Bacillus subtilis] | UniRef100_P54607 | Bacillus subtilis | YhcW |
| 914 | Hypothetical UPF0012 protein yhcX [Bacillus subtilis] | UniRef100_P54608 | Bacillus subtilis | YhcX |
| 915 | ABC transporter [Bacillus halodurans] | UniRef100_Q9KBA3 | Bacillus halodurans | YdiF |
| 916 | Hypothetical transport protein yrhG [Bacillus subtilis] | UniRef100_O05399 | Bacillus subtilis | YrhG |
| 917 | Lin0826 protein [Listeria innocua] | UniRef100_Q92DI7 | Listeria innocua | YwkB |
| 918 | Alcohol dehydrogenase [Bacillus cereus] | UniRef100_Q81CT4 | Bacillus cereus | YogA |
| 919 | Glycerol uptake operon antiterminator regulatory protein [Bacillus subtilis] | UniRef100_P30300 | Bacillus subtilis | GlpP |
| 920 | Glycerol uptake facilitator protein [Bacillus subtilis] | UniRef100_P18156 | Bacillus subtilis | GlpF |
| 921 | Glycerol kinase [Bacillus subtilis] | UniRef100_P18157 | Bacillus subtilis | GlpK |
| 922 | Aerobic glycerol-3-phosphate dehydrogenase [Bacillus subtilis] | UniRef100_P18158 | Bacillus subtilis | GlpD |
| 923 | Alpha-phosphoglucomutase [Bacillus subtilis subsp. subtilis] | UniRef100_Q68VA2 | Bacillus subtilis subsp. subtilis | YhxB |
| 924 | Hypothetical conserved protein [Oceanobacillus iheyensis] | UniRef100_Q8ELS7 | Oceanobacillus iheyensis | YcgB |
| 925 | Transcriptional regulator [Oceanobacillus iheyensis] | UniRef100_Q8ELS8 | Oceanobacillus iheyensis | |
| 926 | | | | YhcY |
| 927 | Hypothetical protein yhcZ [Bacillus subtilis] | UniRef100_O07528 | Bacillus subtilis | YhcZ |
| 928 | Hypothetical protein yhdA [Bacillus subtilis] | UniRef100_O07529 | Bacillus subtilis | YhdA |
| 929 | | | | |
| 930 | | | | |

TABLE 1-continued

Predicted functions

| SEQ ID NO. | Description | UniRef Accession No. | Organism | Bacillus subtilis homolog (Gene Name) |
|---|---|---|---|---|
| 931 | Hypothetical UPF0074 protein yhdE [Bacillus subtilis] | UniRef100_O07573 | Bacillus subtilis | YhdE |
| 932 | Flavohemoprotein [Bacillus halodurans] | UniRef100_Q9RC40 | Bacillus halodurans | Hmp |
| 933 | Stage V sporulation protein R [Bacillus subtilis] | UniRef100_P37875 | Bacillus subtilis | SpoVR |
| 934 | Probable endopeptidase lytE precursor [Bacillus subtilis] | UniRef100_P54421 | Bacillus subtilis | LytE |
| 935 | | | | CitR |
| 936 | | | | CitA |
| 937 | Glucose dehydrogenase-B [Bacillus halodurans] | UniRef100_Q9Z9R3 | Bacillus halodurans | |
| 938 | Hypothetical oxidoreductase yhdF [Bacillus subtilis] | UniRef100_O07575 | Bacillus subtilis | YhdF |
| 939 | Hypothetical protein yhdH [Bacillus subtilis] | UniRef100_O07577 | Bacillus subtilis | YhdH |
| 940 | 2,4-diaminobutyrate decarboxylase [Bacillus halodurans] | UniRef100_Q9KFB9 | Bacillus halodurans | |
| 941 | YdeE protein [Bacillus subtilis] | UniRef100_P96662 | Bacillus subtilis | YdeE |
| 942 | YdeL protein [Bacillus subtilis] | UniRef100_P96669 | Bacillus subtilis | YdeL |
| 943 | BH1582 protein [Bacillus halodurans] | UniRef100_Q9KCI9 | Bacillus halodurans | YhdJ |
| 944 | YhdK [Bacillus subtilis subsp. spizizenii] | UniRef100_Q7X2K9 | Bacillus subtilis subsp. spizizenii | |
| 945 | YhdL [Bacillus subtilis subsp. spizizenii] | UniRef100_Q7X2L0 | Bacillus subtilis subsp. spizizenii | YhdL |
| 946 | Hypothetical protein yhdM (RNA polymerase ECF (Extracytoplasmic function)-type sigma factor) [Bacillus subtilis] | UniRef100_O07582 | Bacillus subtilis | SigM |
| 947 | | | | YrkC |
| 948 | Hypothetical protein yhdO [Bacillus subtilis] | UniRef100_O07584 | Bacillus subtilis | YhdO |
| 949 | | | | |
| 950 | Acyl-CoA thioesterase 1 [Clostridium acetobutylicum] | UniRef100_Q97DR5 | Clostridium acetobutylicum | |
| 951 | UPI00003CB259 UniRef100 entry | UniRef100_UPI00003CB259 | | YvkB |
| 952 | | | | YhdP |
| 953 | HTH-type transcriptional regulator cueR [Bacillus subtilis] | UniRef100_O07586 | Bacillus subtilis | YhdQ |
| 954 | | | | YhdT |
| 955 | | | | |
| 956 | BH3511 protein [Bacillus halodurans] | UniRef100_Q9K762 | Bacillus halodurans | |
| 957 | Sporulation specific N-acetylmuramoyl-L-alanine amidase [Oceanobacillus iheyensis] | UniRef100_Q8CX69 | Oceanobacillus iheyensis | CwlC |
| 958 | Protein crcB homolog 1 [Bacillus subtilis] | UniRef100_O07590 | Bacillus subtilis | YhdU |
| 959 | Protein crcB homolog 2 [Bacillus subtilis] | UniRef100_O07591 | Bacillus subtilis | YhdV |
| 960 | | | | YhdW |
| 961 | | | | |
| 962 | Hypothetical UPF0003 protein yhdY [Bacillus subtilis] | UniRef100_O07594 | Bacillus subtilis | YhdY |
| 963 | NAD-dependent deacetylase [Bacillus subtilis] | UniRef100_O07595 | Bacillus subtilis | YhdZ |
| 964 | | | | |
| 965 | Hypothetical protein yheN [Bacillus subtilis] | UniRef100_O07596 | Bacillus subtilis | YheN |
| 966 | | | | Dat |
| 967 | Na(+)/H(+) antiporter [Bacillus subtilis] | UniRef100_O07553 | Bacillus subtilis | NhaC |
| 968 | Hypothetical protein yoxA [Bacillus subtilis] | UniRef100_P39840 | Bacillus subtilis | YoxA |
| 969 | Hypothetical protein ydhH [Bacillus subtilis] | UniRef100_O05500 | Bacillus subtilis | YdhH |
| 970 | Hypothetical protein [Bacillus cereus ZK] | UniRef100_Q63EB4 | Bacillus cereus ZK | |
| 971 | Hypothetical protein [Bacillus cereus] | UniRef100_Q81GF4 | Bacillus cereus | |
| 972 | Stress response protein nhaX [Bacillus subtilis] | UniRef100_O07552 | Bacillus subtilis | NhaX |

TABLE 1-continued

Predicted functions

| SEQ ID NO. | Description | UniRef Accession No. | Organism | Bacillus subtilis homolog (Gene Name) |
|---|---|---|---|---|
| 973 | Hypothetical protein yheI [*Bacillus subtilis*] | UniRef100_O07550 | *Bacillus subtilis* | YheI |
| 974 | Hypothetical protein yheH [*Bacillus subtilis*] | UniRef100_O07549 | *Bacillus subtilis* | YheH |
| 975 | Hypothetical protein yheG [*Bacillus subtilis*] | UniRef100_O07548 | *Bacillus subtilis* | YheG |
| 976 | Small, acid-soluble spore protein B [*Bacillus subtilis*] | UniRef100_P04832 | *Bacillus subtilis* | |
| 977 | BH1139 protein [*Bacillus halodurans*] | UniRef100_Q9KDS2 | *Bacillus halodurans* | |
| 978 | Sugar ABC transporter ATP-binding protein [*Oceanobacillus iheyensis*] | UniRef100_Q8CUH3 | *Oceanobacillus iheyensis* | MsmX |
| 979 | Fis-type helix-turn-helix domain protein [*Bacillus cereus*] | UniRef100_Q73A84 | *Bacillus cereus* | YxkF |
| 980 | Hypothetical protein yheE [*Bacillus subtilis*] | UniRef100_O07546 | *Bacillus subtilis* | |
| 981 | Hypothetical protein yheD [*Bacillus subtilis*] | UniRef100_O07545 | *Bacillus subtilis* | YheD |
| 982 | Hypothetical protein yheC [*Bacillus subtilis*] | UniRef100_O07544 | *Bacillus subtilis* | YheC |
| 983 | Hypothetical protein yheB [*Bacillus subtilis*] | UniRef100_O07543 | *Bacillus subtilis* | YheB |
| 984 | Hypothetical protein yheA [*Bacillus subtilis*] | UniRef100_O07542 | *Bacillus subtilis* | YheA |
| 985 | Stress response protein yhaX [*Bacillus subtilis*] | UniRef100_O07539 | *Bacillus subtilis* | YhaX |
| 986 | | | | HemZ |
| 987 | YhaR protein [*Bacillus subtilis*] | UniRef100_O07533 | *Bacillus subtilis* | YhaR |
| 988 | Response regulator aspartate phosphatase I [*Bacillus subtilis*] | UniRef100_P96649 | *Bacillus subtilis* | RapI |
| 989 | | | | |
| 990 | Hypothetical protein yhaQ [*Bacillus subtilis*] | UniRef100_O07524 | *Bacillus subtilis* | YhaQ |
| 991 | Hypothetical protein yhaP [*Bacillus subtilis*] | UniRef100_O07523 | *Bacillus subtilis* | YhaP |
| 992 | | | | YhaO |
| 993 | Hypothetical protein yhaN [*Bacillus subtilis*] | UniRef100_O08455 | *Bacillus subtilis* | YhaN |
| 994 | | | | YhaM |
| 995 | Hypothetical protein yhaL [*Bacillus subtilis*] | UniRef100_O07520 | *Bacillus subtilis* | |
| 996 | Foldase protein prsA precursor [*Bacillus subtilis*] | UniRef100_P24327 | *Bacillus subtilis* | PrsA |
| 997 | | | | |
| 998 | Hypothetical protein yhaK [*Bacillus subtilis*] | UniRef100_O07519 | *Bacillus subtilis* | |
| 999 | Hypothetical protein yhaI [*Bacillus subtilis*] | UniRef100_O07517 | *Bacillus subtilis* | YhaI |
| 1000 | Protease production regulatory protein hpr [*Bacillus subtilis*] | UniRef100_P11065 | *Bacillus subtilis* | Hpr |
| 1001 | Hypothetical protein yhaH [*Bacillus subtilis*] | UniRef100_O07516 | *Bacillus subtilis* | YhaH |
| 1002 | Probable tryptophan transport protein [*Bacillus subtilis*] | UniRef100_O07515 | *Bacillus subtilis* | YhaG |
| 1003 | Phosphoserine aminotransferase [*Bacillus subtilis*] | UniRef100_P80862 | *Bacillus subtilis* | SerC |
| 1004 | Hit protein [*Bacillus subtilis*] | UniRef100_O07513 | *Bacillus subtilis* | Hit |
| 1005 | | | | |
| 1006 | ABC-type transporter ATP-binding protein ecsA [*Bacillus subtilis*] | UniRef100_P55339 | *Bacillus subtilis* | EcsA |
| 1007 | Protein ecsB [*Bacillus subtilis*] | UniRef100_P55340 | *Bacillus subtilis* | EcsB |
| 1008 | Protein ecsC [*Bacillus subtilis*] | UniRef100_P55341 | *Bacillus subtilis* | EcsC |
| 1009 | YhaA protein [*Bacillus subtilis*] | UniRef100_O07598 | *Bacillus subtilis* | YhaA |
| 1010 | Hypothetical protein yhfA [*Bacillus subtilis*] | UniRef100_O07599 | *Bacillus subtilis* | YhfA |
| 1011 | Hypothetical protein yhgC [*Bacillus subtilis*] | UniRef100_P38049 | *Bacillus subtilis* | YhgC |
| 1012 | Penicillin-binding protein 1F [*Bacillus subtilis*] | UniRef100_P38050 | *Bacillus subtilis* | PbpF |
| 1013 | Uroporphyrinogen decarboxylase [*Bacillus subtilis*] | UniRef100_P32395 | *Bacillus subtilis* | HemE |
| 1014 | Ferrochelatase [*Bacillus subtilis*] | UniRef100_P32396 | *Bacillus subtilis* | HemH |

TABLE 1-continued

Predicted functions

| SEQ ID NO. | Description | UniRef Accession No. | Organism | Bacillus subtilis homolog (Gene Name) |
|---|---|---|---|---|
| 1015 | Protoporphyrinogen oxidase [*Bacillus subtilis*] | UniRef100_P32397 | *Bacillus subtilis* | HemY |
| 1016 | | | | YhgD |
| 1017 | Hypothetical protein yhgE [*Bacillus subtilis*] | UniRef100_P32399 | *Bacillus subtilis* | YhgE |
| 1018 | 3-oxoacyl-[acyl-carrier-protein] synthase III protein 2 [*Bacillus subtilis*] | UniRef100_O07600 | acyl-carrier-protein | FabHB |
| 1019 | Hypothetical protein yhfE [*Bacillus subtilis*] | UniRef100_O07603 | *Bacillus subtilis* | YhfE |
| 1020 | | | | |
| 1021 | Hypothetical protein yhfG [*Bacillus subtilis*] | UniRef100_O07605 | *Bacillus subtilis* | GltT |
| 1022 | Hypothetical protein yhfI [*Bacillus subtilis*] | UniRef100_O07607 | *Bacillus subtilis* | YhfI |
| 1023 | Hypothetical protein yhfJ [*Bacillus subtilis*] | UniRef100_O07608 | *Bacillus subtilis* | YhfJ |
| 1024 | Hypothetical protein yhfL [*Bacillus subtilis*] | UniRef100_O07610 | *Bacillus subtilis* | YhfL |
| 1025 | Hypothetical protein yhfM precursor [*Bacillus subtilis*] | UniRef100_O07611 | *Bacillus subtilis* | YhfM |
| 1026 | BH2909 protein [*Bacillus halodurans*] | UniRef100_Q9K8U3 | *Bacillus halodurans* | |
| 1027 | Branched-chain amino acid transporter [*Bacillus halodurans*] | UniRef100_Q9K8U2 | *Bacillus halodurans* | AzlC |
| 1028 | BH2911 protein [*Bacillus halodurans*] | UniRef100_Q9K8U1 | *Bacillus halodurans* | |
| 1029 | Putative metalloprotease yhfN [*Bacillus subtilis*] | UniRef100_P40769 | *Bacillus subtilis* | YhfN |
| 1030 | | | | AprE |
| 1031 | Transporter, drug/metabolite exporter family [*Bacillus cereus ZK*] | UniRef100_Q63D40 | *Bacillus cereus* ZK | YdeD |
| 1032 | Hypothetical protein yhfQ [*Bacillus subtilis*] | UniRef100_O07616 | *Bacillus subtilis* | YhfQ |
| 1033 | YfmD protein [*Bacillus subtilis*] | UniRef100_O34933 | *Bacillus subtilis* | YfmD |
| 1034 | YfmE protein [*Bacillus subtilis*] | UniRef100_O34832 | *Bacillus subtilis* | YfmE |
| 1035 | Hypothetical protein yhfR [*Bacillus subtilis*] | UniRef100_O07617 | *Bacillus subtilis* | YhfR |
| 1036 | Heme-based aerotactic transducer hemAT [*Bacillus subtilis*] | UniRef100_O07621 | *Bacillus subtilis* | HemAT |
| 1037 | Rieske 2Fe-2S iron-sulfur protein, putative [*Bacillus cereus*] | UniRef100_Q73E94 | *Bacillus cereus* | YhfW |
| 1038 | | | | YhxC |
| 1039 | Hypothetical protein yhzC [*Bacillus subtilis*] | UniRef100_O31594 | *Bacillus subtilis* | |
| 1040 | | | | ComK |
| 1041 | | | | YhjD |
| 1042 | | | | YhjE |
| 1043 | Signal peptidase I V [*Bacillus subtilis*] | UniRef100_O07560 | *Bacillus subtilis* | SipV |
| 1044 | Minor extracellular protease epr precursor [*Bacillus subtilis*] | UniRef100_P16396 | *Bacillus subtilis* | Epr |
| 1045 | Putative permease [*Klebsiella pneumoniae*] | UniRef100_Q765R6 | *Klebsiella pneumoniae* | YbO |
| 1046 | Hypothetical protein [*Enterococcus faecalis*] | UniRef100_Q82ZQ4 | *Enterococcus faecalis* | PucR |
| 1047 | Putative allantoinase [*Staphylococcus xylosus*] | UniRef100_Q9EV52 | *Staphylococcus xylosus* | PucH |
| 1048 | Peptidase, M20/M25/M40 family [*Enterococcus faecalis*] | UniRef100_Q82ZQ2 | *Enterococcus faecalis* | YurH |
| 1049 | Hypothetical protein STY0574 [*Salmonella typhi*] | UniRef100_Q8XFX7 | *Salmonella typhi* | |
| 1050 | Ureidoglycolate dehydrogenase [*Enterococcus faecalis*] | UniRef100_Q838P9 | *Enterococcus faecalis* | YjmC |
| 1051 | Ureidoglycolate dehydrogenase [*Enterococcus faecalis*] | UniRef100_Q838P9 | *Enterococcus faecalis* | YjmC |
| 1052 | Hypothetical protein [*Enterococcus faecalis*] | UniRef100_Q838Q3 | *Enterococcus faecalis* | SucD |
| 1053 | Hypothetical protein [*Enterococcus faecalis*] | UniRef100_Q838Q3 | *Enterococcus faecalis* | |
| 1054 | | | | |
| 1055 | Carbamate kinase [*Clostridium tetani*] | UniRef100_Q890W1 | *Clostridium tetani* | |
| 1056 | Major facilitator family transporter [*Enterococcus faecalis*] | UniRef100_Q838Q1 | *Enterococcus faecalis* | YcbE |

TABLE 1-continued

Predicted functions

| SEQ ID NO. | Description | UniRef Accession No. | Organism | Bacillus subtilis homolog (Gene Name) |
|---|---|---|---|---|
| 1057 | Hypothetical protein yjfA precursor [*Bacillus subtilis*] | UniRef100_O34554 | *Bacillus subtilis* | |
| 1058 | Response regulator aspartate phosphatase G [*Bacillus subtilis*] | UniRef100_O32294 | *Bacillus subtilis* | RapG |
| 1059 | | | | |
| 1060 | | | | |
| 1061 | | | | |
| 1062 | LacI-family transcription regulator [*Bacillus subtilis*] | UniRef100_O34829 | *Bacillus subtilis* | MsmR |
| 1063 | Multiple sugar-binding protein [*Bacillus subtilis*] | UniRef100_O34335 | *Bacillus subtilis* | MsmE |
| 1064 | Sugar transporter [*Bacillus subtilis*] | UniRef100_O34706 | *Bacillus subtilis* | AmyD |
| 1065 | Sugar transporter [*Bacillus subtilis*] | UniRef100_O34518 | *Bacillus subtilis* | AmyC |
| 1066 | Alpha-galactosidase [*Bacillus subtilis*] | UniRef100_O34645 | *Bacillus subtilis* | MelA |
| 1067 | Hypothetical protein yhjN [*Bacillus subtilis*] | UniRef100_O07568 | *Bacillus subtilis* | YhjN |
| 1068 | Spore coat-associated protein JA [*Bacillus cereus* ZK] | UniRef100_Q63FK5 | *Bacillus cereus* ZK | |
| 1069 | CotJB protein [*Bacillus subtilis*] | UniRef100_Q45537 | *Bacillus subtilis* | |
| 1070 | CotJC protein [*Bacillus subtilis*] | UniRef100_Q45538 | *Bacillus subtilis* | CotJC |
| 1071 | Long-chain fatty-acid-CoA ligase [*Bacillus halodurans*] | UniRef100_Q9KDT0 | *Bacillus halodurans* | YngI |
| 1072 | Hypothetical protein yhjO [*Bacillus subtilis*] | UniRef100_O07569 | *Bacillus subtilis* | YhjO |
| 1073 | Hypothetical protein [*Bacillus cereus* ZK] | UniRef100_Q63FZ3 | *Bacillus cereus* ZK | LytB |
| 1074 | Sensor histidine kinase [*Bacillus thuringiensis*] | UniRef100_Q6HNG3 | *Bacillus thuringiensis* | PhoR |
| 1075 | Two-component response regulator [*Bacillus cereus*] | UniRef100_Q81I36 | *Bacillus cereus* | YclJ |
| 1076 | | | | YhjR |
| 1077 | Putative molybdate binding protein, YvgL [*Bacillus subtilis*] | UniRef100_O32208 | *Bacillus subtilis* | YvgL |
| 1078 | Putative molybdate transport protein, YvgM [*Bacillus subtilis*] | UniRef100_O32209 | *Bacillus subtilis* | YvgM |
| 1079 | ATP-dependent nuclease subunit B [*Bacillus subtilis*] | UniRef100_P23477 | *Bacillus subtilis* | AddB |
| 1080 | ATP-dependent nuclease subunit A [*Bacillus subtilis*] | UniRef100_P23478 | *Bacillus subtilis* | AddA |
| 1081 | Exonuclease sbcD homolog [*Bacillus subtilis*] | UniRef100_P23479 | *Bacillus subtilis* | SbcD |
| 1082 | Nuclease sbcCD subunit C [*Bacillus subtilis*] | UniRef100_O06714 | *Bacillus subtilis* | YirY |
| 1083 | Probable spore germination protein gerPF [*Bacillus subtilis*] | UniRef100_O06716 | *Bacillus subtilis* | |
| 1084 | Probable spore germination protein gerPE [*Bacillus subtilis*] | UniRef100_O06717 | *Bacillus subtilis* | GerPE |
| 1085 | Probable spore germination protein gerPD [*Bacillus subtilis*] | UniRef100_O06718 | *Bacillus subtilis* | |
| 1086 | Probable spore germination protein gerPC [*Bacillus subtilis*] | UniRef100_O06719 | *Bacillus subtilis* | GerPC |
| 1087 | Probable spore germination protein gerPB [*Bacillus subtilis*] | UniRef100_O06720 | *Bacillus subtilis* | |
| 1088 | Probable spore germination protein gerPA [*Bacillus subtilis*] | UniRef100_O06721 | *Bacillus subtilis* | |
| 1089 | Hypothetical protein yitR [*Bacillus subtilis*] | UniRef100_O06753 | *Bacillus subtilis* | |
| 1090 | | | | |
| 1091 | Spore coat protein H [*Bacillus cereus*] | UniRef100_Q81EE9 | *Bacillus cereus* | CotH |
| 1092 | | | | CotG |
| 1093 | YisK [*Bacillus subtilis*] | UniRef100_O06724 | *Bacillus subtilis* | YisK |
| 1094 | Hypothetical protein yloQ [*Bacillus cereus* ZK] | UniRef100_Q63CF2 | *Bacillus cereus* ZK | YloQ |
| 1095 | YisL [*Bacillus subtilis*] | UniRef100_O06725 | *Bacillus subtilis* | YisL |
| 1096 | Hypothetical protein yisN [*Bacillus subtilis*] | UniRef100_O06727 | *Bacillus subtilis* | YisN |
| 1097 | Asparagine synthetase [*glutamine-hydrolyzing*] 3 [*Bacillus subtilis*] | UniRef100_O05272 | glutamine-hydrolyzing | AsnO |
| 1098 | | | | NrgA |
| 1099 | Nitrogen regulatory PII protein [*Oceanobacillus iheyensis*] | UniRef100_Q8ERT8 | *Oceanobacillus iheyensis* | |

TABLE 1-continued

Predicted functions

| SEQ ID NO. | Description | UniRef Accession No. | Organism | Bacillus subtilis homolog (Gene Name) |
|---|---|---|---|---|
| 1100 | YisQ [Bacillus subtilis] | UniRef100_O07940 | Bacillus subtilis | YisQ |
| 1101 | Putative HTH-type transcriptional regulator yisR [Bacillus subtilis] | UniRef100_P40331 | Bacillus subtilis | YisR |
| 1102 | Acetyltransferase, GNAT family [Bacillus cereus ZK] | UniRef100_Q63C80 | Bacillus cereus ZK | YokL |
| 1103 | HTH-type transcriptional regulator degA [Bacillus subtilis] | UniRef100_P37947 | Bacillus subtilis | DegA |
| 1104 | Hypothetical oxidoreductase yisS [Bacillus subtilis] | UniRef100_P40332 | Bacillus subtilis | YisS |
| 1105 | YisV protein [Bacillus subtilis] | UniRef100_Q796Q6 | Bacillus subtilis | YisV |
| 1106 | Diaminobutyrate-pyruvate transaminase [Bacillus halodurans] | UniRef100_Q9K9M1 | Bacillus halodurans | GabT |
| 1107 | L-2,4-diaminobutyrate decarboxylase [Anabaena sp.] | UniRef100_Q8YZR2 | Anabaena sp. | |
| 1108 | All0394 protein [Anabaena sp.] | UniRef100_Q8YZR3 | Anabaena sp. | |
| 1109 | BH2621 protein [Bacillus halodurans] | UniRef100_Q9K9M4 | Bacillus halodurans | |
| 1110 | BH2620 protein [Bacillus halodurans] | UniRef100_Q9K9M5 | Bacillus halodurans | |
| 1111 | BH2618 protein [Bacillus halodurans] | UniRef100_Q9K9M7 | Bacillus halodurans | |
| 1112 | YitI protein [Bacillus subtilis] | UniRef100_O06744 | Bacillus subtilis | YitI |
| 1113 | Glr2355 protein [Gloeobacter violaceus] | UniRef100_Q7N129 | Gloeobacter violaceus | YcdF |
| 1114 | BH0411 protein [Bacillus halodurans] | UniRef100_Q9KFR6 | Bacillus halodurans | YobV |
| 1115 | 5-methyltetrahydrofolate S-homocysteine methyltransferase [Bacillus halodurans] | UniRef100_Q9KCE1 | Bacillus halodurans | YitJ |
| 1116 | YitJ [Bacillus subtilis] | UniRef100_O06745 | Bacillus subtilis | YitJ |
| 1117 | Hypothetical UPF0234 protein yitk [Bacillus subtilis] | UniRef100_O06746 | Bacillus subtilis | YitK |
| 1118 | YitL protein [Bacillus subtilis] | UniRef100_O06747 | Bacillus subtilis | YitL |
| 1119 | | | | |
| 1120 | | | | |
| 1121 | Hypothetical UPF0230 protein yitS [Bacillus subtilis] | UniRef100_P70945 | Bacillus subtilis | YitS |
| 1122 | Hypothetical protein yitT [Bacillus subtilis] | UniRef100_P39803 | Bacillus subtilis | YitT |
| 1123 | Intracellular proteinase inhibitor [Bacillus subtilis] | UniRef100_P39804 | Bacillus subtilis | Ipi |
| 1124 | GMP reductase [Bacillus subtilis] | UniRef100_O05269 | Bacillus subtilis | GuaC |
| 1125 | | | | |
| 1126 | | | | |
| 1127 | Putative orf protein [Bacillus subtilis] | UniRef100_P70947 | Bacillus subtilis | YitU |
| 1128 | Putative orf protein [Bacillus subtilis] | UniRef100_P70948 | Bacillus subtilis | YitV |
| 1129 | | | | YitW |
| 1130 | N-acetyl-gamma-glutamyl-phosphate reductase [Bacillus subtilis] | UniRef100_P23715 | Bacillus subtilis | ArgC |
| 1131 | Arginine biosynthesis bifunctional protein argJ [Includes: Glutamate N-acetyltransferase (EC 2.3.1.35) (Ornithine acetyltransferase) (Ornithine transacetylase) (OATase); Amino-acid acetyltransferase (EC 2.3.1.1) (N-acetylglutamate synthase) (AGS)] [Contai | UniRef100_Q9ZJ14 | Includes: Glutamate N-acetyltransferase (EC 2.3.1.35) (Ornithine acetyltransferase) (Ornithine transacetylase) (OATase); Amino-acid acetyltransferase (EC 2.3.1.1) (N-acetylglutamate synthase) (AGS) | ArgJ |
| 1132 | Acetylglutamate kinase [Bacillus subtilis] | UniRef100_P36840 | Bacillus subtilis | ArgB |
| 1133 | Acetylornithine aminotransferase [Bacillus subtilis] | UniRef100_P36839 | Bacillus subtilis | ArgD |
| 1134 | Carbamoyl-phosphate synthase, arginine-specific, small chain [Bacillus subtilis] | UniRef100_P36838 | Bacillus subtilis | CarA |
| 1135 | Carbamoyl-phosphate synthase, arginine-specific, large chain [Bacillus subtilis] | UniRef100_P18185 | Bacillus subtilis | CarB |

TABLE 1-continued

Predicted functions

| SEQ ID NO. | Description | UniRef Accession No. | Organism | Bacillus subtilis homolog (Gene Name) |
|---|---|---|---|---|
| 1136 | Ornithine carbamoyltransferase [Bacillus subtilis] | UniRef100_P18186 | Bacillus subtilis | ArgF |
| 1137 | Undecaprenyl-diphosphatase 1 [Bacillus cereus] | UniRef100_Q81HV4 | Bacillus cereus | YubB |
| 1138 | YjzC protein [Bacillus subtilis] | UniRef100_O34585 | Bacillus subtilis | |
| 1139 | | | | |
| 1140 | Hypothetical protein yjaU [Bacillus subtilis] | UniRef100_O35001 | Bacillus subtilis | YjaU |
| 1141 | ArgF and med genes, partial and complete cds [Bacillus subtilis] | UniRef100_O32435 | Bacillus subtilis | YjaV |
| 1142 | Transcriptional activator protein med precursor [Bacillus subtilis] | UniRef100_O32436 | Bacillus subtilis | Med |
| 1143 | ComG operon repressor [Bacillus subtilis] | UniRef100_O32437 | Bacillus subtilis | |
| 1144 | Hypothetical protein yjzB [Bacillus subtilis] | UniRef100_O34891 | Bacillus subtilis | |
| 1145 | 3-oxoacyl-[acyl-carrier-protein] synthase III protein 1 [Bacillus subtilis] | UniRef100_O34746 | acyl-carrier-protein | FabHA |
| 1146 | Beta-ketoacyl-acyl carrier protein synthase II [Bacillus subtilis] | UniRef100_O34340 | Bacillus subtilis | FabF |
| 1147 | YjaZ protein [Bacillus subtilis] | UniRef100_O31596 | Bacillus subtilis | YjaZ |
| 1148 | Oligopeptide transport ATP-binding protein appD [Bacillus subtilis] | UniRef100_P42064 | Bacillus subtilis | AppD |
| 1149 | Oligopeptide transport ATP-binding protein appF [Bacillus subtilis] | UniRef100_P42065 | Bacillus subtilis | AppF |
| 1150 | Oligopeptide-binding protein appA precursor [Bacillus subtilis] | UniRef100_P42061 | Bacillus subtilis | AppA |
| 1151 | Oligopeptide transport system permease protein appB [Bacillus subtilis] | UniRef100_P42062 | Bacillus subtilis | AppB |
| 1152 | Oligopeptide transport system permease protein appC [Bacillus subtilis] | UniRef100_P42063 | Bacillus subtilis | AppC |
| 1153 | Permease, putative [Bacillus cereus] | UniRef100_Q734Y3 | Bacillus cereus | YvqJ |
| 1154 | | | | YjbA |
| 1155 | Tryptophanyl-tRNA synthetase [Bacillus subtilis] | UniRef100_P21656 | Bacillus subtilis | TrpS |
| 1156 | Oligopeptide-binding protein oppA precursor [Bacillus subtilis] | UniRef100_P24141 | Bacillus subtilis | OppA |
| 1157 | Oligopeptide transport system permease protein oppB [Bacillus subtilis] | UniRef100_P24138 | Bacillus subtilis | OppB |
| 1158 | Oligopeptide transport system permease protein oppC [Bacillus subtilis] | UniRef100_P24139 | Bacillus subtilis | OppC |
| 1159 | Oligopeptide transport ATP-binding protein oppD [Bacillus subtilis] | UniRef100_P24136 | Bacillus subtilis | OppD |
| 1160 | Oligopeptide transport ATP-binding protein oppF [Bacillus subtilis] | UniRef100_P24137 | Bacillus subtilis | OppF |
| 1161 | YjbC protein [Bacillus subtilis] | UniRef100_O31601 | Bacillus subtilis | YjbC |
| 1162 | Regulatory protein spx [Bacillus subtilis] | UniRef100_O31602 | Bacillus subtilis | YjbD |
| 1163 | YjbE protein [Bacillus subtilis] | UniRef100_O31603 | Bacillus subtilis | YjbE |
| 1164 | Adapter protein mecA 1 [Bacillus subtilis] | UniRef100_P37958 | Bacillus subtilis | MecA |
| 1165 | Hypothetical conserved protein [Oceanobacillus iheyensis] | UniRef100_Q8ELH8 | Oceanobacillus iheyensis | YflP |
| 1166 | Hypothetical protein OB3248 [Oceanobacillus iheyensis] | UniRef100_Q8ELH9 | Oceanobacillus iheyensis | |
| 1167 | Hypothetical conserved protein [Oceanobacillus iheyensis] | UniRef100_Q8ELI0 | Oceanobacillus iheyensis | |
| 1168 | Response regulator of citrate/malate metabolism [Vibrio vulnificus] | UniRef100_Q7ML23 | Vibrio vulnificus | CitT |
| 1169 | Sensor protein citS [Bacillus halodurans] | UniRef100_Q9RC53 | Bacillus halodurans | YufL |
| 1170 | YjbF protein [Bacillus subtilis] | UniRef100_O31604 | Bacillus subtilis | YjbF |
| 1171 | | | | YjbG |
| 1172 | | | | |
| 1173 | YjbH protein [Bacillus subtilis] | UniRef100_O31606 | Bacillus subtilis | YjbH |
| 1174 | YjbI protein [Bacillus subtilis] | UniRef100_O31607 | Bacillus subtilis | YjbI |
| 1175 | YjbJ protein [Bacillus subtilis] | UniRef100_O31608 | Bacillus subtilis | YjbJ |

TABLE 1-continued

Predicted functions

| SEQ ID NO. | Description | UniRef Accession No. | Organism | Bacillus subtilis homolog (Gene Name) |
|---|---|---|---|---|
| 1176 | YjbK protein [Bacillus subtilis] | UniRef100_O31609 | Bacillus subtilis | YjbK |
| 1177 | YjbL protein [Bacillus subtilis] | UniRef100_O31610 | Bacillus subtilis | YjbL |
| 1178 | YjbM protein [Bacillus subtilis] | UniRef100_O31611 | Bacillus subtilis | YjbM |
| 1179 | | | | YjbN |
| 1180 | Hypothetical pseudouridine synthase yjbO [Bacillus subtilis] | UniRef100_O31613 | Bacillus subtilis | YjbO |
| 1181 | YjbP protein [Bacillus subtilis] | UniRef100_O31614 | Bacillus subtilis | YjbP |
| 1182 | YjbQ protein [Bacillus subtilis] | UniRef100_O31615 | Bacillus subtilis | YjbQ |
| 1183 | Transcriptional activator tenA [Bacillus subtilis] | UniRef100_P25052 | Bacillus subtilis | TenA |
| 1184 | Regulatory protein tenI [Bacillus subtilis] | UniRef100_P25053 | Bacillus subtilis | TenI |
| 1185 | Glycine oxidase [Bacillus subtilis] | UniRef100_O31616 | Bacillus subtilis | GoxB |
| 1186 | ThiS protein [Bacillus subtilis] | UniRef100_O31617 | Bacillus subtilis | |
| 1187 | Thiazole biosynthesis protein thiG [Bacillus subtilis] | UniRef100_O31618 | Bacillus subtilis | ThiG |
| 1188 | ThiF protein [Bacillus subtilis] | UniRef100_O31619 | Bacillus subtilis | ThiF |
| 1189 | YjbV protein [Bacillus subtilis] | UniRef100_O31620 | Bacillus subtilis | YjbV |
| 1190 | Enoyl-[acyl-carrier-protein] reductase [NADH] [Bacillus subtilis] | UniRef100_P54616 | acyl-carrier-protein | FabI |
| 1191 | YjbX protein [Bacillus subtilis] | UniRef100_O31622 | Bacillus subtilis | YjbX |
| 1192 | Spore coat protein Z [Bacillus subtilis] | UniRef100_Q08312 | Bacillus subtilis | CotZ |
| 1193 | Spore coat protein Y [Bacillus subtilis] | UniRef100_Q08311 | Bacillus subtilis | CotY |
| 1194 | Spore coat protein X [Bacillus subtilis] | UniRef100_Q08313 | Bacillus subtilis | CotX |
| 1195 | Spore coat protein W [Bacillus subtilis] | UniRef100_Q08310 | Bacillus subtilis | CotW |
| 1196 | Spore coat protein V [Bacillus subtilis] | UniRef100_Q08309 | Bacillus subtilis | CotV |
| 1197 | YjcA protein [Bacillus subtilis] | UniRef100_O31623 | Bacillus subtilis | YjcA |
| 1198 | | | | |
| 1199 | | | | |
| 1200 | YjcC protein [Bacillus subtilis] | UniRef100_O31625 | Bacillus subtilis | |
| 1201 | | | | YjcD |
| 1202 | | | | YngC |
| 1203 | | | | GalE |
| 1204 | YngB protein [Bacillus subtilis] | UniRef100_O31822 | Bacillus subtilis | YngB |
| 1205 | YngA protein [Bacillus amyloliquefaciens] | UniRef100_Q70JY6 | Bacillus amyloliquefaciens | YngA |
| 1206 | YjcF protein [Bacillus subtilis] | UniRef100_O31628 | Bacillus subtilis | YjcF |
| 1207 | YjcG protein [Bacillus subtilis] | UniRef100_O31629 | Bacillus subtilis | YjcG |
| 1208 | YjcH protein [Bacillus subtilis] | UniRef100_O31630 | Bacillus subtilis | YjcH |
| 1209 | Hypothetical protein [Bacillus cereus] | UniRef100_Q739H9 | Bacillus cereus | |
| 1210 | BH1889 protein [Bacillus halodurans] | UniRef100_Q9KBN6 | Bacillus halodurans | YobV |
| 1211 | YjcI protein [Bacillus subtilis] | UniRef100_O31631 | Bacillus subtilis | YjcI |
| 1212 | YjcJ protein [Bacillus subtilis] | UniRef100_O31632 | Bacillus subtilis | YjcJ |
| 1213 | YjcL protein [Bacillus subtilis] | UniRef100_O31634 | Bacillus subtilis | YjcL |
| 1214 | Transcriptional regulator, MarR/EmrR family [Clostridium acetobutylicum] | UniRef100_Q97DR6 | Clostridium acetobutylicum | |
| 1215 | Penicillin-binding protein 4* [Bacillus subtilis] | UniRef100_P32959 | Bacillus subtilis | PbpE |
| 1216 | | | | AbnA |
| 1217 | | | | |
| 1218 | Maltose transacetylase [Bacillus stearothermophilus] | UniRef100_Q75TH6 | Bacillus stearothermophilus | Maa |
| 1219 | | | | |
| 1220 | Putative HTH-type transcriptional regulator ywfK [Bacillus subtilis] | UniRef100_P39647 | Bacillus subtilis | YwfK |
| 1221 | Sulfite reductase [Bacillus halodurans] | UniRef100_Q9KF76 | Bacillus halodurans | YvgR |
| 1222 | Sulfite reductase [Bacillus halodurans] | UniRef100_Q9KF75 | Bacillus halodurans | YvgQ |
| 1223 | Putative HTH-type transcriptional regulator yoaU [Bacillus subtilis] | UniRef100_O34701 | Bacillus subtilis | YoaU |
| 1224 | Hypothetical transport protein yoaV [Bacillus subtilis] | UniRef100_O34416 | Bacillus subtilis | YoaV |
| 1225 | Hypothetical protein VPA0302 [Vibrio parahaemolyticus] | UniRef100_Q87JF1 | Vibrio parahaemolyticus | YyaH |
| 1226 | Hypothetical protein yoeB precursor [Bacillus subtilis] | UniRef100_O34841 | Bacillus subtilis | YoeB |
| 1227 | | | | YocH |
| 1228 | Permease, general substrate transporter [Bacillus thuringiensis] | UniRef100_Q6HMC3 | Bacillus thuringiensis | LmrB |

TABLE 1-continued

Predicted functions

| SEQ ID NO. | Description | UniRef Accession No. | Organism | Bacillus subtilis homolog (Gene Name) |
|---|---|---|---|---|
| 1229 | Putative HTH-type transcriptional regulator yxaF [Bacillus subtilis] | UniRef100_P42105 | Bacillus subtilis | YxaF |
| 1230 | | | | |
| 1231 | | | | YmzD |
| 1232 | | | | YeeF |
| 1233 | | | | YjqB |
| 1234 | Phage-like element PBSX protein xkdA [Bacillus subtilis] | UniRef100_P39780 | Bacillus subtilis | XkdA |
| 1235 | HTH-type transcriptional regulator xre [Bacillus subtilis] | UniRef100_P23789 | Bacillus subtilis | Xre |
| 1236 | | | | |
| 1237 | | | | |
| 1238 | Phage-like element PBSX protein xkdB [Bacillus subtilis] | UniRef100_P39781 | Bacillus subtilis | XkdB |
| 1239 | Phage-like element PBSX protein xkdC [Bacillus subtilis] | UniRef100_P39782 | Bacillus subtilis | XkdC |
| 1240 | Phage-like element PBSX protein xkdD [Bacillus subtilis] | UniRef100_P39783 | Bacillus subtilis | XkdD |
| 1241 | Phage-like element PBSX protein xtrA [Bacillus subtilis] | UniRef100_P54344 | Bacillus subtilis | |
| 1242 | Positive control factor [Bacillus subtilis] | UniRef100_P39784 | Bacillus subtilis | Xpf |
| 1243 | PBSX phage terminase small subunit [Bacillus subtilis] | UniRef100_P39785 | Bacillus subtilis | XtmA |
| 1244 | PBSX phage terminase large subunit [Bacillus subtilis] | UniRef100_P39786 | Bacillus subtilis | XtmB |
| 1245 | Phage-like element PBSX protein xkdE [Bacillus subtilis] | UniRef100_P54325 | Bacillus subtilis | XkdE |
| 1246 | Phage-like element PBSX protein xkdF [Bacillus subtilis] | UniRef100_P54326 | Bacillus subtilis | XkdF |
| 1247 | Phage-like element PBSX protein xkdG [Bacillus subtilis] | UniRef100_P54327 | Bacillus subtilis | XkdG |
| 1248 | Hypothetical protein yqbG [Bacillus subtilis] | UniRef100_P45923 | Bacillus subtilis | YqbG |
| 1249 | Hypothetical protein yqbH [Bacillus subtilis] | UniRef100_P45924 | Bacillus subtilis | YqbH |
| 1250 | Phage-like element PBSX protein xkdI [Bacillus subtilis] | UniRef100_P54329 | Bacillus subtilis | XkdI |
| 1251 | Phage-like element PBSX protein xkdJ [Bacillus subtilis] | UniRef100_P54330 | Bacillus subtilis | XkdJ |
| 1252 | Lin1277 protein [Listeria innocua] | UniRef100_Q92CB2 | Listeria innocua | |
| 1253 | Phage-like element PBSX protein xkdK [Bacillus subtilis] | UniRef100_P54331 | Bacillus subtilis | XkdK |
| 1254 | Phage-like element PBSX protein xkdM [Bacillus subtilis] | UniRef100_P54332 | Bacillus subtilis | XkdM |
| 1255 | Phage-like element PBSX protein xkdN [Bacillus subtilis] | UniRef100_P54333 | Bacillus subtilis | XkdN |
| 1256 | Phage-like element PBSX protein xkdO [Bacillus subtilis] | UniRef100_P54334 | Bacillus subtilis | XkdO |
| 1257 | Phage-like element PBSX protein xkdP [Bacillus subtilis] | UniRef100_P54335 | Bacillus subtilis | YqbP |
| 1258 | Hypothetical protein yqbQ [Bacillus subtilis] | UniRef100_P45950 | Bacillus subtilis | YqbO |
| 1259 | Hypothetical protein yqbR [Bacillus subtilis] | UniRef100_P45933 | Bacillus subtilis | YqbR |
| 1260 | Phage-like element PBSX protein xkdS [Bacillus subtilis] | UniRef100_P54338 | Bacillus subtilis | XkdS |
| 1261 | Hypothetical protein yqbT [Bacillus subtilis] | UniRef100_P45935 | Bacillus subtilis | YqbT |
| 1262 | Phage-like element PBSX protein xkdU [Bacillus subtilis] | UniRef100_P54340 | Bacillus subtilis | XkdU |
| 1263 | | | | |
| 1264 | | | | XkdV |
| 1265 | | | | YomR |
| 1266 | | | | |
| 1267 | | | | |
| 1268 | | | | BlyA |
| 1269 | Regulatory protein [Bacillus stearothermophilus] | UniRef100_Q9ZFL9 | Bacillus stearothermophilus | YdhC |
| 1270 | Zinc-containing alcohol dehydrogenase [Bacillus subtilis] | UniRef100_O35045 | Bacillus subtilis | YjmD |

TABLE 1-continued

Predicted functions

| SEQ ID NO. | Description | UniRef Accession No. | Organism | Bacillus subtilis homolog (Gene Name) |
|---|---|---|---|---|
| 1271 | Mannonate dehydratase 1 [*Bacillus halodurans*] | UniRef100_Q9KDZ8 | *Bacillus halodurans* | UxuA |
| 1272 | D-mannonate oxidoreductase [*Bacillus halodurans*] | UniRef100_Q9KDZ4 | *Bacillus halodurans* | YjmF |
| 1273 | UPI00002F2634 UniRef100 entry | | UniRef100_UPI00002F2634 | YjmD |
| 1274 | Hexuronate transporter [*Bacillus subtilis*] | UniRef100_O34456 | *Bacillus subtilis* | ExuT |
| 1275 | Stage II sporulation protein SB [*Bacillus subtilis*] | UniRef100_O34800 | *Bacillus subtilis* | |
| 1276 | Stage II sporulation protein SA [*Bacillus subtilis*] | UniRef100_O34853 | *Bacillus subtilis* | SpoIISA |
| 1277 | UPI00003CC121 UniRef100 entry | | UniRef100_UPI00003CC121 | Pit |
| 1278 | Hypothetical UPF0111 protein ykaA [*Bacillus subtilis*] | UniRef100_O34454 | *Bacillus subtilis* | YkaA |
| 1279 | | | | Ggt |
| 1280 | YesL protein [*Bacillus subtilis*] | UniRef100_O31515 | *Bacillus subtilis* | YesL |
| 1281 | YesM protein [*Bacillus subtilis*] | UniRef100_O31516 | *Bacillus subtilis* | YesM |
| 1282 | YesN protein [*Bacillus subtilis*] | UniRef100_O31517 | *Bacillus subtilis* | YesN |
| 1283 | YesO protein [*Bacillus subtilis*] | UniRef100_O31518 | *Bacillus subtilis* | YesO |
| 1284 | Probable ABC transporter permease protein yesP [*Bacillus subtilis*] | UniRef100_O31519 | *Bacillus subtilis* | YesP |
| 1285 | Probable ABC transporter permease protein yesQ [*Bacillus subtilis*] | UniRef100_O31520 | *Bacillus subtilis* | YesQ |
| 1286 | YesR protein [*Bacillus subtilis*] | UniRef100_O31521 | *Bacillus subtilis* | YesR |
| 1287 | YesS protein [*Bacillus subtilis*] | UniRef100_O31522 | *Bacillus subtilis* | YesS |
| 1288 | YesT protein [*Bacillus subtilis*] | UniRef100_O31523 | *Bacillus subtilis* | YesT |
| 1289 | | | | YesU |
| 1290 | YesV protein [*Bacillus subtilis*] | UniRef100_O31525 | *Bacillus subtilis* | YesV |
| 1291 | YesW protein [*Bacillus subtilis*] | UniRef100_O31526 | *Bacillus subtilis* | YesW |
| 1292 | | | | |
| 1293 | | | | YesT |
| 1294 | YesX protein [*Bacillus subtilis*] | UniRef100_O31527 | *Bacillus subtilis* | YesX |
| 1295 | Putative ion-channel protein [*Salmonella typhi*] | UniRef100_Q8Z4X6 | *Salmonella typhi* | YccK |
| 1296 | YesY protein [*Bacillus subtilis*] | UniRef100_O31528 | *Bacillus subtilis* | YesY |
| 1297 | YesZ protein [*Bacillus subtilis*] | UniRef100_O31529 | *Bacillus subtilis* | YesZ |
| 1298 | | | | YetA |
| 1299 | Lipoprotein lplA precursor [*Bacillus subtilis*] | UniRef100_P37966 | *Bacillus subtilis* | LplA |
| 1300 | LplB protein [*Bacillus subtilis*] | UniRef100_P39128 | *Bacillus subtilis* | LplB |
| 1301 | LplC protein [*Bacillus subtilis*] | UniRef100_P39129 | *Bacillus subtilis* | LplC |
| 1302 | YkbA protein [*Bacillus subtilis*] | UniRef100_O34739 | *Bacillus subtilis* | YkbA |
| 1303 | YkcA protein [*Bacillus subtilis*] | UniRef100_O34689 | *Bacillus subtilis* | YkcA |
| 1304 | Hypothetical protein [*Bacillus cereus*] | UniRef100_Q81CP9 | *Bacillus cereus* | |
| 1305 | Probable serine protease do-like htrA [*Bacillus subtilis*] | UniRef100_O34358 | *Bacillus subtilis* | HtrA |
| 1306 | Pyrroline-5-carboxylate reductase 3 [*Bacillus subtilis*] | UniRef100_Q00777 | *Bacillus subtilis* | ProG |
| 1307 | D-aminopeptidase [*Bacillus subtilis*] | UniRef100_P26902 | *Bacillus subtilis* | DppA |
| 1308 | Dipeptide transport system permease protein dppB [*Bacillus subtilis*] | UniRef100_P26903 | *Bacillus subtilis* | DppB |
| 1309 | Dipeptide transport system permease protein dppC [*Bacillus subtilis*] | UniRef100_P26904 | *Bacillus subtilis* | DppC |
| 1310 | Dipeptide transport ATP-binding protein dppD [*Bacillus subtilis*] | UniRef100_P26905 | *Bacillus subtilis* | DppD |
| 1311 | Dipeptide-binding protein dppE precursor [*Bacillus subtilis*] | UniRef100_P26906 | *Bacillus subtilis* | DppE |
| 1312 | Hypothetical protein ykfA [*Bacillus subtilis*] | UniRef100_O34851 | *Bacillus subtilis* | YkfA |
| 1313 | YkfB [*Bacillus subtilis*] | UniRef100_O34508 | *Bacillus subtilis* | YkfB |
| 1314 | YkfC [*Bacillus subtilis*] | UniRef100_O35010 | *Bacillus subtilis* | YkfC |
| 1315 | YkfD [*Bacillus subtilis*] | UniRef100_O34480 | *Bacillus subtilis* | YkfD |
| 1316 | BH1779 protein [*Bacillus halodurans*] | UniRef100_Q9KBZ5 | *Bacillus halodurans* | YkgA |
| 1317 | Putative acyl-CoA thioester hydrolase ykhA [*Bacillus subtilis*] | UniRef100_P49851 | *Bacillus subtilis* | YkhA |
| 1318 | | | | YkjA |
| 1319 | Pectate lyase 47 precursor [*Bacillus* sp. TS-47] | UniRef100_Q9AJM4 | *Bacillus* sp. TS-47 | Pel |
| 1320 | Transcriptional regulator, PadR family [*Bacillus thuringiensis*] | UniRef100_Q6HED5 | *Bacillus thuringiensis* | |

TABLE 1-continued

Predicted functions

| SEQ ID NO. | Description | UniRef Accession No. | Organism | Bacillus subtilis homolog (Gene Name) |
|---|---|---|---|---|
| 1321 | Hypothetical protein OB0568 [*Oceanobacillus iheyensis*] | UniRef100_Q8ESQ3 | *Oceanobacillus iheyensis* | |
| 1322 | BH1312 protein [*Bacillus halodurans*] | UniRef100_Q9KDA2 | *Bacillus halodurans* | |
| 1323 | Hypothetical protein ykkA [*Bacillus subtilis*] | UniRef100_P49854 | *Bacillus subtilis* | YkkA |
| 1324 | Hypothetical protein ykkC [*Bacillus subtilis*] | UniRef100_P49856 | *Bacillus subtilis* | YkkC |
| 1325 | | | | |
| 1326 | YkkE [*Bacillus subtilis*] | UniRef100_O34990 | *Bacillus subtilis* | YkkE |
| 1327 | Glutamate 5-kinase 1 [*Bacillus subtilis*] | UniRef100_P39820 | *Bacillus subtilis* | ProB |
| 1328 | Gamma-glutamyl phosphate reductase [*Bacillus subtilis*] | UniRef100_P39821 | *Bacillus subtilis* | ProA |
| 1329 | Organic hydroperoxide resistance protein ohrA [*Bacillus subtilis*] | UniRef100_O34762 | *Bacillus subtilis* | YklA |
| 1330 | Organic hydroperoxide resistance transcriptional regulator [*Bacillus subtilis*] | UniRef100_O34777 | *Bacillus subtilis* | YkmA |
| 1331 | Organic hydroperoxide resistance protein ohrB [*Bacillus subtilis*] | UniRef100_P80242 | *Bacillus subtilis* | YkzA |
| 1332 | | | | |
| 1333 | Guanine deaminase [*Bacillus subtilis*] | UniRef100_O34598 | *Bacillus subtilis* | GuaD |
| 1334 | Phosphoglycerate mutase [*Bacillus stearothermophilus*] | UniRef100_Q9ALU0 | *Bacillus stearothermophilus* | YhfR |
| 1335 | | | | |
| 1336 | | | | |
| 1337 | 5-methyltetrahydropteroyltriglutamate-homocysteine methyltransferase [*Bacillus subtilis*] | UniRef100_P80877 | *Bacillus subtilis* | MetE |
| 1338 | Intracellular serine protease [*Bacillus* sp. WRD-2] | UniRef100_Q69DB4 | *Bacillus* sp. WRD-2 | IspA |
| 1339 | | | | |
| 1340 | YkoK [*Bacillus subtilis*] | UniRef100_O34442 | *Bacillus subtilis* | YkoK |
| 1341 | | | | |
| 1342 | Integrase [*Oceanobacillus iheyensis*] | UniRef100_Q8ETV2 | *Oceanobacillus iheyensis* | YdcL |
| 1343 | | | | YqaB |
| 1344 | Hypothetical protein [*Bacillus anthracis*] | UniRef100_Q81UE0 | *Bacillus anthracis* | |
| 1345 | | | | YonS |
| 1346 | | | | |
| 1347 | Putative HTH-type transcriptional regulator yqaE [*Bacillus subtilis*] | UniRef100_P45902 | *Bacillus subtilis* | YqaE |
| 1348 | Transcriptional regulator [*Fusobacterium nucleatum* subsp. *vincentii* ATCC 49256] | UniRef100_Q7P886 | *Fusobacterium nucleatum* subsp. *vincentii* ATCC 49256 | |
| 1349 | | | | |
| 1350 | | | | |
| 1351 | Lin1236 protein [*Listeria innocua*] | UniRef100_Q92CD6 | *Listeria innocua* | |
| 1352 | | | | |
| 1353 | | | | |
| 1354 | | | | |
| 1355 | | | | YqaJ |
| 1356 | 35 protein [Bacteriophage SPP1] | UniRef100_Q38143 | Bacteriophage SPP1 | YqaK |
| 1357 | | | | YqaL |
| 1358 | | | | YqaM |
| 1359 | Hypothetical protein yqaO [*Bacillus subtilis*] | UniRef100_P45912 | *Bacillus subtilis* | |
| 1360 | Hypothetical protein yopY [Bacteriophage SPBc2] | UniRef100_O64108 | Bacteriophage SPBc2 | |
| 1361 | | | | |
| 1362 | | | | |
| 1363 | | | | |
| 1364 | Hypothetical protein CTC02137 [*Clostridium tetani*] | UniRef100_Q892G2 | *Clostridium tetani* | |
| 1365 | Hypothetical protein MW1918 [*Staphylococcus aureus*] | UniRef100_Q8NVN5 | *Staphylococcus aureus* | YqaN |
| 1366 | | | | |
| 1367 | Single-strand binding protein 2 [*Listeria monocytogenes*] | UniRef100_Q8Y4X1 | *Listeria monocytogenes* | |
| 1368 | | | | |
| 1369 | | | | |

TABLE 1-continued

Predicted functions

| SEQ ID NO. | Description | UniRef Accession No. | Organism | Bacillus subtilis homolog (Gene Name) |
|---|---|---|---|---|
| 1370 | Hypothetical protein yqaQ [Bacillus subtilis] | UniRef100_P45948 | Bacillus subtilis | YqaQ |
| 1371 | | | | |
| 1372 | Hypothetical protein yqaS [Bacillus subtilis] | UniRef100_P45915 | Bacillus subtilis | YqaS |
| 1373 | Hypothetical protein yqaT [Bacillus subtilis] | UniRef100_P45916 | Bacillus subtilis | YqaT |
| 1374 | Hypothetical phage associated protein SpyM3_1326 [Streptococcus pyogenes] | UniRef100_Q8K6I0 | Streptococcus pyogenes | |
| 1375 | Minor head structural component GP7 [Bacteriophage SPP1] | UniRef100_O38442 | Bacteriophage SPP1 | |
| 1376 | | | | |
| 1377 | | | | |
| 1378 | | | | |
| 1379 | Hypothetical protein CTC01553 [Clostridium tetani] | UniRef100_Q894J0 | Clostridium tetani | |
| 1380 | Major capsid protein [Bacteriophage A118] | UniRef100_Q9T1B7 | Bacteriophage A118 | |
| 1381 | ORF28 [Bacteriophage phi-105] | UniRef100_Q9ZXF5 | Bacteriophage phi-105 | |
| 1382 | | | | |
| 1383 | 15 protein [Bacteriophage SPP1] | UniRef100_Q38584 | Bacteriophage SPP1 | |
| 1384 | Complete nucleotide sequence [Bacteriophage SPP1] | UniRef100_O48446 | Bacteriophage SPP1 | |
| 1385 | | | | |
| 1386 | Complete nucleotide sequence [Bacteriophage SPP1] | UniRef100_O48448 | Bacteriophage SPP1 | |
| 1387 | Complete nucleotide sequence [Bacteriophage SPP1] | UniRef100_O48449 | Bacteriophage SPP1 | |
| 1388 | | | | |
| 1389 | Complete nucleotide sequence [Bacteriophage SPP1] | UniRef100_O48453 | Bacteriophage SPP1 | |
| 1390 | | | | |
| 1391 | Complete nucleotide sequence [Bacteriophage SPP1] | UniRef100_O48455 | Bacteriophage SPP1 | XkdO |
| 1392 | Complete nucleotide sequence [Bacteriophage SPP1] | UniRef100_O48459 | Bacteriophage SPP1 | |
| 1393 | Complete nucleotide sequence [Bacteriophage SPP1] | UniRef100_O48463 | Bacteriophage SPP1 | |
| 1394 | | | | |
| 1395 | | | | |
| 1396 | LycA [Clostridium botulinum] | UniRef100_Q6RI00 | Clostridium botulinum | |
| 1397 | Hypothetical protein yrkC [Bacillus subtilis] | UniRef100_P54430 | Bacillus subtilis | YrkC |
| 1398 | | | | YhjR |
| 1399 | YdfS protein [Bacillus subtilis] | UniRef100_P96697 | Bacillus subtilis | YdfS |
| 1400 | HTH-type transcriptional regulator tnrA [Bacillus subtilis] | UniRef100_Q45666 | Bacillus subtilis | TnrA |
| 1401 | Hypothetical protein ykzB [Bacillus subtilis] | UniRef100_O34923 | Bacillus subtilis | |
| 1402 | | | | |
| 1403 | YkoM [Bacillus subtilis] | UniRef100_O34949 | Bacillus subtilis | YkoM |
| 1404 | YkoU protein [Bacillus subtilis] | UniRef100_O34398 | Bacillus subtilis | YkoU |
| 1405 | YkoV protein [Bacillus subtilis] | UniRef100_O34859 | Bacillus subtilis | YkoV |
| 1406 | Signaling protein ykoW [Bacillus subtilis] | UniRef100_O34311 | Bacillus subtilis | YkoW |
| 1407 | YkoX protein [Bacillus subtilis] | UniRef100_O34908 | Bacillus subtilis | YkoX |
| 1408 | YkoY protein [Bacillus subtilis] | UniRef100_O34997 | Bacillus subtilis | YkoY |
| 1409 | RNA polymerase sigma factor [Bacillus subtilis] | UniRef100_O31654 | Bacillus subtilis | SigI |
| 1410 | | | | YkrI |
| 1411 | Small, acid-soluble spore protein C3 [Bacillus megaterium] | UniRef100_P10572 | Bacillus megaterium | |
| 1412 | YkrK protein [Bacillus subtilis] | UniRef100_O31656 | Bacillus subtilis | YkrK |
| 1413 | Probable protease htpX homolog [Bacillus subtilis] | UniRef100_O31657 | Bacillus subtilis | YkrL |
| 1414 | YkrM protein [Bacillus subtilis] | UniRef100_O31658 | Bacillus subtilis | YkrM |
| 1415 | Penicillin-binding protein 3 [Bacillus subtilis] | UniRef100_P42971 | Bacillus subtilis | PbpC |
| 1416 | Hypothetical protein [Bacillus cereus] | UniRef100_Q73BI4 | Bacillus cereus | |
| 1417 | | | | |

TABLE 1-continued

Predicted functions

| SEQ ID NO. | Description | UniRef Accession No. | Organism | Bacillus subtilis homolog (Gene Name) |
|---|---|---|---|---|
| 1418 | YkrP protein [*Bacillus subtilis*] | UniRef100_O31660 | *Bacillus subtilis* | YkrP |
| 1419 | Two-component sensor histidine kinase [*Bacillus subtilis*] | UniRef100_O31661 | *Bacillus subtilis* | KinE |
| 1420 | Methylated-DNA--protein-cysteine methyltransferase [*Bacillus subtilis*] | UniRef100_P11742 | *Bacillus subtilis* | Ogt |
| 1421 | | | | |
| 1422 | Methylthioribose-1-phosphate isomerase [*Bacillus subtilis*] | UniRef100_O31662 | *Bacillus subtilis* | YkrS |
| 1423 | Methylthioribose kinase [*Bacillus subtilis*] | UniRef100_O31663 | *Bacillus subtilis* | YkrT |
| 1424 | YkrU protein [*Bacillus subtilis*] | UniRef100_O31664 | *Bacillus subtilis* | YkrU |
| 1425 | Transaminase mtnE [*Bacillus subtilis*] | UniRef100_O31665 | *Bacillus subtilis* | YkrV |
| 1426 | 2,3-diketo-5-methylthiopentyl-1-phosphate enolase [*Bacillus subtilis*] | UniRef100_O31666 | *Bacillus subtilis* | YkrW |
| 1427 | Methylthioribulose-1-phosphate dehydratase [*Bacillus subtilis*] | UniRef100_O31668 | *Bacillus subtilis* | YkrY |
| 1428 | 1,2-dihydroxy-3-keto-5-methylthiopentene dioxygenase [*Bacillus subtilis*] | UniRef100_O31669 | *Bacillus subtilis* | YkrZ |
| 1429 | Metallothiol transferase fosB [*Oceanobacillus iheyensis*] | UniRef100_Q8CXK5 | *Oceanobacillus iheyensis* | YndN |
| 1430 | YkvA protein [*Bacillus subtilis*] | UniRef100_O31670 | *Bacillus subtilis* | |
| 1431 | Stage 0 sporulation regulatory protein [*Bacillus subtilis*] | UniRef100_P05043 | *Bacillus subtilis* | |
| 1432 | Two-component sensor histidine kinase [*Bacillus subtilis*] | UniRef100_O31671 | *Bacillus subtilis* | KinD |
| 1433 | | | | YkvE |
| 1434 | Chemotaxis motB protein [*Bacillus subtilis*] | UniRef100_P28612 | *Bacillus subtilis* | MotB |
| 1435 | Chemotaxis motA protein [*Bacillus subtilis*] | UniRef100_P28611 | *Bacillus subtilis* | MotA |
| 1436 | ATP-dependent Clp protease-like [*Bacillus subtilis*] | UniRef100_O31673 | *Bacillus subtilis* | ClpE |
| 1437 | YkvI protein [*Bacillus subtilis*] | UniRef100_O31674 | *Bacillus subtilis* | YkvI |
| 1438 | YkvJ protein [*Bacillus subtilis*] | UniRef100_O31675 | *Bacillus subtilis* | YkvJ |
| 1439 | YkvK protein [*Bacillus subtilis*] | UniRef100_O31676 | *Bacillus subtilis* | YkvK |
| 1440 | YkvL protein [*Bacillus subtilis*] | UniRef100_O31677 | *Bacillus subtilis* | YkvL |
| 1441 | YkvM protein [*Bacillus subtilis*] | UniRef100_O31678 | *Bacillus subtilis* | YkvM |
| 1442 | DNA integration/recombination protein [*Clostridium tetani*] | UniRef100_Q894H7 | *Clostridium tetani* | CodV |
| 1443 | Integrase/recombinase [*Bacillus cereus* ZK] | UniRef100_Q633V7 | *Bacillus cereus* ZK | RipX |
| 1444 | | | | |
| 1445 | | | | |
| 1446 | | | | |
| 1447 | YoqV protein [Bacteriophage SPBc2] | UniRef100_O64130 | Bacteriophage SPBc2 | LigB |
| 1448 | | | | |
| 1449 | | | | |
| 1450 | UPI00003CC586 UniRef100 entry | | UniRef100_UPI00003CC586 | |
| 1451 | | | | |
| 1452 | | | | |
| 1453 | | | | |
| 1454 | | | | |
| 1455 | Prophage LambdaBa02, HNH endonuclease family protein [*Bacillus anthracis*] | UniRef100_Q81W86 | *Bacillus anthracis* | |
| 1456 | Terminase small subunit [*Staphylococcus aureus*] | UniRef100_Q6GAL5 | *Staphylococcus aureus* | |
| 1457 | Prophage LambdaBa02, terminase, large subunit, putative [*Bacillus anthracis*] | UniRef100_Q6HUD2 | *Bacillus anthracis* | |
| 1458 | Hypothetical protein [*Bacillus anthracis*] | UniRef100_Q81W89 | *Bacillus anthracis* | |
| 1459 | ClpP family serine protease, possible phage related [*Clostridium acetobutylicum*] | UniRef100_Q97HW4 | *Clostridium acetobutylicum* | ClpP |
| 1460 | Prophage LambdaBa02, major capsid protein, putative [*Bacillus anthracis*] | UniRef100_Q81W91 | *Bacillus anthracis* | |
| 1461 | Precursor polypeptide (AA-37 to 1647) precursor [unidentified bacterium] | UniRef100_O03658 | unidentified bacterium | |
| 1462 | Gp7 protein [Bacteriophage phi3626] | UniRef100_Q8SBP7 | Bacteriophage phi3626 | |

TABLE 1-continued

Predicted functions

| SEQ ID NO. | Description | UniRef Accession No. | Organism | Bacillus subtilis homolog (Gene Name) |
|---|---|---|---|---|
| 1463 | Uncharacterized phage related protein [*Clostridium acetobutylicum*] | UniRef100_Q97HW7 | *Clostridium acetobutylicum* | |
| 1464 | Hypothetical protein CAC1887 [*Clostridium acetobutylicum*] | UniRef100_Q97HW9 | *Clostridium acetobutylicum* | |
| 1465 | Prophage LambdaBa02, major tail protein, putative [*Bacillus anthracis*] | UniRef100_Q81W97 | *Bacillus anthracis* | |
| 1466 | | | | |
| 1467 | | | | |
| 1468 | Prophage LambdaBa02, tape measure protein, putative [*Bacillus anthracis*] | UniRef100_Q81WA0 | *Bacillus anthracis* | YqbO |
| 1469 | Lin2382 protein [*Listeria innocua*] | UniRef100_Q928Z8 | *Listeria innocua* | |
| 1470 | Protein gp18 [*Listeria monocytogenes*] | UniRef100_Q8Y4Z4 | *Listeria monocytogenes* | |
| 1471 | | | | YclG |
| 1472 | | | | XkdV |
| 1473 | | | | XkdW |
| 1474 | YomP protein [Bacteriophage SPBc2] | UniRef100_O64052 | Bacteriophage SPBc2 | |
| 1475 | Glycerophosphoryl diester phosphodiesterase, putative [*Bacillus cereus*] | UniRef100_Q737E6 | *Bacillus cereus* | GlpQ |
| 1476 | Protein bhlA [Bacteriophage SPBc2] | UniRef100_O64039 | Bacteriophage SPBc2 | |
| 1477 | ORF46 [Bacteriophage phi-105] | UniRef100_Q9ZXD7 | Bacteriophage phi-105 | XlyB |
| 1478 | | | | |
| 1479 | | | | |
| 1480 | | | | |
| 1481 | Transcriptional regulator, DeoR family [*Bacillus cereus*] | UniRef100_Q816D5 | *Bacillus cereus* | |
| 1482 | Hypothetical protein yolD [Bacteriophage SPBc2] | UniRef100_O64030 | Bacteriophage SPBc2 | |
| 1483 | DNA integration/recombination/invertion protein [*Bacillus cereus*] | UniRef100_Q81GD4 | *Bacillus cereus* | YdcL |
| 1484 | YkvM protein [*Bacillus subtilis*] | UniRef100_O31678 | *Bacillus subtilis* | |
| 1485 | Response regulator aspartate phosphatase H [*Bacillus subtilis*] | UniRef100_P40771 | *Bacillus subtilis* | RapH |
| 1486 | YoaT [*Bacillus subtilis*] | UniRef100_O34535 | *Bacillus subtilis* | YoaT |
| 1487 | YozG protein [*Bacillus subtilis*] | UniRef100_O31834 | *Bacillus subtilis* | |
| 1488 | YoaS protein [*Bacillus subtilis*] | UniRef100_O31833 | *Bacillus subtilis* | YoaS |
| 1489 | | | | |
| 1490 | | | | |
| 1491 | | | | |
| 1492 | | | | |
| 1493 | | | | |
| 1494 | YkvS protein [*Bacillus subtilis*] | UniRef100_O31684 | *Bacillus subtilis* | |
| 1495 | BH2327 protein [*Bacillus halodurans*] | UniRef100_Q9KAG0 | *Bacillus halodurans* | |
| 1496 | YkvT protein [*Bacillus subtilis*] | UniRef100_O31685 | *Bacillus subtilis* | YkvT |
| 1497 | YkvU protein [*Bacillus subtilis*] | UniRef100_O31686 | *Bacillus subtilis* | YkvU |
| 1498 | YkvV protein [*Bacillus subtilis*] | UniRef100_O31687 | *Bacillus subtilis* | YkvV |
| 1499 | | | | YkvW |
| 1500 | YkvY protein [*Bacillus subtilis*] | UniRef100_O31689 | *Bacillus subtilis* | YkvY |
| 1501 | Necrosis and ethylene inducing protein [*Bacillus halodurans*] | UniRef100_Q9KFT2 | *Bacillus halodurans* | |
| 1502 | Putative HTH-type transcriptional regulator ykvZ [*Bacillus subtilis*] | UniRef100_O31690 | *Bacillus subtilis* | YkvZ |
| 1503 | Transcription antiterminator [*Bacillus subtilis*] | UniRef100_O06710 | *Bacillus subtilis* | GlcT |
| 1504 | | | | PtsG |
| 1505 | Phosphocarrier protein HPr [*Bacillus subtilis*] | UniRef100_P08877 | *Bacillus subtilis* | |
| 1506 | Phosphoenolpyruvate-protein phosphotransferase [*Bacillus subtilis*] | UniRef100_P08838 | *Bacillus subtilis* | PtsI |
| 1507 | SplA [*Bacillus amyloliquefaciens*] | UniRef100_O54358 | *Bacillus amyloliquefaciens* | |
| 1508 | Spore photoproduct lyase [*Bacillus amyloliquefaciens*] | UniRef100_O54359 | *Bacillus amyloliquefaciens* | SplB |
| 1509 | Hypothetical protein orf1 [*Bacillus subtilis*] | UniRef100_O05187 | *Bacillus subtilis* | YkwB |
| 1510 | Methyl-accepting chemotaxis protein mcpC [*Bacillus subtilis*] | UniRef100_P54576 | *Bacillus subtilis* | McpC |
| 1511 | 3-oxoacyl-(Acyl carrier protein) reductase [*Oceanobacillus iheyensis*] | UniRef100_Q8EMP9 | *Oceanobacillus iheyensis* | FabG |

TABLE 1-continued

Predicted functions

| SEQ ID NO. | Description | UniRef Accession No. | Organism | Bacillus subtilis homolog (Gene Name) |
|---|---|---|---|---|
| 1512 | Hypothetical oxidoreductase ykwC [Bacillus subtilis] | UniRef100_O34948 | Bacillus subtilis | YkwC |
| 1513 | YkwD protein [Bacillus subtilis] | UniRef100_O31694 | Bacillus subtilis | YkwD |
| 1514 | YkuA protein [Bacillus subtilis] | UniRef100_O31399 | Bacillus subtilis | YkuA |
| 1515 | Sporulation kinase A [Bacillus subtilis] | UniRef100_P16497 | Bacillus subtilis | KinA |
| 1516 | Putative aminotransferase A [Bacillus subtilis] | UniRef100_P16524 | Bacillus subtilis | PatA |
| 1517 | | | | |
| 1518 | Hypothetical protein yxaI [Bacillus subtilis] | UniRef100_P42108 | Bacillus subtilis | YxaI |
| 1519 | | | | YxiO |
| 1520 | Chemotaxis protein cheV [Bacillus subtilis] | UniRef100_P37599 | Bacillus subtilis | CheV |
| 1521 | Hypothetical protein ykyB [Bacillus subtilis] | UniRef100_P42430 | Bacillus subtilis | YkyB |
| 1522 | | | | YkuC |
| 1523 | YkuD protein [Bacillus subtilis] | UniRef100_O34816 | Bacillus subtilis | YkuD |
| 1524 | | | | YkuE |
| 1525 | Hypothetical oxidoreductase ykuF [Bacillus subtilis] | UniRef100_O34717 | Bacillus subtilis | YkuF |
| 1526 | YkuI protein [Bacillus subtilis] | UniRef100_O35014 | Bacillus subtilis | YkuI |
| 1527 | | | | |
| 1528 | YkuJ protein [Bacillus subtilis] | UniRef100_O34588 | Bacillus subtilis | |
| 1529 | YkuK protein [Bacillus subtilis] | UniRef100_O34776 | Bacillus subtilis | YkuK |
| 1530 | Hypothetical protein ykzF [Bacillus subtilis] | UniRef100_O31697 | Bacillus subtilis | |
| 1531 | YkuL protein [Bacillus subtilis] | UniRef100_O31698 | Bacillus subtilis | YkuL |
| 1532 | Putative HTH-type transcriptional regulator ykuM [Bacillus subtilis] | UniRef100_O34827 | Bacillus subtilis | CcpC |
| 1533 | Probable flavodoxin 1 [Bacillus subtilis] | UniRef100_O34737 | Bacillus subtilis | YkuN |
| 1534 | YkuO protein [Bacillus subtilis] | UniRef100_O34879 | Bacillus subtilis | YkuO |
| 1535 | Probable flavodoxin 2 [Bacillus subtilis] | UniRef100_O34589 | Bacillus subtilis | YkuP |
| 1536 | YkuQ protein [Bacillus subtilis] | UniRef100_O34981 | Bacillus subtilis | YkuQ |
| 1537 | YkuR protein [Bacillus subtilis] | UniRef100_O34916 | Bacillus subtilis | YkuR |
| 1538 | Hypothetical UPF0180 protein ykuS [Bacillus subtilis] | UniRef100_O34783 | Bacillus subtilis | |
| 1539 | YkuU protein [Bacillus subtilis] | UniRef100_O34564 | Bacillus subtilis | YkuU |
| 1540 | YkuV protein [Bacillus subtilis] | UniRef100_O31403 | Bacillus subtilis | YkuV |
| 1541 | Repressor rok [Bacillus subtilis] | UniRef100_O34857 | Bacillus subtilis | Rok |
| 1542 | YknT protein [Bacillus subtilis] | UniRef100_O31700 | Bacillus subtilis | YknT |
| 1543 | | | | MobA |
| 1544 | Molybdopterin biosynthesis protein MoeB [Bacillus subtilis] | UniRef100_O31702 | Bacillus subtilis | MoeB |
| 1545 | Molybdopterin biosynthesis protein MoeA [Bacillus subtilis] | UniRef100_O31703 | Bacillus subtilis | MoeA |
| 1546 | Molybdopterin-guanine dinucleotide biosynthesis protein B [Bacillus subtilis] | UniRef100_O31704 | Bacillus subtilis | MobB |
| 1547 | Molybdopterin converting factor, subunit 2 [Bacillus subtilis] | UniRef100_O31705 | Bacillus subtilis | MoaE |
| 1548 | Molybdopterin converting factor, subunit 1 [Bacillus subtilis] | UniRef100_O31706 | Bacillus subtilis | |
| 1549 | | | | |
| 1550 | YknU protein [Bacillus subtilis] | UniRef100_O31707 | Bacillus subtilis | YknU |
| 1551 | YknV protein [Bacillus subtilis] | UniRef100_O31708 | Bacillus subtilis | YknV |
| 1552 | Hypothetical protein yknW [Bacillus subtilis] | UniRef100_O31709 | Bacillus subtilis | YknW |
| 1553 | YknX protein [Bacillus subtilis] | UniRef100_O31710 | Bacillus subtilis | YknX |
| 1554 | YknY protein [Bacillus subtilis] | UniRef100_O31711 | Bacillus subtilis | YknY |
| 1555 | Hypothetical protein yknZ [Bacillus subtilis] | UniRef100_O31712 | Bacillus subtilis | YknZ |
| 1556 | | | | FruR |
| 1557 | 1-phosphofructokinase [Bacillus subtilis] | UniRef100_O31714 | Bacillus subtilis | FruK |
| 1558 | Phosphotransferase system (PTS) fructose-specific enzyme IIABC component [Bacillus subtilis] | UniRef100_P71012 | Bacillus subtilis | FruA |
| 1559 | Signal peptidase I T [Bacillus subtilis] | UniRef100_P71013 | Bacillus subtilis | SipT |
| 1560 | Hypothetical protein ykoA [Bacillus subtilis] | UniRef100_O31715 | Bacillus subtilis | |
| 1561 | | | | |
| 1562 | YkpA protein [Bacillus subtilis] | UniRef100_O31716 | Bacillus subtilis | YkpA |

TABLE 1-continued

Predicted functions

| SEQ ID NO. | Description | UniRef Accession No. | Organism | Bacillus subtilis homolog (Gene Name) |
|---|---|---|---|---|
| 1563 | BH1921 protein [*Bacillus halodurans*] | UniRef100_Q9KBK5 | *Bacillus halodurans* | |
| 1564 | Aminopeptidase ampS [*Bacillus subtilis*] | UniRef100_P39762 | *Bacillus subtilis* | AmpS |
| 1565 | | | | |
| 1566 | MreBH protein [*Bacillus subtilis*] | UniRef100_P39763 | *Bacillus subtilis* | MreBH |
| 1567 | | | | |
| 1568 | Sporulation kinase C [*Bacillus subtilis*] | UniRef100_P39764 | *Bacillus subtilis* | KinC |
| 1569 | Hypothetical protein ykqB [*Bacillus subtilis*] | UniRef100_P39760 | *Bacillus subtilis* | YkqB |
| 1570 | Adenine deaminase [*Bacillus subtilis*] | UniRef100_P39761 | *Bacillus subtilis* | AdeC |
| 1571 | | | | YkqC |
| 1572 | YkzG protein [*Bacillus subtilis*] | UniRef100_O31718 | *Bacillus subtilis* | |
| 1573 | Hypothetical protein ykrA [*Bacillus subtilis*] | UniRef100_Q45494 | *Bacillus subtilis* | YkrA |
| 1574 | | | | YkrB |
| 1575 | | | | |
| 1576 | Hypothetical protein ykyA [*Bacillus subtilis*] | UniRef100_P21884 | *Bacillus subtilis* | YkyA |
| 1577 | Pyruvate dehydrogenase E1 component, alpha subunit [*Bacillus subtilis*] | UniRef100_P21881 | *Bacillus subtilis* | PdhA |
| 1578 | Pyruvate dehydrogenase E1 component, beta subunit [*Bacillus subtilis*] | UniRef100_P21882 | *Bacillus subtilis* | PdhB |
| 1579 | Dihydrolipoyllysine-residue acetyltransferase component of pyruvate dehydrogenase complex [*Bacillus subtilis*] | UniRef100_P21883 | *Bacillus subtilis* | PdhC |
| 1580 | Dihydrolipoyl dehydrogenase [*Bacillus subtilis*] | UniRef100_P21880 | *Bacillus subtilis* | PdhD |
| 1581 | UPI00003CC069 UniRef100 entry | UniRef100_UPI00003CC069 | | |
| 1582 | IS1627s1-related, transposase [*Bacillus anthracis* str. A2012] | UniRef100_Q7CMD0 | *Bacillus anthracis* str. A2012 | |
| 1583 | | | | |
| 1584 | | | | |
| 1585 | Arginine decarboxylase [*Bacillus subtilis*] | UniRef100_P21885 | *Bacillus subtilis* | SpeA |
| 1586 | Hypothetical UPF0223 protein yktA [*Bacillus subtilis*] | UniRef100_Q45497 | *Bacillus subtilis* | |
| 1587 | Hypothetical protein yktB [*Bacillus subtilis*] | UniRef100_Q45498 | *Bacillus subtilis* | YktB |
| 1588 | YkzI protein [*Bacillus subtilis*] | UniRef100_O31719 | *Bacillus subtilis* | |
| 1589 | Inositol-1-monophosphatase [*Bacillus subtilis*] | UniRef100_Q45499 | *Bacillus subtilis* | YktC |
| 1590 | Hypothetical protein ykzC [*Bacillus subtilis*] | UniRef100_O31720 | *Bacillus subtilis* | YkzC |
| 1591 | Hypothetical protein ylaA [*Bacillus subtilis*] | UniRef100_O07625 | *Bacillus subtilis* | YlaA |
| 1592 | Hypothetical protein ylaB [*Bacillus subtilis*] | UniRef100_O07626 | *Bacillus subtilis* | |
| 1593 | YlaC protein [*Bacillus subtilis*] | UniRef100_O07627 | *Bacillus subtilis* | YlaC |
| 1594 | Hypothetical protein ylaD [*Bacillus subtilis*] | UniRef100_O07628 | *Bacillus subtilis* | |
| 1595 | Hypothetical protein ylaF [*Bacillus subtilis*] | UniRef100_O07630 | *Bacillus subtilis* | |
| 1596 | GTP-binding protein typA/bipA homolog [*Bacillus subtilis*] | UniRef100_O07631 | *Bacillus subtilis* | YlaG |
| 1597 | YlaH protein [*Bacillus subtilis*] | UniRef100_O07632 | *Bacillus subtilis* | YlaH |
| 1598 | YhzA homolog [*Bacillus subtilis*] | UniRef100_O07562 | *Bacillus subtilis* | YhjH |
| 1599 | Hypothetical protein yhjG [*Bacillus subtilis*] | UniRef100_O07561 | *Bacillus subtilis* | YhjG |
| 1600 | | | | |
| 1601 | Hypothetical lipoprotein ylaJ precursor [*Bacillus subtilis*] | UniRef100_O07634 | *Bacillus subtilis* | YlaJ |
| 1602 | YlaK protein [*Bacillus subtilis*] | UniRef100_O07635 | *Bacillus subtilis* | YlaK |
| 1603 | UPI00003CB7B1 UniRef100 entry | UniRef100_UPI00003CB7B1 | | YlaL |
| 1604 | Probable glutaminase ylaM [*Bacillus subtilis*] | UniRef100_O07637 | *Bacillus subtilis* | YlaM |
| 1605 | YlaN protein [*Bacillus subtilis*] | UniRef100_O07638 | *Bacillus subtilis* | |
| 1606 | Hypothetical protein ylaO [*Bacillus subtilis*] | UniRef100_O07639 | *Bacillus subtilis* | FtsW |

TABLE 1-continued

Predicted functions

| SEQ ID NO. | Description | UniRef Accession No. | Organism | Bacillus subtilis homolog (Gene Name) |
|---|---|---|---|---|
| 1607 | | | | PycA |
| 1608 | Cytochrome AA3 controlling protein [*Bacillus subtilis*] | UniRef100_P12946 | *Bacillus subtilis* | CtaA |
| 1609 | Protoheme IX farnesyltransferase [*Bacillus subtilis*] | UniRef100_P24009 | *Bacillus subtilis* | CtaB |
| 1610 | Cytochrome c oxidase polypeptide II precursor (EC 1.9.3.1) (Cytochrome aa3 subunit 2) (Caa-3605 subunit 2) (Oxidase aa(3) subunit 2) [*Bacillus subtilis*] | UniRef100_P24011 | *Bacillus subtilis* | CtaC |
| 1611 | Cytochrome c oxidase polypeptide I (EC 1.9.3.1) (Cytochrome aa3 subunit 1) (Caa-3605 subunit 1) (Oxidase aa(3) subunit 1) [*Bacillus subtilis*] | UniRef100_P24010 | *Bacillus subtilis* | CtaD |
| 1612 | Cytochrome c oxidase polypeptide III (EC 1.9.3.1) (Cytochrome aa3 subunit 3) (Caa-3605 subunit 3) (Oxidase aa(3) subunit 3) [*Bacillus subtilis*] | UniRef100_P24012 | *Bacillus subtilis* | CtaE |
| 1613 | Cytochrome c oxidase polypeptide IVB [*Bacillus subtilis*] | UniRef100_P24013 | *Bacillus subtilis* | CtaF |
| 1614 | CtaG protein [*Bacillus subtilis*] | UniRef100_O34329 | *Bacillus subtilis* | CtaG |
| 1615 | YlbA protein [*Bacillus subtilis*] | UniRef100_O34743 | *Bacillus subtilis* | YlbA |
| 1616 | YlbB protein [*Bacillus subtilis*] | UniRef100_O34682 | *Bacillus subtilis* | YlbB |
| 1617 | YlbC protein [*Bacillus subtilis*] | UniRef100_O34586 | *Bacillus subtilis* | YlbC |
| 1618 | YlbD protein [*Bacillus subtilis*] | UniRef100_O34880 | *Bacillus subtilis* | YlbD |
| 1619 | YlbE protein [*Bacillus subtilis*] | UniRef100_O34958 | *Bacillus subtilis* | |
| 1620 | Regulatory protein ylbF [*Bacillus subtilis*] | UniRef100_O34412 | *Bacillus subtilis* | YlbF |
| 1621 | Hypothetical UPF0298 protein ylbG [*Bacillus subtilis*] | UniRef100_O34658 | *Bacillus subtilis* | |
| 1622 | YlbH protein [*Bacillus subtilis*] | UniRef100_O34331 | *Bacillus subtilis* | YlbH |
| 1623 | Phosphopantetheine adenylyltransferase [*Bacillus subtilis*] | UniRef100_O34797 | *Bacillus subtilis* | YlbI |
| 1624 | | | | YlbJ |
| 1625 | YlbL protein [*Bacillus subtilis*] | UniRef100_O34470 | *Bacillus subtilis* | YlbL |
| 1626 | YlbM protein [*Bacillus subtilis*] | UniRef100_O34513 | *Bacillus subtilis* | YlbM |
| 1627 | YlbN protein [*Bacillus subtilis*] | UniRef100_O34445 | *Bacillus subtilis* | YlbN |
| 1628 | 50S ribosomal protein L32 [*Bacillus subtilis*] | UniRef100_O34687 | *Bacillus subtilis* | |
| 1629 | Hypothetical protein ylbO [*Bacillus subtilis*] | UniRef100_O34549 | *Bacillus subtilis* | YlbO |
| 1630 | YlbP protein [*Bacillus subtilis*] | UniRef100_O34468 | *Bacillus subtilis* | YlbP |
| 1631 | Probable 2-dehydropantoate 2-reductase [*Bacillus subtilis*] | UniRef100_O34661 | *Bacillus subtilis* | YlbQ |
| 1632 | | | | YllA |
| 1633 | Protein mraZ [*Bacillus subtilis*] | UniRef100_P55343 | *Bacillus subtilis* | YllB |
| 1634 | S-adenosyl-methyltransferase mraW [*Bacillus subtilis*] | UniRef100_Q07876 | *Bacillus subtilis* | YlxA |
| 1635 | | | | FtsL |
| 1636 | Penicillin-binding protein 2B [*Bacillus subtilis*] | UniRef100_Q07868 | *Bacillus subtilis* | PbpB |
| 1637 | Stage V sporulation protein D [*Bacillus subtilis*] | UniRef100_Q03524 | *Bacillus subtilis* | SpoVD |
| 1638 | UDP-N-acetylmuramoylalanyl-D-glutamate--2,6-diaminopimelate ligase [*Bacillus subtilis*] | UniRef100_Q03523 | *Bacillus subtilis* | MurE |
| 1639 | Phospho-N-acetylmuramoyl-pentapeptide-transferase [*Bacillus subtilis*] | UniRef100_Q03521 | *Bacillus subtilis* | MraY |
| 1640 | UDP-N-acetylmuramoylalanine--D-glutamate ligase [*Bacillus subtilis*] | UniRef100_Q03522 | *Bacillus subtilis* | MurD |
| 1641 | Stage V sporulation protein E [*Bacillus subtilis*] | UniRef100_P07373 | *Bacillus subtilis* | SpoVE |
| 1642 | UDP-N-acetylglucosamine--N-acetylmuramyl-(pentapeptide) pyrophosphoryl-undecaprenol N-acetylglucosamine transferase [*Bacillus subtilis*] | UniRef100_P37585 | *Bacillus subtilis* | MurG |
| 1643 | UDP-N-acetylenolpyruvoylglucosamine reductase [*Bacillus subtilis*] | UniRef100_P18579 | *Bacillus subtilis* | MurB |
| 1644 | | | | DivIB |

TABLE 1-continued

Predicted functions

| SEQ ID NO. | Description | UniRef Accession No. | Organism | Bacillus subtilis homolog (Gene Name) |
|---|---|---|---|---|
| 1645 | | | | YlxW |
| 1646 | | | | YlxX |
| 1647 | | | | Sbp |
| 1648 | | | | FtsA |
| 1649 | Cell division protein ftsZ [*Bacillus subtilis*] | UniRef100_P17865 | *Bacillus subtilis* | FtsZ |
| 1650 | | | | Bpr |
| 1651 | Bacillopeptidase F precursor [*Bacillus subtilis*] | UniRef100_P16397 | *Bacillus subtilis* | Bpr |
| 1652 | Sporulation sigma-E factor processing peptidase [*Bacillus subtilis*] | UniRef100_P13801 | *Bacillus subtilis* | SpoIIGA |
| 1653 | RNA polymerase sigma-E factor precursor [*Bacillus subtilis*] | UniRef100_P06222 | *Bacillus subtilis* | SigE |
| 1654 | RNA polymerase sigma-G factor [*Bacillus subtilis*] | UniRef100_P19940 | *Bacillus subtilis* | SigG |
| 1655 | YlmA protein [*Bacillus subtilis*] | UniRef100_O31723 | *Bacillus subtilis* | YlmA |
| 1656 | | | | |
| 1657 | YlmC protein [*Bacillus subtilis*] | UniRef100_O31725 | *Bacillus subtilis* | |
| 1658 | Hypothetical UPF0124 protein ylmD [*Bacillus subtilis*] | UniRef100_O31726 | *Bacillus subtilis* | YlmD |
| 1659 | | | | YlmE |
| 1660 | YlmF protein [*Bacillus subtilis*] | UniRef100_O31728 | *Bacillus subtilis* | YlmF |
| 1661 | YlmG protein [*Bacillus subtilis*] | UniRef100_O31729 | *Bacillus subtilis* | |
| 1662 | Minicell-associated protein [*Bacillus subtilis*] | UniRef100_P71020 | *Bacillus subtilis* | YlmH |
| 1663 | Minicell-associated protein DivIVA [*Bacillus subtilis*] | UniRef100_P71021 | *Bacillus subtilis* | DivIVA |
| 1664 | Isoleucyl-tRNA synthetase [*Bacillus subtilis*] | UniRef100_Q45477 | *Bacillus subtilis* | IleS |
| 1665 | | | | YlyA |
| 1666 | | | | LspA |
| 1667 | Hypothetical pseudouridine synthase ylyB [*Bacillus subtilis*] | UniRef100_Q45480 | *Bacillus subtilis* | YlyB |
| 1668 | PyrR bifunctional protein [Includes: Pyrimidine operon regulatory protein; Uracil phosphoribosyltransferase (EC 2.4.2.9) (UPRTase)] [*Bacillus subtilis*] | UniRef100_P39765 | Includes: Pyrimidine operon regulatory protein; Uracil phosphoribosyltransferase (EC 2.4.2.9) (UPRTase) | PyrR |
| 1669 | Uracil permease [*Bacillus subtilis*] | UniRef100_P39766 | *Bacillus subtilis* | PyrP |
| 1670 | Aspartate carbamoyltransferase [*Bacillus subtilis*] | UniRef100_P05654 | *Bacillus subtilis* | PyrB |
| 1671 | Dihydroorotase [*Bacillus subtilis*] | UniRef100_P25995 | *Bacillus subtilis* | PyrC |
| 1672 | Carbamoyl-phosphate synthase, pyrimidine-specific, small chain [*Bacillus subtilis*] | UniRef100_P25993 | *Bacillus subtilis* | PyrAA |
| 1673 | Carbamoyl-phosphate synthase, pyrimidine-specific, large chain [*Bacillus subtilis*] | UniRef100_P25994 | *Bacillus subtilis* | PyrAB |
| 1674 | Dihydroorotate dehydrogenase electron transfer subunit [*Bacillus subtilis*] | UniRef100_P25983 | *Bacillus subtilis* | PyrK |
| 1675 | Dihydroorotate dehydrogenase, catalytic subunit [*Bacillus subtilis*] | UniRef100_P25996 | *Bacillus subtilis* | PyrD |
| 1676 | Orotidine 5'-phosphate decarboxylase [*Bacillus subtilis*] | UniRef100_P25971 | *Bacillus subtilis* | PyrF |
| 1677 | Orotate phosphoribosyltransferase [*Bacillus subtilis*] | UniRef100_P25972 | *Bacillus subtilis* | PyrE |
| 1678 | | | | |
| 1679 | | | | CysH |
| 1680 | YlnA protein [*Bacillus subtilis*] | UniRef100_O34734 | *Bacillus subtilis* | CysP |
| 1681 | Sulfate adenylyltransferase [*Bacillus subtilis*] | UniRef100_O34764 | *Bacillus subtilis* | Sat |
| 1682 | Probable adenylyl-sulfate kinase [*Bacillus subtilis*] | UniRef100_O34577 | *Bacillus subtilis* | CysC |
| 1683 | Putative S-adenosyl L-methionine: uroporphyrinogen III methyltransferase [*Bacillus subtilis*] | UniRef100_O34744 | *Bacillus subtilis* | YlnD |
| 1684 | Sirohydrochlorin ferrochelatase [*Bacillus subtilis*] | UniRef100_O34632 | *Bacillus subtilis* | YlnE |

TABLE 1-continued

Predicted functions

| SEQ ID NO. | Description | UniRef Accession No. | Organism | Bacillus subtilis homolog (Gene Name) |
|---|---|---|---|---|
| 1685 | YlnF protein [Bacillus subtilis] | UniRef100_O34813 | Bacillus subtilis | YlnF |
| 1686 | Putative fibronectin-binding protein [Bacillus subtilis] | UniRef100_O34693 | Bacillus subtilis | YloA |
| 1687 | YloB protein [Bacillus subtilis] | UniRef100_O34431 | Bacillus subtilis | YloB |
| 1688 | YloC protein [Bacillus subtilis] | UniRef100_O34441 | Bacillus subtilis | YloC |
| 1689 | Hypothetical UPF0296 protein ylzA [Bacillus subtilis] | UniRef100_Q7WY72 | Bacillus subtilis | |
| 1690 | Guanylate kinase [Bacillus subtilis] | UniRef100_O34328 | Bacillus subtilis | Gmk |
| 1691 | DNA-directed RNA polymerase omega chain [Bacillus subtilis] | UniRef100_O35011 | Bacillus subtilis | |
| 1692 | YloI protein [Bacillus subtilis] | UniRef100_O35033 | Bacillus subtilis | YloI |
| 1693 | Primosomal protein N' [Bacillus subtilis] | UniRef100_P94461 | Bacillus subtilis | PriA |
| 1694 | Peptide deformylase 1 [Bacillus subtilis] | UniRef100_P94462 | Bacillus subtilis | Def |
| 1695 | Methionyl-tRNA formyltransferase [Bacillus subtilis] | UniRef100_P94463 | Bacillus subtilis | Fmt |
| 1696 | Ribosomal RNA small subunit methyltransferase B (EC 2.1.1.—) (rRNA (cytosine-C(5)-)-methyltransferase) [Bacillus subtilis] | UniRef100_P94464 | Bacillus subtilis | YloM |
| 1697 | Hypothetical UPF0063 protein yloN [Bacillus subtilis] | UniRef100_O34617 | Bacillus subtilis | YloN |
| 1698 | Protein phosphatase [Bacillus subtilis] | UniRef100_O34779 | Bacillus subtilis | PrpC |
| 1699 | Probable serine/threonine-protein kinase yloP [Bacillus subtilis] | UniRef100_O34507 | Bacillus subtilis | PrkC |
| 1700 | Probable GTPase engC [Bacillus subtilis] | UniRef100_O34530 | Bacillus subtilis | YloQ |
| 1701 | Ribulose-phosphate 3-epimerase [Bacillus subtilis] | UniRef100_O34557 | Bacillus subtilis | Rpe |
| 1702 | YloS protein [Bacillus subtilis] | UniRef100_O34664 | Bacillus subtilis | YloS |
| 1703 | | | | |
| 1704 | 50S ribosomal protein L28 [Bacillus subtilis] | UniRef100_P37807 | Bacillus subtilis | |
| 1705 | Hypothetical protein yloU [Bacillus subtilis] | UniRef100_O34318 | Bacillus subtilis | YloU |
| 1706 | | | | YloV |
| 1707 | Probable L-serine dehydratase, beta chain [Bacillus subtilis] | UniRef100_O34635 | Bacillus subtilis | SdaAB |
| 1708 | Probable L-serine dehydratase, alpha chain [Bacillus subtilis] | UniRef100_O34607 | Bacillus subtilis | SdaAA |
| 1709 | ATP-dependent DNA helicase recG [Bacillus subtilis] | UniRef100_O34942 | Bacillus subtilis | RecG |
| 1710 | Transcription factor fapR [Bacillus subtilis] | UniRef100_O34835 | Bacillus subtilis | YlpC |
| 1711 | Fatty acid/phospholipid synthesis protein plsX [Bacillus subtilis] | UniRef100_P71018 | Bacillus subtilis | PlsX |
| 1712 | Malonyl CoA-acyl carrier protein transacylase [Bacillus subtilis] | UniRef100_P71019 | Bacillus subtilis | FabD |
| 1713 | 3-oxoacyl-[acyl-carrier-protein] reductase [Bacillus subtilis] | UniRef100_P51831 | acyl-carrier-protein | FabG |
| 1714 | Acyl carrier protein [Bacillus subtilis] | UniRef100_P80643 | Bacillus subtilis | |
| 1715 | | | | Rnc |
| 1716 | Chromosome partition protein smc [Bacillus subtilis] | UniRef100_P51834 | Bacillus subtilis | Smc |
| 1717 | | | | FtsY |
| 1718 | | | | |
| 1719 | Signal recognition particle protein [Bacillus subtilis] | UniRef100_P37105 | Bacillus subtilis | Ffh |
| 1720 | 30S ribosomal protein S16 [Bacillus subtilis] | UniRef100_P21474 | Bacillus subtilis | |
| 1721 | | | | |
| 1722 | YlqD protein [Bacillus subtilis] | UniRef100_O31739 | Bacillus subtilis | YlqD |
| 1723 | | | | RimM |
| 1724 | | | | TrmD |
| 1725 | 50S ribosomal protein L19 [Bacillus subtilis] | UniRef100_O31742 | Bacillus subtilis | RplS |
| 1726 | YlqF protein [Bacillus subtilis] | UniRef100_O31743 | Bacillus subtilis | YlqF |
| 1727 | Ribonuclease HII [Bacillus subtilis] | UniRef100_O31744 | Bacillus subtilis | RnhB |
| 1728 | YlqG protein [Bacillus subtilis] | UniRef100_O31745 | Bacillus subtilis | YlqG |
| 1729 | YlqH protein [Bacillus subtilis] | UniRef100_O34867 | Bacillus subtilis | |

TABLE 1-continued

Predicted functions

| SEQ ID NO. | Description | UniRef Accession No. | Organism | Bacillus subtilis homolog (Gene Name) |
|---|---|---|---|---|
| 1730 | Succinyl-CoA synthetase beta chain [*Bacillus subtilis*] | UniRef100_P80886 | *Bacillus subtilis* | SucC |
| 1731 | Succinyl-CoA synthetase alpha chain [*Bacillus subtilis*] | UniRef100_P80865 | *Bacillus subtilis* | SucD |
| 1732 | | | | Smf |
| 1733 | | | | TopA |
| 1734 | Protein gid [*Bacillus subtilis*] | UniRef100_P39815 | *Bacillus subtilis* | Gid |
| 1735 | Tyrosine recombinase xerC [*Bacillus subtilis*] | UniRef100_P39776 | *Bacillus subtilis* | CodV |
| 1736 | ATP-dependent protease hslV precursor [*Bacillus subtilis*] | UniRef100_P39070 | *Bacillus subtilis* | ClpQ |
| 1737 | ATP-dependent hsl protease ATP-binding subunit hslU [*Bacillus subtilis*] | UniRef100_P39778 | *Bacillus subtilis* | ClpY |
| 1738 | GTP-sensing transcriptional pleiotropic repressor codY [*Bacillus subtilis*] | UniRef100_P39779 | *Bacillus subtilis* | CodY |
| 1739 | Flagellar basal-body rod protein flgB [*Bacillus subtilis*] | UniRef100_P24500 | *Bacillus subtilis* | FlgB |
| 1740 | Flagellar basal-body rod protein flgC [*Bacillus subtilis*] | UniRef100_P24501 | *Bacillus subtilis* | FlgC |
| 1741 | Flagellar hook-basal body complex protein fliE [*Bacillus subtilis*] | UniRef100_P24502 | *Bacillus subtilis* | FliE |
| 1742 | Flagellar M-ring protein [*Bacillus subtilis*] | UniRef100_P23447 | *Bacillus subtilis* | FliF |
| 1743 | Flagellar motor switch protein fliG [*Bacillus subtilis*] | UniRef100_P23448 | *Bacillus subtilis* | FliG |
| 1744 | Probable flagellar assembly protein fliH [*Bacillus subtilis*] | UniRef100_P23449 | *Bacillus subtilis* | FliH |
| 1745 | Flagellum-specific ATP synthase [*Bacillus subtilis*] | UniRef100_P23445 | *Bacillus subtilis* | FliI |
| 1746 | Flagellar fliJ protein [*Bacillus subtilis*] | UniRef100_P20487 | *Bacillus subtilis* | FliJ |
| 1747 | FlaA locus 22.9 kDa protein [*Bacillus subtilis*] | UniRef100_P23454 | *Bacillus subtilis* | YlxF |
| 1748 | Probable flagellar hook-length control protein [*Bacillus subtilis*] | UniRef100_P23451 | *Bacillus subtilis* | FliK |
| 1749 | FlaA locus hypothetical protein ylxG [*Bacillus subtilis*] | UniRef100_P23455 | *Bacillus subtilis* | YlxG |
| 1750 | | | | FlgE |
| 1751 | BH2448 protein [*Bacillus halodurans*] | UniRef100_Q9KA42 | *Bacillus halodurans* | |
| 1752 | Flagellar fliL protein [*Bacillus subtilis*] | UniRef100_P23452 | *Bacillus subtilis* | FliL |
| 1753 | Flagellar motor switch protein fliM [*Bacillus subtilis*] | UniRef100_P23453 | *Bacillus subtilis* | FliM |
| 1754 | Flagellar motor switch protein fliY [*Bacillus subtilis*] | UniRef100_P24073 | *Bacillus subtilis* | FliY |
| 1755 | Chemotaxis protein cheY homolog [*Bacillus subtilis*] | UniRef100_P24072 | *Bacillus subtilis* | CheY |
| 1756 | Flagellar biosynthetic protein fliZ precursor [*Bacillus subtilis*] | UniRef100_P35536 | *Bacillus subtilis* | FliZ |
| 1757 | Flagellar biosynthetic protein fliP [*Bacillus subtilis*] | UniRef100_P35528 | *Bacillus subtilis* | FliP |
| 1758 | Flagellar biosynthetic protein fliQ [*Bacillus subtilis*] | UniRef100_P35535 | *Bacillus subtilis* | |
| 1759 | Flagellar biosynthetic protein fliR [*Bacillus subtilis*] | UniRef100_P35537 | *Bacillus subtilis* | FliR |
| 1760 | Flagellar biosynthetic protein flhB [*Bacillus subtilis*] | UniRef100_P35538 | *Bacillus subtilis* | FlhB |
| 1761 | Flagellar biosynthesis protein flhA [*Bacillus subtilis*] | UniRef100_P35620 | *Bacillus subtilis* | FlhA |
| 1762 | Flagellar biosynthesis protein flhF [*Bacillus subtilis*] | UniRef100_Q01960 | *Bacillus subtilis* | FlhF |
| 1763 | Hypothetical protein ylxH [*Bacillus subtilis*] | UniRef100_P40742 | *Bacillus subtilis* | YlxH |
| 1764 | Chemotaxis response regulator protein-glutamate methylesterase [*Bacillus subtilis*] | UniRef100_Q05522 | *Bacillus subtilis* | CheB |
| 1765 | Chemotaxis protein cheA [*Bacillus subtilis*] | UniRef100_P29072 | *Bacillus subtilis* | CheA |
| 1766 | Chemotaxis protein cheW [*Bacillus subtilis*] | UniRef100_P39802 | *Bacillus subtilis* | CheW |
| 1767 | Chemotaxis protein cheC [*Bacillus subtilis*] | UniRef100_P40403 | *Bacillus subtilis* | CheC |

TABLE 1-continued

Predicted functions

| SEQ ID NO. | Description | UniRef Accession No. | Organism | Bacillus subtilis homolog (Gene Name) |
|---|---|---|---|---|
| 1768 | Chemotaxis protein cheD [Bacillus subtilis] | UniRef100_P40404 | Bacillus subtilis | CheD |
| 1769 | RNA polymerase sigma-D factor [Bacillus subtilis] | UniRef100_P10726 | Bacillus subtilis | SigD |
| 1770 | Swarming motility protein swrB [Bacillus subtilis] | UniRef100_P40405 | Bacillus subtilis | YlxL |
| 1771 | 30S ribosomal protein S2 [Bacillus subtilis] | UniRef100_P21464 | Bacillus subtilis | RpsB |
| 1772 | Translation elongation factor Ts [Bacillus cereus] | UniRef100_Q65JJ8 | Bacillus cereus | Tsf |
| 1773 | | | | PyrH |
| 1774 | | | | Frr |
| 1775 | Undecaprenyl pyrophosphate synthetase [Bacillus subtilis] | UniRef100_O31751 | Bacillus subtilis | UppS |
| 1776 | Phosphatidate cytidylyltransferase [Bacillus subtilis] | UniRef100_O31752 | Bacillus subtilis | CdsA |
| 1777 | 1-deoxy-D-xylulose 5-phosphate reductoisomerase [Bacillus subtilis] | UniRef100_O31753 | Bacillus subtilis | Dxr |
| 1778 | Hypothetical zinc metalloprotease yluc [Bacillus subtilis] | UniRef100_O31754 | Bacillus subtilis | YluC |
| 1779 | Prolyl-tRNA synthetase [Bacillus subtilis] | UniRef100_O31755 | Bacillus subtilis | ProS |
| 1780 | DNA polymerase III polC-type [Bacillus subtilis] | UniRef100_P13267 | Bacillus subtilis | PolC |
| 1781 | | | | |
| 1782 | Cellulose 1,4-beta-cellobiosidase precursor [Paenibacillus sp. BP-23] | UniRef100_Q8KKF7 | Paenibacillus sp. BP-23 | |
| 1783 | Endoglucanase B precursor [Paenibacillus lautus] | UniRef100_P23550 | Paenibacillus lautus | |
| 1784 | Beta-mannosidase [Thermotoga neapolitana] | UniRef100_Q9RIK7 | Thermotoga neapolitana | |
| 1785 | Hypothetical UPF0090 protein ylxS [Bacillus subtilis] | UniRef100_P32726 | Bacillus subtilis | YlxS |
| 1786 | Transcription elongation protein nusA [Bacillus subtilis] | UniRef100_P32727 | Bacillus subtilis | NusA |
| 1787 | Hypothetical protein ylxR [Bacillus subtilis] | UniRef100_P32728 | Bacillus subtilis | |
| 1788 | Probable ribosomal protein ylxQ [Bacillus subtilis] | UniRef100_P32729 | Bacillus subtilis | |
| 1789 | Translation initiation factor IF-2 [Bacillus subtilis] | UniRef100_P17889 | Bacillus subtilis | InfB |
| 1790 | Hypothetical protein ylxP [Bacillus subtilis] | UniRef100_P32730 | Bacillus subtilis | |
| 1791 | Ribosome-binding factor A [Bacillus subtilis] | UniRef100_P32731 | Bacillus subtilis | RbfA |
| 1792 | | | | TruB |
| 1793 | Riboflavin biosynthesis protein ribC [Includes: Riboflavin kinase (EC 2.7.1.26) (Flavokinase); FMN adenylyltransferase (EC 2.7.7.2) (FAD pyrophosphorylase) (FAD synthetase)] [Bacillus subtilis] | UniRef100_P54575 | Includes: Riboflavin kinase (EC 2.7.1.26) (Flavokinase); FMN adenylyltransferase (EC 2.7.7.2) (FAD pyrophosphorylase) (FAD synthetase) | RibC |
| 1794 | 30S ribosomal protein S15 [Bacillus subtilis] | UniRef100_P21473 | Bacillus subtilis | |
| 1795 | Polyribonucleotide nucleotidyltransferase [Bacillus subtilis] | UniRef100_P50849 | Bacillus subtilis | PnpA |
| 1796 | Hypothetical protein ylxY precursor [Bacillus subtilis] | UniRef100_P50850 | Bacillus subtilis | YlxY |
| 1797 | Hypothetical zinc protease ymxG [Bacillus subtilis] | UniRef100_Q04805 | Bacillus subtilis | MlpA |
| 1798 | Hypothetical protein ymxH [Bacillus subtilis] | UniRef100_Q04811 | Bacillus subtilis | |
| 1799 | Dipicolinate synthase, A chain [Bacillus subtilis] | UniRef100_Q04809 | Bacillus subtilis | SpoVFA |
| 1800 | Dipicolinate synthase, B chain [Bacillus subtilis] | UniRef100_Q04810 | Bacillus subtilis | SpoVFB |

TABLE 1-continued

Predicted functions

| SEQ ID NO. | Description | UniRef Accession No. | Organism | Bacillus subtilis homolog (Gene Name) |
|---|---|---|---|---|
| 1801 | Aspartate-semialdehyde dehydrogenase [*Bacillus subtilis*] | UniRef100_Q04797 | *Bacillus subtilis* | Asd |
| 1802 | Aspartokinase 1 (EC 2.7.2.4) (Aspartokinase I) (Aspartate kinase 1) [Contains: Aspartokinase I alpha subunit; Aspartokinase I beta subunit] [*Bacillus subtilis*] | UniRef100_Q04795 | Contains: Aspartokinase I alpha subunit; Aspartokinase I beta subunit | DapG |
| 1803 | Dihydrodipicolinate synthase [*Bacillus subtilis*] | UniRef100_Q04796 | *Bacillus subtilis* | DapA |
| 1804 | YmfA protein [*Bacillus subtilis*] | UniRef100_O31760 | *Bacillus subtilis* | YmfA |
| 1805 | Translocation-enhancing protein tepA [*Bacillus subtilis*] | UniRef100_Q99171 | *Bacillus subtilis* | TepA |
| 1806 | | | | |
| 1807 | DNA translocase ftsK [*Bacillus subtilis*] | UniRef100_P21458 | *Bacillus subtilis* | SpoIIIE |
| 1808 | Hypothetical transcriptional regulator ymfC [*Bacillus subtilis*] | UniRef100_O31761 | *Bacillus subtilis* | YmfC |
| 1809 | Multidrug resistance protein [*Bacillus halodurans*] | UniRef100_Q9K7Q2 | *Bacillus halodurans* | YitG |
| 1810 | Hypothetical protein [*Bacillus anthracis*] | UniRef100_Q81WP6 | *Bacillus anthracis* | YmfG |
| 1811 | YmfH protein [*Bacillus subtilis*] | UniRef100_O31766 | *Bacillus subtilis* | YmfH |
| 1812 | | | | |
| 1813 | | | | |
| 1814 | YmfJ protein [*Bacillus subtilis*] | UniRef100_O31768 | *Bacillus subtilis* | |
| 1815 | Hypothetical protein [*Bacillus cereus* ZK] | UniRef100_Q636P2 | *Bacillus cereus* ZK | YmfK |
| 1816 | | | | YmfM |
| 1817 | CDP-diacylglycerol--glycerol-3-phosphate 3-phosphatidyltransferase [*Bacillus subtilis*] | UniRef100_P46322 | *Bacillus subtilis* | PgsA |
| 1818 | CinA-like protein [*Bacillus subtilis*] | UniRef100_P46323 | *Bacillus subtilis* | CinA |
| 1819 | RecA protein [*Bacillus amyloliquefaciens*] | UniRef100_Q8GJG2 | *Bacillus amyloliquefaciens* | RecA |
| 1820 | Hypothetical UPF0144 protein ymdA [*Bacillus subtilis*] | UniRef100_O31774 | *Bacillus subtilis* | YmdA |
| 1821 | YmdB protein [*Bacillus subtilis*] | UniRef100_O31775 | *Bacillus subtilis* | YmdB |
| 1822 | Stage V sporulation protein S [*Bacillus subtilis*] | UniRef100_P45693 | *Bacillus subtilis* | |
| 1823 | | | | |
| 1824 | | | | |
| 1825 | L-threonine 3-dehydrogenase [*Bacillus subtilis*] | UniRef100_O31776 | *Bacillus subtilis* | Tdh |
| 1826 | 2-amino-3-ketobutyrate coenzyme A ligase [*Bacillus subtilis*] | UniRef100_O31777 | *Bacillus subtilis* | Kbl |
| 1827 | Hypothetical UPF0004 protein ymcB [*Bacillus subtilis*] | UniRef100_O31778 | *Bacillus subtilis* | YmcB |
| 1828 | YmcA protein [*Bacillus subtilis*] | UniRef100_O31779 | *Bacillus subtilis* | YmcA |
| 1829 | Spore coat protein E [*Bacillus subtilis*] | UniRef100_P14016 | *Bacillus subtilis* | CotE |
| 1830 | | | | MutS |
| 1831 | DNA mismatch repair protein mutL [*Bacillus subtilis*] | UniRef100_P49850 | *Bacillus subtilis* | MutL |
| 1832 | YjcS protein [*Bacillus subtilis*] | UniRef100_O31641 | *Bacillus subtilis* | |
| 1833 | | | | YxiD |
| 1834 | | | | |
| 1835 | | | | |
| 1836 | All1751 protein [*Anabaena* sp.] | UniRef100_Q8YW65 | *Anabaena* sp. | YciC |
| 1837 | BH0367 protein [*Bacillus halodurans*] | UniRef100_Q9KFV4 | *Bacillus halodurans* | |
| 1838 | Phosphinothricin N-acetyltransferase [*Bacillus halodurans*] | UniRef100_Q9KFP5 | *Bacillus halodurans* | YwnH |
| 1839 | UPI00003CC0D8 UniRef100 entry | | UniRef100_UPI00003CC0D8 | |
| 1840 | | | | |
| 1841 | Putative L-amino acid oxidase [*Bacillus subtilis*] | UniRef100_O34363 | *Bacillus subtilis* | YobN |
| 1842 | | | | YoaK |
| 1843 | Na+/H+ antiporter [*Bacillus halodurans*] | UniRef100_Q9K5Q0 | *Bacillus halodurans* | YvgP |
| 1844 | Aromatic hydrocarbon catabolism protein [*Oceanobacillus iheyensis*] | UniRef100_Q8CV32 | *Oceanobacillus iheyensis* | |
| 1845 | Hypothetical UPF0145 protein VP1283 [*Vibrio parahaemolyticus*] | UniRef100_Q87Q67 | *Vibrio parahaemolyticus* | |

TABLE 1-continued

Predicted functions

| SEQ ID NO. | Description | UniRef Accession No. | Organism | Bacillus subtilis homolog (Gene Name) |
|---|---|---|---|---|
| 1846 | Hypothetical protein yqeD [Bacillus subtilis] | UniRef100_P54449 | Bacillus subtilis | YqeD |
| 1847 | Penicillin-binding protein, putative [Bacillus cereus] | UniRef100_Q738U9 | Bacillus cereus | PbpE |
| 1848 | Hypothetical glycosyl transferase [Bacillus subtilis] | UniRef100_O34539 | Bacillus subtilis | YjiC |
| 1849 | Asparate-proton symporter [Bacillus subtilis] | UniRef100_O07002 | Bacillus subtilis | YveA |
| 1850 | Spore coat protein [Bacillus halodurans] | UniRef100_Q9KEV6 | Bacillus halodurans | |
| 1851 | | | | |
| 1852 | | | | YdhD |
| 1853 | Putative HTH-type transcriptional regulator yezE [Bacillus subtilis] | UniRef100_Q7WY76 | Bacillus subtilis | YezE |
| 1854 | Hypothetical protein yesE [Bacillus subtilis] | UniRef100_O31511 | Bacillus subtilis | YesE |
| 1855 | YesF protein [Bacillus subtilis] | UniRef100_O31512 | Bacillus subtilis | YesF |
| 1856 | UPI00003CBA3B UniRef100 entry | | UniRef100_UPI00003CBA3B | |
| 1857 | YmaD protein [Bacillus subtilis] | UniRef100_O31790 | Bacillus subtilis | YmaD |
| 1858 | Multidrug resistance protein ebrB [Bacillus subtilis] | UniRef100_O31791 | Bacillus subtilis | EbrB |
| 1859 | Multidrug resistance protein ebrA [Bacillus subtilis] | UniRef100_O31792 | Bacillus subtilis | EbrA |
| 1860 | | | | |
| 1861 | Hypothetical protein ymaF [Bacillus subtilis] | UniRef100_O31794 | Bacillus subtilis | YmaF |
| 1862 | tRNA delta(2)-isopentenylpyrophosphate transferase [Bacillus subtilis] | UniRef100_O31795 | Bacillus subtilis | MiaA |
| 1863 | Hfq protein [Bacillus subtilis] | UniRef100_O31796 | Bacillus subtilis | |
| 1864 | Hypothetical protein ymzA [Bacillus subtilis] | UniRef100_O31798 | Bacillus subtilis | |
| 1865 | NrdI protein [Bacillus subtilis] | UniRef100_P50618 | Bacillus subtilis | YmaA |
| 1866 | Ribonucleoside-diphosphate reductase alpha chain [Bacillus subtilis] | UniRef100_P50620 | Bacillus subtilis | NrdE |
| 1867 | Ribonucleoside-diphosphate reductase beta chain [Bacillus subtilis] | UniRef100_P50621 | Bacillus subtilis | NrdF |
| 1868 | Hypothetical protein ymaB [Bacillus subtilis] | UniRef100_P50619 | Bacillus subtilis | YmaB |
| 1869 | Blr6966 protein [Bradyrhizobium japonicum] | UniRef100_Q89EV4 | Bradyrhizobium japonicum | YtnP |
| 1870 | Nitrogen fixation protein [Bacillus halodurans] | UniRef100_Q9KFV2 | Bacillus halodurans | YurV |
| 1871 | Transcription regulator Fur family-like protein [Staphylococcus epidermidis] | UniRef100_Q8CNQ7 | Staphylococcus epidermidis | PerR |
| 1872 | UPI00003CB681 UniRef100 entry | | UniRef100_UPI00003CB681 | YdhC |
| 1873 | Hypothetical protein [Bacillus cereus] | UniRef100_Q81C60 | Bacillus cereus | YjlA |
| 1874 | | | | CwlC |
| 1875 | Membrane protein, putative [Listeria monocytogenes] | UniRef100_Q720L9 | Listeria monocytogenes | |
| 1876 | Lin1174 protein [Listeria innocua] | UniRef100_Q92CJ7 | Listeria innocua | |
| 1877 | | | | |
| 1878 | | | | |
| 1879 | Transcriptional regulator [Aquifex aeolicus] | UniRef100_O66635 | Aquifex aeolicus | YdgC |
| 1880 | Hypothetical membrane-anchored protein [Rhizobium meliloti] | UniRef100_Q92VA1 | Rhizobium meliloti | |
| 1881 | Cytosine permease [Bacillus halodurans] | UniRef100_Q9KBP3 | Bacillus halodurans | YxlA |
| 1882 | AgaF [Agrobacterium tumefaciens] | UniRef100_O50265 | Agrobacterium tumefaciens | |
| 1883 | | | | |
| 1884 | Hydantoin utilization protein B [Pseudomonas putida] | UniRef100_Q88H51 | Pseudomonas putida | |
| 1885 | Hypothetical protein SMb20139 [Rhizobium meliloti] | UniRef100_Q92X23 | Rhizobium meliloti | |
| 1886 | BH2340 protein [Bacillus halodurans] | UniRef100_Q9KAE7 | Bacillus halodurans | |
| 1887 | | | | |
| 1888 | | | | |
| 1889 | Stage V sporulation protein K [Bacillus subtilis] | UniRef100_P27643 | Bacillus subtilis | SpoVK |
| 1890 | YnbA [Bacillus subtilis] | UniRef100_P94478 | Bacillus subtilis | YnbA |

TABLE 1-continued

Predicted functions

| SEQ ID NO. | Description | UniRef Accession No. | Organism | Bacillus subtilis homolog (Gene Name) |
|---|---|---|---|---|
| 1891 | YnbB [*Bacillus subtilis*] | UniRef100_P94479 | *Bacillus subtilis* | YnbB |
| 1892 | HTH-type transcriptional regulator glnR [*Bacillus subtilis*] | UniRef100_P37582 | *Bacillus subtilis* | GlnR |
| 1893 | Glutamine synthetase [*Bacillus subtilis*] | UniRef100_P12425 | *Bacillus subtilis* | GlnA |
| 1894 | | | | |
| 1895 | Hypothetical protein CAC3435 [*Clostridium acetobutylicum*] | UniRef100_Q97DN7 | *Clostridium acetobutylicum* | |
| 1896 | | | | |
| 1897 | | | | |
| 1898 | Hypothetical protein CAC0350 [*Clostridium acetobutylicum*] | UniRef100_Q97M50 | *Clostridium acetobutylicum* | |
| 1899 | Hypothetical HIT-like protein MJ0866 [*Methanococcus jannaschii*] | UniRef100_Q58276 | *Methanococcus jannaschii* | Hit |
| 1900 | Hypothetical protein [*Bacillus anthracis*] | UniRef100_Q6I2B3 | *Bacillus anthracis* | |
| 1901 | Hypothetical protein [*Bacillus cereus*] | UniRef100_Q81CM1 | *Bacillus cereus* | YdjC |
| 1902 | | | | |
| 1903 | Methyltransferase [*Bacillus cereus*] | UniRef100_Q81CJ2 | *Bacillus cereus* | |
| 1904 | | | | YoaO |
| 1905 | Acetyltransferase, GNAT family [*Bacillus cereus*] | UniRef100_Q737B4 | *Bacillus cereus* | |
| 1906 | Repressor rok [*Bacillus subtilis*] | UniRef100_O34857 | *Bacillus subtilis* | Rok |
| 1907 | | | | |
| 1908 | Hypothetical protein [Bacteriophage T5] | UniRef100_Q6QGK2 | Bacteriophage T5 | |
| 1909 | Hypothetical protein yvdT [*Bacillus subtilis*] | UniRef100_O07001 | *Bacillus subtilis* | YvdT |
| 1910 | Hypothetical protein yvdS [*Bacillus subtilis*] | UniRef100_O32262 | *Bacillus subtilis* | YvdS |
| 1911 | Hypothetical protein yvdR [*Bacillus subtilis*] | UniRef100_O06999 | *Bacillus subtilis* | YvdR |
| 1912 | Spermidine N1-acetyltransferase [*Bacillus cereus*] | UniRef100_Q72Y03 | *Bacillus cereus* | YoaA |
| 1913 | Hypothetical Membrane Associated Protein [*Bacillus cereus*] | UniRef100_Q812L6 | *Bacillus cereus* | |
| 1914 | Hypothetical protein yoaW precursor [*Bacillus subtilis*] | UniRef100_O34541 | *Bacillus subtilis* | YoaW |
| 1915 | Thiol-disulfide oxidoreductase resA [*Bacillus halodurans*] | UniRef100_Q9KCJ4 | *Bacillus halodurans* | ResA |
| 1916 | Manganese-containing catalase [*Bacillus halodurans*] | UniRef100_Q9KAU6 | *Bacillus halodurans* | YdbD |
| 1917 | BH1562 protein [*Bacillus halodurans*] | UniRef100_Q9KCK9 | *Bacillus halodurans* | |
| 1918 | Acetyltransferase, GNAT family [*Bacillus cereus*] | UniRef100_Q739K0 | *Bacillus cereus* | YjcK |
| 1919 | Hypothetical conserved protein [*Oceanobacillus iheyensis*] | UniRef100_Q8ELR7 | *Oceanobacillus iheyensis* | |
| 1920 | | | | |
| 1921 | Transcriptional regulator, MarR family [*Bacillus cereus*] | UniRef100_Q81BM5 | *Bacillus cereus* | YkvE |
| 1922 | Putative NAD(P)H nitroreductase ydfN [*Bacillus subtilis*] | UniRef100_P96692 | *Bacillus subtilis* | YdfN |
| 1923 | YdfO protein [*Bacillus subtilis*] | UniRef100_P96693 | *Bacillus subtilis* | YdfO |
| 1924 | Hypothetical protein [*Bacillus cereus* ZK] | UniRef100_Q630S7 | *Bacillus cereus* ZK | YwrF |
| 1925 | BH1010 protein [*Bacillus halodurans*] | UniRef100_Q9KE48 | *Bacillus halodurans* | YhcB |
| 1926 | ORF28 [*Staphylococcus* phage K] | UniRef100_Q6Y7T8 | *Staphylococcus* phage K | |
| 1927 | | | | |
| 1928 | Thymidylate synthase [Bacteriophage phi-3T] | UniRef100_P07606 | Bacteriophage phi-3T | ThyA |
| 1929 | Sporulation-specific extracellular nuclease precursor [*Bacillus subtilis*] | UniRef100_P42983 | *Bacillus subtilis* | NucB |
| 1930 | LexA repressor [*Bacillus subtilis*] | UniRef100_P31080 | *Bacillus subtilis* | LexA |
| 1931 | YneA [*Bacillus subtilis*] | UniRef100_Q45056 | *Bacillus subtilis* | YneA |
| 1932 | YneB [*Bacillus subtilis*] | UniRef100_Q45057 | *Bacillus subtilis* | YneB |
| 1933 | Hypothetical UPF0291 protein ynzC [*Bacillus subtilis*] | UniRef100_O31818 | *Bacillus subtilis* | |
| 1934 | Transketolase [*Bacillus subtilis*] | UniRef100_P45694 | *Bacillus subtilis* | Tkt |
| 1935 | Hypothetical protein yneE [*Bacillus subtilis*] | UniRef100_P45707 | *Bacillus subtilis* | YneE |
| 1936 | Hypothetical UPF0154 protein yneF [*Bacillus subtilis*] | UniRef100_P45708 | *Bacillus subtilis* | |

TABLE 1-continued

Predicted functions

| SEQ ID NO. | Description | UniRef Accession No. | Organism | Bacillus subtilis homolog (Gene Name) |
|---|---|---|---|---|
| 1937 | | | | |
| 1938 | Cytochrome c-type biogenesis protein ccdA [Bacillus subtilis] | UniRef100_P45706 | Bacillus subtilis | CcdA |
| 1939 | CcdB protein [Bacillus subtilis] | UniRef100_P45709 | Bacillus subtilis | YneI |
| 1940 | CcdC protein [Bacillus subtilis] | UniRef100_P45710 | Bacillus subtilis | YneJ |
| 1941 | Hypothetical protein yneK [Bacillus subtilis] | UniRef100_P45711 | Bacillus subtilis | YneK |
| 1942 | Spore coat protein M [Bacillus subtilis] | UniRef100_Q45058 | Bacillus subtilis | CotM |
| 1943 | | | | |
| 1944 | | | | |
| 1945 | | | | CitB |
| 1946 | YneN protein [Bacillus subtilis] | UniRef100_O31820 | Bacillus subtilis | YneN |
| 1947 | | | | |
| 1948 | | | | |
| 1949 | Small, acid-soluble spore protein tlp [Bacillus subtilis] | UniRef100_Q45060 | Bacillus subtilis | |
| 1950 | YneP [Bacillus subtilis] | UniRef100_Q45061 | Bacillus subtilis | YneP |
| 1951 | YneQ [Bacillus subtilis] | UniRef100_Q45062 | Bacillus subtilis | |
| 1952 | Hypothetical protein [Bacillus cereus] | UniRef100_Q815P1 | Bacillus cereus | |
| 1953 | Conserved domain protein [Bacillus cereus] | UniRef100_Q72YR7 | Bacillus cereus | |
| 1954 | YneR [Bacillus subtilis] | UniRef100_Q45063 | Bacillus subtilis | |
| 1955 | Hypothetical UPF0078 protein yneS [Bacillus subtilis] | UniRef100_Q45064 | Bacillus subtilis | YneS |
| 1956 | YneT [Bacillus subtilis] | UniRef100_Q45065 | Bacillus subtilis | YneT |
| 1957 | Topoisomerase IV subunit B [Bacillus subtilis] | UniRef100_Q59192 | Bacillus subtilis | ParE |
| 1958 | Topoisomerase IV subunit A [Bacillus subtilis] | UniRef100_Q45066 | Bacillus subtilis | ParC |
| 1959 | | | | AraR |
| 1960 | Hypothetical conserved protein [Oceanobacillus iheyensis] | UniRef100_Q8EMP2 | Oceanobacillus iheyensis | XylB |
| 1961 | L-ribulose-5-phosphate 4-epimerase [Oceanobacillus iheyensis] | UniRef100_Q8EMP3 | Oceanobacillus iheyensis | AraD |
| 1962 | L-arabinose isomerase [Oceanobacillus iheyensis] | UniRef100_Q8EMP4 | Oceanobacillus iheyensis | AraA |
| 1963 | | | | YwtG |
| 1964 | | | | FabG |
| 1965 | Hypothetical protein ynfC [Bacillus subtilis] | UniRef100_Q45067 | Bacillus subtilis | YnfC |
| 1966 | Amino acid carrier protein alsT [Bacillus subtilis] | UniRef100_Q45068 | Bacillus subtilis | AlsT |
| 1967 | | | | NarI |
| 1968 | | | | NarJ |
| 1969 | | | | NarH |
| 1970 | | | | NarG |
| 1971 | | | | |
| 1972 | Hypothetical protein yqfB [Lactococcus lactis] | UniRef100_Q9CF70 | Lactococcus lactis | |
| 1973 | | | | AlbA |
| 1974 | | | | ArfM |
| 1975 | | | | YwiC |
| 1976 | Transcriptional regulator of anaerobic genes [Bacillus halodurans] | UniRef100_Q9KG81 | Bacillus halodurans | Fnr |
| 1977 | Nitrite extrusion protein [Bacillus subtilis] | UniRef100_P46907 | Bacillus subtilis | NarK |
| 1978 | | | | |
| 1979 | CAMP-binding domains-Catabolite gene activator and regulatory subunit of cAMP-dependent protein kinases [Thermoanaerobacter tengcongensis] | UniRef100_Q8R5P4 | Thermoanaerobacter tengcongensis | Fnr |
| 1980 | Putative nitric oxide reductase [Staphylococcus aureus] | UniRef100_Q6GK48 | Staphylococcus aureus | |
| 1981 | | | | |
| 1982 | | | | YngL |
| 1983 | | | | BglC |
| 1984 | Hypothetical protein ynfE [Bacillus subtilis] | UniRef100_Q45069 | Bacillus subtilis | |
| 1985 | Hypothetical protein [Bacillus megaterium] | UniRef100_Q9ZF48 | Bacillus megaterium | YkkB |

TABLE 1-continued

Predicted functions

| SEQ ID NO. | Description | UniRef Accession No. | Organism | Bacillus subtilis homolog (Gene Name) |
|---|---|---|---|---|
| 1986 | Hypothetical protein [Bacillus amyloliquefaciens] | UniRef100_Q70K06 | Bacillus amyloliquefaciens | |
| 1987 | Alkyl hydroperoxide reductase large subunit [Bacillus halodurans] | UniRef100_Q9Z9W3 | Bacillus halodurans | AhpF |
| 1988 | Methyltransferase [Methanosarcina mazei] | UniRef100_Q8PU82 | Methanosarcina mazei | |
| 1989 | Similar to B. subtilis ywgB gene [Bacillus halodurans] | UniRef100_Q9Z9W2 | Bacillus halodurans | YwgB |
| 1990 | Hypothetical protein ywoF [Bacillus subtilis] | UniRef100_P94576 | Bacillus subtilis | YwoF |
| 1991 | Branched-chain amino acid transport system carrier protein brnQ [Bacillus subtilis] | UniRef100_P94499 | Bacillus subtilis | BrnQ |
| 1992 | NADP-dependent alcohol dehydrogenase [Bacillus subtilis] | UniRef100_O06007 | Bacillus subtilis | AdhA |
| 1993 | Transcriptional regulator, MerR family [Listeria monocytogenes] | UniRef100_Q721Z3 | Listeria monocytogenes | YraB |
| 1994 | HPr-like protein crh [Bacillus subtilis] | UniRef100_O06976 | Bacillus subtilis | |
| 1995 | BH2089 protein [Bacillus halodurans] | UniRef100_Q9Z9R4 | Bacillus halodurans | YddR |
| 1996 | | | | |
| 1997 | Enoyl-CoA hydratase/isomerase family protein [Bacillus cereus] | UniRef100_Q738L0 | Bacillus cereus | YngF |
| 1998 | Hypothetical protein ysiB [Bacillus subtilis] | UniRef100_P94549 | Bacillus subtilis | YsiB |
| 1999 | Methylmalonic acid semialdehyde dehydrogenase [Bacillus cereus ZK] | UniRef100_Q63BL0 | Bacillus cereus ZK | MmsA |
| 2000 | 3-hydroxyisobutyrate dehydrogenase [Bacillus cereus ZK] | UniRef100_Q63BL1 | Bacillus cereus ZK | YkwC |
| 2001 | Acyl-CoA dehydrogenase [Bacillus cereus] | UniRef100_Q81DR7 | Bacillus cereus | YusJ |
| 2002 | Mannose-6-phosphate isomerase [Bacillus subtilis] | UniRef100_O31646 | Bacillus subtilis | ManA |
| 2003 | Phosphotransferase system (PTS) mannose-specific enzyme IIBCA component [Bacillus subtilis] | UniRef100_O31645 | Bacillus subtilis | ManP |
| 2004 | | | | |
| 2005 | | | | |
| 2006 | Hypothetical protein [Bacillus cereus] | UniRef100_Q72YT6 | Bacillus cereus | |
| 2007 | Transcriptional regulator [Bacillus subtilis] | UniRef100_O31644 | Bacillus subtilis | ManR |
| 2008 | | | | |
| 2009 | UPI00003CC220 UniRef100 entry | UniRef100_UPI00003CC220 | | YtrB |
| 2010 | Transcriptional regulator [Bacillus halodurans] | UniRef100_Q9KF35 | Bacillus halodurans | YtrA |
| 2011 | Probable oxidoreductase [Clostridium perfringens] | UniRef100_Q8XP17 | Clostridium perfringens | YjmF |
| 2012 | Mannonate dehydratase [Clostridium perfringens] | UniRef100_Q8XP15 | Clostridium perfringens | UxuA |
| 2013 | Glucosidase [Bacillus halodurans] | UniRef100_Q9KEZ5 | Bacillus halodurans | |
| 2014 | C4-dicarboxylate transport system [Bacillus halodurans] | UniRef100_Q9KEZ6 | Bacillus halodurans | |
| 2015 | C4-dicarboxylate transport system permease small protein [Oceanobacillus iheyensis] | UniRef100_Q8EMM5 | Oceanobacillus iheyensis | |
| 2016 | C4-dicarboxylate transport system [Bacillus halodurans] | UniRef100_Q9KEZ8 | Bacillus halodurans | DctB |
| 2017 | Transcriptional regulator [Oceanobacillus iheyensis] | UniRef100_Q8EL22 | Oceanobacillus iheyensis | CcpA |
| 2018 | Arsenate reductase [Bacillus subtilis] | UniRef100_P45947 | Bacillus subtilis | ArsC |
| 2019 | YdfA protein [Bacillus subtilis] | UniRef100_P96678 | Bacillus subtilis | YdfA |
| 2020 | YdeT protein [Bacillus subtilis] | UniRef100_P96677 | Bacillus subtilis | YdeT |
| 2021 | YdeI [Bacillus halodurans] | UniRef100_Q9Z9R5 | Bacillus halodurans | YdeI |
| 2022 | Putative secreted protein [Streptomyces coelicolor] | UniRef100_Q9S1Z5 | Streptomyces coelicolor | |
| 2023 | Probable glucose uptake protein glcU [Bacillus megaterium] | UniRef100_P40419 | Bacillus megaterium | GlcU |
| 2024 | YngK protein [Bacillus subtilis] | UniRef100_O35015 | Bacillus subtilis | YngK |
| 2025 | YngD protein [Bacillus subtilis] | UniRef100_O31824 | Bacillus subtilis | YngD |

TABLE 1-continued

Predicted functions

| SEQ ID NO. | Description | UniRef Accession No. | Organism | Bacillus subtilis homolog (Gene Name) |
|---|---|---|---|---|
| 2026 | Pyruvate formate-lyase-activating enzyme [*Bacillus cereus*] | UniRef100_Q73DZ6 | *Bacillus cereus* | YkvL |
| 2027 | Formate acetyltransferase [*Bacillus anthracis*] | UniRef100_Q81YX1 | *Bacillus anthracis* | |
| 2028 | | | | DacC |
| 2029 | NADH dehydrogenase-like protein yjlD [*Bacillus subtilis*] | UniRef100_P80861 | *Bacillus subtilis* | YjlD |
| 2030 | Hypothetical protein yjlC [*Bacillus subtilis*] | UniRef100_O34633 | *Bacillus subtilis* | YjlC |
| 2031 | | | | |
| 2032 | Hypothetical protein [*Bacillus cereus*] | UniRef100_Q81IJ8 | *Bacillus cereus* | |
| 2033 | Hypothetical protein ykzH [*Bacillus subtilis*] | UniRef100_O31653 | *Bacillus subtilis* | |
| 2034 | Acetyl-CoA synthetase [*Bacillus halodurans*] | UniRef100_Q9KDS4 | *Bacillus halodurans* | AcsA |
| 2035 | YngE protein [*Bacillus subtilis*] | UniRef100_O31825 | *Bacillus subtilis* | YngE |
| 2036 | Hydroxybutyryl-dehydratase [*Bacillus subtilis*] | UniRef100_Q9L7W1 | *Bacillus subtilis* | YngF |
| 2037 | YngG protein [*Bacillus subtilis*] | UniRef100_O34873 | *Bacillus subtilis* | YngG |
| 2038 | YngXX [*Bacillus subtilis*] | UniRef100_Q9R9I3 | *Bacillus subtilis* | |
| 2039 | YngH [*Bacillus subtilis*] | UniRef100_Q9R9I4 | *Bacillus subtilis* | YngH |
| 2040 | YngI [*Bacillus subtilis*] | UniRef100_Q9R9I5 | *Bacillus subtilis* | YngI |
| 2041 | YngJ protein [*Bacillus subtilis*] | UniRef100_O34421 | *Bacillus subtilis* | YngJ |
| 2042 | NAD(P)H oxidoreductase YRKL [*Fusobacterium nucleatum* subsp. *vincentii* ATCC 49256] | UniRef100_Q7P6P0 | *Fusobacterium nucleatum* subsp. *vincentii* ATCC 49256 | YrkL |
| 2043 | Transcriptional regulator, MarR family [*Fusobacterium nucleatum*] | UniRef100_Q8RE85 | *Fusobacterium nucleatum* | |
| 2044 | Glutamate-5-semialdehyde dehydrogenase [*Bacillus thuringiensis*] | UniRef100_Q6HHC2 | *Bacillus thuringiensis* | ProA |
| 2045 | Glutamate 5-kinase 2 [*Bacillus subtilis*] | UniRef100_O07509 | *Bacillus subtilis* | ProJ |
| 2046 | Pyrroline-5-carboxylate reductase 1 [*Bacillus subtilis*] | UniRef100_P14383 | *Bacillus subtilis* | ProH |
| 2047 | UPI00003CB6CD UniRef100 entry | UniRef100_UPI00003CB6CD | | YetF |
| 2048 | Sodium-dependent phosphate transporter [*Bacillus halodurans*] | UniRef100_Q9KCT1 | *Bacillus halodurans* | CysP |
| 2049 | Probable phosphoadenosine phosphosulfate reductase [*Bacillus subtilis*] | UniRef100_O06737 | *Bacillus subtilis* | YitB |
| 2050 | Phosphosulfolactate synthase (EC 4.4.1.19) ((2R)-phospho-3-sulfolactate synthase) [*Bacillus subtilis*] | UniRef100_O06739 | *Bacillus subtilis* | YitD |
| 2051 | YitE [*Bacillus subtilis*] | UniRef100_O06740 | *Bacillus subtilis* | YitE |
| 2052 | YitF [*Bacillus subtilis*] | UniRef100_O06741 | *Bacillus subtilis* | YitF |
| 2053 | YitG [*Bacillus subtilis*] | UniRef100_O06742 | *Bacillus subtilis* | YitG |
| 2054 | Putative glycosyl transferase ykoT [*Bacillus subtilis*] | UniRef100_O34755 | *Bacillus subtilis* | YkoT |
| 2055 | YkoR [*Bacillus subtilis*] | UniRef100_O34830 | *Bacillus subtilis* | YkoS |
| 2056 | Glutamate synthase [NADPH] small chain [*Bacillus subtilis*] | UniRef100_O34399 | NADPH | GltB |
| 2057 | | | | GltA |
| 2058 | HTH-type transcriptional regulator gltC [*Bacillus subtilis*] | UniRef100_P20668 | *Bacillus subtilis* | GltC |
| 2059 | All7121 protein [*Anabaena* sp.] | UniRef100_Q8YL17 | *Anabaena* sp. | |
| 2060 | | | | |
| 2061 | Lmo0606 protein [*Listeria monocytogenes*] | UniRef100_Q8Y9C6 | *Listeria monocytogenes* | |
| 2062 | ABC transporter ATP-binding protein [*Symbiobacterium thermophilum*] | UniRef100_Q67MU2 | *Symbiobacterium thermophilum* | YfiB |
| 2063 | ABC transporter ATP-binding protein [*Symbiobacterium thermophilum*] | UniRef100_Q67MU3 | *Symbiobacterium thermophilum* | YfiC |
| 2064 | Cytochrome P450 109 [*Bacillus subtilis*] | UniRef100_P27632 | *Bacillus subtilis* | YjiB |
| 2065 | Hypothetical oxidoreductase yoxD [*Bacillus subtilis*] | UniRef100_P14802 | *Bacillus subtilis* | YoxD |
| 2066 | | | | Pps |
| 2067 | Permease, general substrate transporter [*Bacillus thuringiensis*] | UniRef100_Q6HMC3 | *Bacillus thuringiensis* | LmrB |
| 2068 | Putative formate dehydrogenase [*Bacillus subtilis*] | UniRef100_O34323 | *Bacillus subtilis* | YoaE |

TABLE 1-continued

Predicted functions

| SEQ ID NO. | Description | UniRef Accession No. | Organism | Bacillus subtilis homolog (Gene Name) |
|---|---|---|---|---|
| 2069 | Transcriptional regulatory protein [*Bradyrhizobium japonicum*] | UniRef100_Q89KD1 | *Bradyrhizobium japonicum* | YcgE |
| 2070 | Drug resistance transporter, EmrB/QacA family [*Bacillus cereus*] | UniRef100_Q73615 | *Bacillus cereus* | Mdr |
| 2071 | YndE protein [*Bacillus subtilis*] | UniRef100_O31809 | *Bacillus subtilis* | YndE |
| 2072 | YndF protein [*Bacillus subtilis*] | UniRef100_O31810 | *Bacillus subtilis* | YndF |
| 2073 | | | | YndE |
| 2074 | | | | YndE |
| 2075 | UPI00003CB22E UniRef100 entry | | UniRef100_UPI00003CB22E | YndD |
| 2076 | | | | |
| 2077 | Nucleotide binding protein expZ [*Bacillus subtilis*] | UniRef100_P39115 | *Bacillus subtilis* | ExpZ |
| 2078 | | | | TlpB |
| 2079 | CsaA protein [*Bacillus subtilis*] | UniRef100_P37584 | *Bacillus subtilis* | CsaA |
| 2080 | Alkaline serine protease [*Bacillus subtilis*] | UniRef100_O31788 | *Bacillus subtilis* | AprX |
| 2081 | Hypothetical protein [*Bacillus anthracis*] | UniRef100_Q81SD4 | *Bacillus anthracis* | YnzE |
| 2082 | Transcriptional regulator, TetR family [*Bacillus cereus* ZK] | UniRef100_Q63D70 | *Bacillus cereus* ZK | YrhI |
| 2083 | Putative HTH-type transcriptional regulator yvmB [*Bacillus subtilis*] | UniRef100_P40762 | *Bacillus subtilis* | YvmB |
| 2084 | Hydrolase [*Bacillus cereus*] | UniRef100_Q81D79 | *Bacillus cereus* | YqeK |
| 2085 | Hypothetical conserved protein [*Oceanobacillus iheyensis*] | UniRef100_Q8ETG3 | *Oceanobacillus iheyensis* | |
| 2086 | YndJ protein [*Bacillus subtilis*] | UniRef100_O31813 | *Bacillus subtilis* | YndJ |
| 2087 | YndH protein [*Bacillus subtilis*] | UniRef100_O31812 | *Bacillus subtilis* | YndH |
| 2088 | Hypothetical protein [*Bacillus cereus*] | UniRef100_Q73A97 | *Bacillus cereus* | YndG |
| 2089 | UPI00003CBA97 UniRef100 entry | | UniRef100_UPI00003CBA97 | YobS |
| 2090 | UPI00003CBA98 UniRef100 entry | | UniRef100_UPI00003CBA98 | YobT |
| 2091 | DNA-binding protein YobU [*Bacillus subtilis*] | UniRef100_O34637 | *Bacillus subtilis* | YobU |
| 2092 | Hypothetical protein [*Bacteroides fragilis*] | UniRef100_Q64RP1 | *Bacteroides fragilis* | |
| 2093 | Transcription regulator [*Bacillus subtilis*] | UniRef100_O34920 | *Bacillus subtilis* | YobV |
| 2094 | | | | YobW |
| 2095 | YozA protein [*Bacillus subtilis*] | UniRef100_O31844 | *Bacillus subtilis* | |
| 2096 | Possible metallo-beta-lactamase family protein [*Bacillus cereus* ZK] | UniRef100_Q638G1 | *Bacillus cereus* ZK | YmaE |
| 2097 | | | | |
| 2098 | | | | YfnA |
| 2099 | | | | YocA |
| 2100 | UPI00003CBE6E UniRef100 entry | | UniRef100_UPI00003CBE6E | YveM |
| 2101 | Hypothetical protein [*Bacillus cereus*] | UniRef100_Q817C2 | *Bacillus cereus* | |
| 2102 | | | | |
| 2103 | Glycosyl transferase [*Bacillus halodurans*] | UniRef100_Q9K7I1 | *Bacillus halodurans* | YtcC |
| 2104 | YozB protein [*Bacillus subtilis*] | UniRef100_O31845 | *Bacillus subtilis* | YozB |
| 2105 | Lmo2079 protein [*Listeria monocytogenes*] | UniRef100_Q8Y5I3 | *Listeria monocytogenes* | |
| 2106 | YocC [*Bacillus subtilis*] | UniRef100_O35042 | *Bacillus subtilis* | YocC |
| 2107 | Na+/myo-inositol cotransporter [*Bacillus halodurans*] | UniRef100_Q9KAR5 | *Bacillus halodurans* | YcgO |
| 2108 | YocH [*Bacillus subtilis*] | UniRef100_O34669 | *Bacillus subtilis* | YocH |
| 2109 | RecQ homolog [*Bacillus subtilis*] | UniRef100_O34748 | *Bacillus subtilis* | YocI |
| 2110 | Hypothetical protein yqbC [*Bacillus subtilis*] | UniRef100_P45919 | *Bacillus subtilis* | YqbC |
| 2111 | Hypothetical protein yjfB [*Bacillus subtilis*] | UniRef100_O34438 | *Bacillus subtilis* | |
| 2112 | Hypothetical protein yyaQ [*Bacillus subtilis*] | UniRef100_P37507 | *Bacillus subtilis* | YyaQ |
| 2113 | Hypothetical protein OB2103 [*Oceanobacillus iheyensis*] | UniRef100_Q8EPJ8 | *Oceanobacillus iheyensis* | |
| 2114 | | | | |
| 2115 | Hypothetical protein yjgD [*Bacillus subtilis*] | UniRef100_O34681 | *Bacillus subtilis* | YjgD |
| 2116 | | | | YjgC |
| 2117 | | | | YjgC |
| 2118 | Hypothetical protein OB3361 [*Oceanobacillus iheyensis*] | UniRef100_Q8EL70 | *Oceanobacillus iheyensis* | |

TABLE 1-continued

Predicted functions

| SEQ ID NO. | Description | UniRef Accession No. | Organism | Bacillus subtilis homolog (Gene Name) |
|---|---|---|---|---|
| 2119 | Hypothetical protein ypfA [*Bacillus subtilis*] | UniRef100_P38491 | *Bacillus subtilis* | YpfA |
| 2120 | | | | |
| 2121 | | | | |
| 2122 | | | | YxiB |
| 2123 | | | | |
| 2124 | | | | |
| 2125 | | | | |
| 2126 | | | | YndF |
| 2127 | | | | |
| 2128 | Hypothetical protein [*Bacillus cereus*] | UniRef100_Q816C2 | *Bacillus cereus* | |
| 2129 | BH0185 protein [*Bacillus halodurans*] | UniRef100_Q9KGB9 | *Bacillus halodurans* | |
| 2130 | | | | |
| 2131 | | | | YisY |
| 2132 | Hypothetical protein yoqH [*Bacteriophage SPBc2*] | UniRef100_O64117 | Bacteriophage SPBc2 | YoqH |
| 2133 | | | | |
| 2134 | BH0429 protein [*Bacillus halodurans*] | UniRef100_Q9KFP9 | *Bacillus halodurans* | YrhP |
| 2135 | 30S ribosomal protein S14 [*Oceanobacillus iheyensis*] | UniRef100_Q8ETX0 | *Oceanobacillus iheyensis* | |
| 2136 | UPI00002DEBB5 UniRef100 entry | | UniRef100_UPI00002DEBB5 | MutT |
| 2137 | Pyruvate water dikinase [*Methanosarcina acetivorans*] | UniRef100_Q8TN35 | *Methanosarcina acetivorans* | Pps |
| 2138 | Transcriptional regulator [*Oceanobacillus iheyensis*] | UniRef100_Q8ESJ8 | *Oceanobacillus iheyensis* | YxbF |
| 2139 | | | | |
| 2140 | YndM protein [*Bacillus subtilis*] | UniRef100_O31816 | *Bacillus subtilis* | YndM |
| 2141 | Hypothetical protein yisT [*Bacillus subtilis*] | UniRef100_O07939 | *Bacillus subtilis* | YisT |
| 2142 | Putative acyl carrier protein phosphodiesterase 1 [*Bacillus subtilis*] | UniRef100_O35022 | *Bacillus subtilis* | YocJ |
| 2143 | General stress protein 16O [*Bacillus subtilis*] | UniRef100_P80872 | *Bacillus subtilis* | YocK |
| 2144 | | | | |
| 2145 | | | | |
| 2146 | Aldehyde dehydrogenase [*Bacillus subtilis*] | UniRef100_O34660 | *Bacillus subtilis* | DhaS |
| 2147 | YjbB protein [*Bacillus subtilis*] | UniRef100_O31600 | *Bacillus subtilis* | YjbB |
| 2148 | Aminoglycoside N6'-acetyltransferase [*Bacillus cereus*] | UniRef100_Q81AT3 | *Bacillus cereus* | YjcK |
| 2149 | Blasticidin S deaminase, putative [*Bacillus anthracis*] | UniRef100_Q81Y61 | *Bacillus anthracis* | |
| 2150 | | | | SqhC |
| 2151 | Probable superoxide dismutase [Fe] [*Bacillus subtilis*] | UniRef100_O35023 | Fe | SodF |
| 2152 | Stress response protein yvgO precursor [*Bacillus subtilis*] | UniRef100_O32211 | *Bacillus subtilis* | YvgO |
| 2153 | Putative transporter [*Bacillus subtilis*] | UniRef100_O34383 | *Bacillus subtilis* | YocR |
| 2154 | Putative transporter [*Bacillus subtilis*] | UniRef100_O34524 | *Bacillus subtilis* | YocS |
| 2155 | Dihydrolipoyllysine-residue succinyltransferase component of 2-oxoglutarate dehydrogenase complex [*Bacillus subtilis*] | UniRef100_P16263 | *Bacillus subtilis* | OdhB |
| 2156 | 2-oxoglutarate dehydrogenase E1 component [*Bacillus subtilis*] | UniRef100_P23129 | *Bacillus subtilis* | OdhA |
| 2157 | YojO protein [*Bacillus subtilis*] | UniRef100_O31849 | *Bacillus subtilis* | YojO |
| 2158 | YojN protein [*Bacillus subtilis*] | UniRef100_O31850 | *Bacillus subtilis* | YojN |
| 2159 | Hypothetical superoxide dismutase-like protein yojM precursor [*Bacillus subtilis*] | UniRef100_O31851 | *Bacillus subtilis* | YojM |
| 2160 | Hypothetical protein yojL precursor [*Bacillus subtilis*] | UniRef100_O31852 | *Bacillus subtilis* | LytF |
| 2161 | Probable multidrug resistance protein norM (Na(+)/drug antiporter) [*Bacillus subtilis*] | UniRef100_O31855 | *Bacillus subtilis* | YojI |
| 2162 | Hypothetical protein [*Bacillus cereus* ZK] | UniRef100_Q637Z8 | *Bacillus cereus* ZK | YojG |
| 2163 | YojF protein [*Bacillus subtilis*] | UniRef100_O31858 | *Bacillus subtilis* | YojF |
| 2164 | YojE [*Bacillus subtilis*] | UniRef100_O68260 | *Bacillus subtilis* | |
| 2165 | YojE protein [*Bacillus subtilis*] | UniRef100_O31859 | *Bacillus subtilis* | YojE |

TABLE 1-continued

Predicted functions

| SEQ ID NO. | Description | UniRef Accession No. | Organism | Bacillus subtilis homolog (Gene Name) |
|---|---|---|---|---|
| 2166 | Hypothetical protein yozR [*Bacillus subtilis*] | UniRef100_Q7WY67 | *Bacillus subtilis* | YozR |
| 2167 | YoaJ [*Bacillus subtilis*] | UniRef100_O34918 | *Bacillus subtilis* | YoaJ |
| 2168 | | | | |
| 2169 | UPI00003CBE9B UniRef100 entry | | UniRef100_UPI00003CBE9B | YwfD |
| 2170 | Hypothetical UPF0087 protein yodB [*Bacillus subtilis*] | UniRef100_O34844 | *Bacillus subtilis* | YodB |
| 2171 | Putative NAD(P)H nitroreductase 12C [*Bacillus subtilis*] | UniRef100_P81102 | *Bacillus subtilis* | YodC |
| 2172 | YolF [*Bacillus subtilis*] | UniRef100_O34842 | *Bacillus subtilis* | YodD |
| 2173 | UPI0000315ACC UniRef100 entry | | UniRef100_UPI0000315ACC | |
| 2174 | YodF protein [*Bacillus subtilis*] | UniRef100_O34745 | *Bacillus subtilis* | YodF |
| 2175 | IS1627s1-related, transposase [*Bacillus anthracis* str. A2012] | UniRef100_Q7CMD0 | *Bacillus anthracis* str. A2012 | |
| 2176 | UPI00003CC069 UniRef100 entry | | UniRef100_UPI00003CC069 | |
| 2177 | OrfRM1 [*Bacillus subtilis*] | UniRef100_O34666 | *Bacillus subtilis* | CtpA |
| 2178 | YolB [*Bacillus subtilis*] | UniRef100_O34954 | *Bacillus subtilis* | YodH |
| 2179 | | | | |
| 2180 | Carboxypeptidase [*Bacillus subtilis*] | UniRef100_O34866 | *Bacillus subtilis* | YodJ |
| 2181 | Purine nucleoside phosphorylase II [*Bacillus subtilis*] | UniRef100_O34925 | *Bacillus subtilis* | DeoD |
| 2182 | Hypothetical Membrane Spanning Protein [*Bacillus cereus*] | UniRef100_Q813P0 | *Bacillus cereus* | YcgR |
| 2183 | YcgQ protein [*Bacillus subtilis*] | UniRef100_P94394 | *Bacillus subtilis* | YcgQ |
| 2184 | | | | |
| 2185 | Hypothetical protein yodL [*Bacillus subtilis*] | UniRef100_O30472 | *Bacillus subtilis* | YodL |
| 2186 | | | | YodM |
| 2187 | Hypothetical protein yozD [*Bacillus subtilis*] | UniRef100_O31863 | *Bacillus subtilis* | |
| 2188 | Hypothetical protein yodN [*Bacillus subtilis*] | UniRef100_O34414 | *Bacillus subtilis* | YodN |
| 2189 | | | | |
| 2190 | YokU [*Bacillus subtilis*] | UniRef100_O30470 | *Bacillus subtilis* | |
| 2191 | Hypothetical UPF0069 protein yodO [*Bacillus subtilis*] | UniRef100_O34676 | *Bacillus subtilis* | KamA |
| 2192 | YodP [*Bacillus subtilis*] | UniRef100_O34895 | *Bacillus subtilis* | YodP |
| 2193 | Acetylornitine deacetylase [*Bacillus subtilis*] | UniRef100_O34984 | *Bacillus subtilis* | YodQ |
| 2194 | Butirate-acetoacetate CoA transferase [*Bacillus subtilis*] | UniRef100_O34466 | *Bacillus subtilis* | YodR |
| 2195 | Butyrate acetoacetate-CoA transferase [*Bacillus subtilis*] | UniRef100_O34317 | *Bacillus subtilis* | YodS |
| 2196 | Probable aminotransferase yodT [*Bacillus subtilis*] | UniRef100_O34662 | *Bacillus subtilis* | YodT |
| 2197 | Multidrug resistance protein; possible tetracycline resistance determinant [*Bacillus thuringiensis*] | UniRef100_Q6HK46 | *Bacillus thuringiensis* | YkuC |
| 2198 | Protein cgeE [*Bacillus subtilis*] | UniRef100_P42093 | *Bacillus subtilis* | CgeE |
| 2199 | Peptide methionine sulfoxide reductase msrB [*Bacillus subtilis*] | UniRef100_P54155 | *Bacillus subtilis* | YppQ |
| 2200 | | | | MsrA |
| 2201 | Putative HTH-type transcriptional regulator ypoP [*Bacillus subtilis*] | UniRef100_P54182 | *Bacillus subtilis* | YpoP |
| 2202 | | | | |
| 2203 | Hypothetical protein yhcK [*Bacillus subtilis*] | UniRef100_P54595 | *Bacillus subtilis* | YhcK |
| 2204 | Hypothetical protein ypnP [*Bacillus subtilis*] | UniRef100_P54181 | *Bacillus subtilis* | YpnP |
| 2205 | Hypothetical conserved protein [*Thermus thermophilus*] | UniRef100_Q746K9 | *Thermus thermophilus* | |
| 2206 | | | | |
| 2207 | Hypothetical protein ypmS [*Bacillus subtilis*] | UniRef100_P54179 | *Bacillus subtilis* | YpmS |
| 2208 | Hypothetical protein ypmR [*Bacillus subtilis*] | UniRef100_P40766 | *Bacillus subtilis* | YpmR |
| 2209 | Hypothetical protein ypmQ [*Bacillus subtilis*] | UniRef100_P54178 | *Bacillus subtilis* | YpmQ |
| 2210 | DegV family protein [*Bacillus cereus* ZK] | UniRef100_Q63BU6 | *Bacillus cereus* ZK | YviA |

TABLE 1-continued

Predicted functions

| SEQ ID NO. | Description | UniRef Accession No. | Organism | Bacillus subtilis homolog (Gene Name) |
|---|---|---|---|---|
| 2211 | Hypothetical protein ypmP [Bacillus subtilis] | UniRef100_P54177 | Bacillus subtilis | |
| 2212 | Threonine dehydratase biosynthetic [Bacillus subtilis] | UniRef100_P37946 | Bacillus subtilis | IlvA |
| 2213 | Putative sigma L-dependent transcriptional regulator yplP [Bacillus subtilis] | UniRef100_P54156 | Bacillus subtilis | YplP |
| 2214 | Hemolysin III homolog [Bacillus subtilis] | UniRef100_P54175 | Bacillus subtilis | YplQ |
| 2215 | Hypothetical protein ypkP [Bacillus subtilis] | UniRef100_P54174 | Bacillus subtilis | YpkP |
| 2216 | Dihydrofolate reductase [Bacillus subtilis] | UniRef100_P11045 | Bacillus subtilis | DfrA |
| 2217 | Hypothetical protein ypjQ [Bacillus subtilis] | UniRef100_P54173 | Bacillus subtilis | YpjQ |
| 2218 | | | | YpjP |
| 2219 | | | | YpiP |
| 2220 | Hypothetical protein yphP [Bacillus subtilis] | UniRef100_P54170 | Bacillus subtilis | YphP |
| 2221 | Dihydroxy-acid dehydratase [Bacillus subtilis] | UniRef100_P51785 | Bacillus subtilis | IlvD |
| 2222 | | | | YpgR |
| 2223 | Hypothetical protein ypgQ [Bacillus subtilis] | UniRef100_P54168 | Bacillus subtilis | YpgQ |
| 2224 | Glutathione peroxidase homolog bsaA [Bacillus subtilis] | UniRef100_P52035 | Bacillus subtilis | BsaA |
| 2225 | UPI00003CBA0F UniRef100 entry | | UniRef100_UPI00003CBA0F | |
| 2226 | Homoserine O-succinyltransferase [Bacillus subtilis] | UniRef100_P54167 | Bacillus subtilis | MetA |
| 2227 | Putative glycosyl transferase ypfP [Bacillus subtilis] | UniRef100_P54166 | Bacillus subtilis | UgtP |
| 2228 | | | | |
| 2229 | Cold shock protein cspD [Bacillus subtilis] | UniRef100_P51777 | Bacillus subtilis | |
| 2230 | Regulatory protein degR [Bacillus subtilis] | UniRef100_P06563 | Bacillus subtilis | |
| 2231 | Hypothetical protein ypzA [Bacillus subtilis] | UniRef100_O32007 | Bacillus subtilis | |
| 2232 | | | | |
| 2233 | Hypothetical protein ypeP [Bacillus subtilis] | UniRef100_P54164 | Bacillus subtilis | YpeP |
| 2234 | Hypothetical protein ypdP [Bacillus subtilis] | UniRef100_P54163 | Bacillus subtilis | YpdP |
| 2235 | 14.7 kDa ribonuclease H-like protein [Bacillus subtilis] | UniRef100_P54162 | Bacillus subtilis | YpdQ |
| 2236 | Probable 5'-3' exonuclease [Bacillus subtilis] | UniRef100_P54161 | Bacillus subtilis | YpcP |
| 2237 | | | | |
| 2238 | Hypothetical protein ypbS [Bacillus subtilis] | UniRef100_P54160 | Bacillus subtilis | |
| 2239 | Hypothetical protein ypbR [Bacillus subtilis] | UniRef100_P54159 | Bacillus subtilis | YpbR |
| 2240 | | | | |
| 2241 | Hypothetical protein ypbQ [Bacillus subtilis] | UniRef100_P54158 | Bacillus subtilis | YpbQ |
| 2242 | | | | BcsA |
| 2243 | Predicted acetyltransferase [Clostridium acetobutylicum] | UniRef100_Q97G03 | Clostridium acetobutylicum | YokL |
| 2244 | Xanthine permease [Bacillus subtilis] | UniRef100_P42086 | Bacillus subtilis | PbuX |
| 2245 | Xanthine phosphoribosyltransferase [Bacillus subtilis] | UniRef100_P42085 | Bacillus subtilis | Xpt |
| 2246 | Hypothetical metalloprotease ypwA [Bacillus subtilis] | UniRef100_P50848 | Bacillus subtilis | YpwA |
| 2247 | | | | YpvA |
| 2248 | Hypothetical protein yptA precursor [Bacillus subtilis] | UniRef100_P50841 | Bacillus subtilis | |
| 2249 | | | | |
| 2250 | Hypothetical UPF0020 protein ypsC precursor [Bacillus subtilis] | UniRef100_P50840 | Bacillus subtilis | YpsC |
| 2251 | Hypothetical protein ypsB [Bacillus subtilis] | UniRef100_P50839 | Bacillus subtilis | |

TABLE 1-continued

Predicted functions

| SEQ ID NO. | Description | UniRef Accession No. | Organism | Bacillus subtilis homolog (Gene Name) |
|---|---|---|---|---|
| 2252 | Hypothetical protein ypsA [Bacillus subtilis] | UniRef100_P50838 | Bacillus subtilis | YpsA |
| 2253 | Spore coat protein D [Bacillus subtilis] | UniRef100_P07791 | Bacillus subtilis | |
| 2254 | | | | |
| 2255 | | | | YprB |
| 2256 | | | | YprA |
| 2257 | Putative PTS system IIA component ypqE [Bacillus subtilis] | UniRef100_P50829 | Bacillus subtilis | YpqE |
| 2258 | Hypothetical protein ypqA precursor [Bacillus subtilis] | UniRef100_P50836 | Bacillus subtilis | YpqA |
| 2259 | Hypothetical protein yppG [Bacillus subtilis] | UniRef100_P50835 | Bacillus subtilis | YppG |
| 2260 | | | | |
| 2261 | | | | YppE |
| 2262 | | | | |
| 2263 | | | | |
| 2264 | Hypothetical protein yppC [Bacillus subtilis] | UniRef100_P39791 | Bacillus subtilis | YppC |
| 2265 | Recombination protein U [Bacillus subtilis] | UniRef100_P39792 | Bacillus subtilis | RecU |
| 2266 | Penicillin-binding protein 1A/1B (PBP1) [Includes: Penicillin-insensitive transglycosylase (EC 2.4.2.—) (Peptidoglycan TGase); Penicillin-sensitive transpeptidase (EC 3.4.—.—) (DD-transpeptidase)] [Bacillus subtilis] | UniRef100_P39793 | Includes: Penicillin-insensitive transglycosylase (EC 2.4.2.—) (Peptidoglycan TGase); Penicillin-sensitive transpeptidase (EC 3.4.—.—) (DD-transpeptidase) | PonA |
| 2267 | Hypothetical protein ypoC [Bacillus subtilis] | UniRef100_P39789 | Bacillus subtilis | YpoC |
| 2268 | Probable endonuclease III (EC 4.2.99.18) (DNA-(apurinic or apyrimidinic site) lyase) [Bacillus subtilis] | UniRef100_P39788 | Bacillus subtilis | Nth |
| 2269 | DNA replication protein dnaD [Bacillus subtilis] | UniRef100_P39787 | Bacillus subtilis | DnaD |
| 2270 | Asparaginyl-tRNA synthetase [Bacillus subtilis] | UniRef100_P39772 | Bacillus subtilis | AsnS |
| 2271 | Aspartate aminotransferase [Bacillus subtilis] | UniRef100_P53001 | Bacillus subtilis | AspB |
| 2272 | Hypothetical protein ypmB [Bacillus subtilis] | UniRef100_P54396 | Bacillus subtilis | YpmB |
| 2273 | Hypothetical protein ypmA [Bacillus subtilis] | UniRef100_P54395 | Bacillus subtilis | |
| 2274 | Probable ATP-dependent helicase dinG homolog [Bacillus subtilis] | UniRef100_P54394 | Bacillus subtilis | DinG |
| 2275 | Aspartate 1-decarboxylase precursor [Bacillus subtilis] | UniRef100_P52999 | Bacillus subtilis | PanD |
| 2276 | Pantoate--beta-alanine ligase [Bacillus subtilis] | UniRef100_P52998 | Bacillus subtilis | PanC |
| 2277 | 3-methyl-2-oxobutanoate hydroxymethyltransferase [Bacillus subtilis] | UniRef100_P52996 | Bacillus subtilis | PanB |
| 2278 | BirA bifunctional protein [Includes: Biotin operon repressor; Biotin--[acetyl-CoA-carboxylase] synthetase (EC 6.3.4.15) (Biotin--protein ligase)] [Bacillus subtilis] | UniRef100_P42975 | Includes: Biotin operon repressor; Biotin-- | BirA |
| 2279 | Poly(A) polymerase [Bacillus subtilis] | UniRef100_P42977 | Bacillus subtilis | Cca |
| 2280 | Putative glycosyl transferase ypjH [Bacillus subtilis] | UniRef100_P42982 | Bacillus subtilis | YpjH |
| 2281 | Hypothetical protein ypjG [Bacillus subtilis] | UniRef100_P42981 | Bacillus subtilis | YpjG |
| 2282 | Methylglyoxal synthase [Bacillus subtilis] | UniRef100_P42980 | Bacillus subtilis | MgsA |
| 2283 | Dihydrodipicolinate reductase [Bacillus subtilis] | UniRef100_P42976 | Bacillus subtilis | DapB |

TABLE 1-continued

Predicted functions

| SEQ ID NO. | Description | UniRef Accession No. | Organism | Bacillus subtilis homolog (Gene Name) |
|---|---|---|---|---|
| 2284 | Hypothetical protein ypjD [*Bacillus subtilis*] | UniRef100_P42979 | *Bacillus subtilis* | YpjD |
| 2285 | | | | YpjC |
| 2286 | Hypothetical protein ypjB precursor [*Bacillus subtilis*] | UniRef100_P54393 | *Bacillus subtilis* | YpjB |
| 2287 | | | | YpjA |
| 2288 | | | | QcrC |
| 2289 | Menaquinol-cytochrome c reductase cytochrome b subunit [*Bacillus subtilis*] | UniRef100_P46912 | *Bacillus subtilis* | QcrB |
| 2290 | Menaquinol-cytochrome c reductase iron-sulfur subunit [*Bacillus subtilis*] | UniRef100_P46911 | *Bacillus subtilis* | QcrA |
| 2291 | Hypothetical protein ypiF [*Bacillus subtilis*] | UniRef100_P54391 | *Bacillus subtilis* | YpiF |
| 2292 | Hypothetical UPF0302 protein ypiB [*Bacillus subtilis*] | UniRef100_P54390 | *Bacillus subtilis* | YpiB |
| 2293 | Hypothetical protein ypiA [*Bacillus subtilis*] | UniRef100_P54389 | *Bacillus subtilis* | YpiA |
| 2294 | 3-phosphoshikimate 1-carboxyvinyltransferase [*Bacillus subtilis*] | UniRef100_P20691 | *Bacillus subtilis* | AroE |
| 2295 | Prephenate dehydrogenase [*Bacillus subtilis*] | UniRef100_P20692 | *Bacillus subtilis* | TyrA |
| 2296 | | | | HisC |
| 2297 | Tryptophan synthase alpha chain [*Bacillus subtilis*] | UniRef100_P07601 | *Bacillus subtilis* | TrpA |
| 2298 | Tryptophan synthase beta chain [*Bacillus subtilis*] | UniRef100_P07600 | *Bacillus subtilis* | TrpB |
| 2299 | N-(5'-phosphoribosyl)anthranilate isomerase [*Bacillus subtilis*] | UniRef100_P20167 | *Bacillus subtilis* | TrpF |
| 2300 | Indole-3-glycerol phosphate synthase [*Bacillus subtilis*] | UniRef100_P03964 | *Bacillus subtilis* | TrpC |
| 2301 | Anthranilate phosphoribosyltransferase [*Bacillus subtilis*] | UniRef100_P03947 | *Bacillus subtilis* | TrpD |
| 2302 | Anthranilate synthase component I [*Bacillus subtilis*] | UniRef100_P03963 | *Bacillus subtilis* | TrpE |
| 2303 | Chorismate mutase [*Bacillus subtilis*] | UniRef100_P19080 | *Bacillus subtilis* | AroH |
| 2304 | 3-dehydroquinate synthase [*Bacillus subtilis*] | UniRef100_P31102 | *Bacillus subtilis* | AroB |
| 2305 | Chorismate synthase [*Bacillus subtilis*] | UniRef100_P31104 | *Bacillus subtilis* | AroF |
| 2306 | Chemotaxis protein methyltransferase [*Bacillus subtilis*] | UniRef100_P31105 | *Bacillus subtilis* | CheR |
| 2307 | Nucleoside diphosphate kinase [*Bacillus subtilis*] | UniRef100_P31103 | *Bacillus subtilis* | Ndk |
| 2308 | Heptaprenyl diphosphate synthase component II [*Bacillus subtilis*] | UniRef100_P31114 | *Bacillus subtilis* | HepT |
| 2309 | Menaquinone biosynthesis methyltransferase ubiE [*Bacillus subtilis*] | UniRef100_P31113 | *Bacillus subtilis* | MenH |
| 2310 | Heptaprenyl diphosphate synthase component I [*Bacillus subtilis*] | UniRef100_P31112 | *Bacillus subtilis* | HepS |
| 2311 | Transcription attenuation protein mtrB [*Bacillus subtilis*] | UniRef100_P19466 | *Bacillus subtilis* | |
| 2312 | GTP cyclohydrolase I [*Bacillus subtilis*] | UniRef100_P19465 | *Bacillus subtilis* | MtrA |
| 2313 | DNA-binding protein HU 1 [*Bacillus subtilis*] | UniRef100_P08821 | *Bacillus subtilis* | |
| 2314 | Stage IV sporulation protein A [*Bacillus subtilis*] | UniRef100_P35149 | *Bacillus subtilis* | SpoIVA |
| 2315 | Hypothetical protein yphF [*Bacillus subtilis*] | UniRef100_P39911 | *Bacillus subtilis* | YphF |
| 2316 | Hypothetical protein yphE [*Bacillus subtilis*] | UniRef100_P50744 | *Bacillus subtilis* | |
| 2317 | Glycerol-3-phosphate dehydrogenase [NAD(P)+] (EC 1.1.1.94) (NAD(P)H-dependent glycerol-3-phosphate dehydrogenase) (NAD(P)H-dependent dihydroxyacetone-phosphate reductase) [*Bacillus subtilis*] | UniRef100_P46919 | NAD(P)+ | GpsA |
| 2318 | | | | YphC |
| 2319 | Hypothetical protein OB1798 [*Oceanobacillus iheyensis*] | UniRef100_Q8EQA7 | *Oceanobacillus iheyensis* | |

TABLE 1-continued

Predicted functions

| SEQ ID NO. | Description | UniRef Accession No. | Organism | Bacillus subtilis homolog (Gene Name) |
|---|---|---|---|---|
| 2320 | Hypothetical protein yphB [Bacillus subtilis] | UniRef100_P50742 | Bacillus subtilis | SeaA |
| 2321 | Hypothetical protein yphA [Bacillus subtilis] | UniRef100_P50741 | Bacillus subtilis | YphA |
| 2322 | | | | |
| 2323 | | | | YpgA |
| 2324 | 30S ribosomal protein S1 homolog [Bacillus subtilis] | UniRef100_P38494 | Bacillus subtilis | YpfD |
| 2325 | Cytidylate kinase [Bacillus subtilis] | UniRef100_P38493 | Bacillus subtilis | Cmk |
| 2326 | Hypothetical protein ypfB [Bacillus subtilis] | UniRef100_P38492 | Bacillus subtilis | |
| 2327 | Sporulation protein ypeB [Bacillus subtilis] | UniRef100_P38490 | Bacillus subtilis | YpeB |
| 2328 | Spore cortex-lytic enzyme precursor [Bacillus subtilis] | UniRef100_P50739 | Bacillus subtilis | SleB |
| 2329 | | | | YpdC |
| 2330 | | | | YccC |
| 2331 | Hypothetical protein ypdA [Bacillus subtilis] | UniRef100_P50736 | Bacillus subtilis | YpdA |
| 2332 | NAD-specific glutamate dehydrogenase [Bacillus subtilis] | UniRef100_P50735 | Bacillus subtilis | GudB |
| 2333 | Adapter protein mecA 2 [Bacillus subtilis] | UniRef100_P50734 | Bacillus subtilis | YpbH |
| 2334 | Hypothetical protein ypbG precursor [Bacillus subtilis] | UniRef100_P50733 | Bacillus subtilis | YpbG |
| 2335 | | | | YpbF |
| 2336 | Hypothetical protein ypbE [Bacillus subtilis] | UniRef100_P50731 | Bacillus subtilis | YpbE |
| 2337 | Hypothetical protein ypbD [Bacillus subtilis] | UniRef100_P50730 | Bacillus subtilis | YpbD |
| 2338 | ATP-dependent DNA helicase recQ [Bacillus subtilis] | UniRef100_P50729 | Bacillus subtilis | RecQ |
| 2339 | Hypothetical protein ypbB [Bacillus subtilis] | UniRef100_P50728 | Bacillus subtilis | YpbB |
| 2340 | Ferredoxin [Bacillus subtilis] | UniRef100_P50727 | Bacillus subtilis | |
| 2341 | Hypothetical protein ypaA [Bacillus subtilis] | UniRef100_P50726 | Bacillus subtilis | YpaA |
| 2342 | | | | |
| 2343 | D-3-phosphoglycerate dehydrogenase [Bacillus subtilis] | UniRef100_P35136 | Bacillus subtilis | SerA |
| 2344 | BH1600 protein [Bacillus halodurans] | UniRef100_Q9KCH1 | Bacillus halodurans | |
| 2345 | Sigma-X negative effector [Bacillus subtilis] | UniRef100_P35166 | Bacillus subtilis | RsiX |
| 2346 | RNA polymerase sigma factor sigX [Bacillus subtilis] | UniRef100_P35165 | Bacillus subtilis | SigX |
| 2347 | Transcriptional regulator [Bacillus cereus] | UniRef100_Q72XJ3 | Bacillus cereus | LytR |
| 2348 | Endo-1,4-beta-xylanase [Bacillus halodurans] | UniRef100_Q9K630 | Bacillus halodurans | YheN |
| 2349 | | | | |
| 2350 | Alkaline phosphatase synthesis sensor protein phoR [Clostridium tetani] | UniRef100_Q898N3 | Clostridium tetani | YclK |
| 2351 | Response regulators consisting of a CheY-like receiver domain and a HTH DNA-binding domain [Thermoanaerobacter tengcongensis] | UniRef100_Q8R9H7 | Thermoanaerobacter tengcongensis | YycF |
| 2352 | Sensor protein resE [Bacillus subtilis] | UniRef100_P35164 | Bacillus subtilis | ResE |
| 2353 | Transcriptional regulatory protein resD [Bacillus subtilis] | UniRef100_P35163 | Bacillus subtilis | ResD |
| 2354 | Protein resC [Bacillus subtilis] | UniRef100_P35162 | Bacillus subtilis | ResC |
| 2355 | ResB protein [Bacillus subtilis] | UniRef100_P35161 | Bacillus subtilis | ResB |
| 2356 | Thiol-disulfide oxidoreductase resA [Bacillus subtilis] | UniRef100_P35160 | Bacillus subtilis | ResA |
| 2357 | Ribosomal large subunit pseudouridine synthase B [Bacillus subtilis] | UniRef100_P35159 | Bacillus subtilis | RluB |
| 2358 | Spore maturation protein B [Bacillus subtilis] | UniRef100_P35158 | Bacillus subtilis | SpmB |
| 2359 | Spore maturation protein A [Bacillus subtilis] | UniRef100_P35157 | Bacillus subtilis | SpmA |
| 2360 | Penicillin-binding protein 5* precursor [Bacillus subtilis] | UniRef100_P35150 | Bacillus subtilis | DacB |

TABLE 1-continued

Predicted functions

| SEQ ID NO. | Description | UniRef Accession No. | Organism | Bacillus subtilis homolog (Gene Name) |
|---|---|---|---|---|
| 2361 | Hypothetical protein ypuI [*Bacillus subtilis*] | UniRef100_P35156 | *Bacillus subtilis* | YpuI |
| 2362 | Segregation and condensation protein B [*Bacillus subtilis*] | UniRef100_P35155 | *Bacillus subtilis* | YpuH |
| 2363 | Segregation and condensation protein A [*Bacillus subtilis*] | UniRef100_P35154 | *Bacillus subtilis* | YpuG |
| 2364 | | | | |
| 2365 | Hypothetical protein ypuF [*Bacillus subtilis*] | UniRef100_P17617 | *Bacillus subtilis* | YpuF |
| 2366 | RibT protein [*Bacillus subtilis*] | UniRef100_P17622 | *Bacillus subtilis* | RibT |
| 2367 | 6,7-dimethyl-8-ribityllumazine synthase [*Bacillus amyloliquefaciens*] | UniRef100_Q44681 | *Bacillus amyloliquefaciens* | RibH |
| 2368 | Riboflavin biosynthesis protein ribA [Includes: GTP cyclohydrolase II (EC 3.5.4.25); 3,4-dihydroxy-2-butanone 4-phosphate synthase (DHBP synthase)] [*Bacillus subtilis*] | UniRef100_P17620 | Includes: GTP cyclohydrolase II (EC 3.5.4.25); 3,4-dihydroxy-2-butanone 4-phosphate synthase (DHBP synthase) | RibA |
| 2369 | Riboflavin synthase alpha chain [*Bacillus subtilis*] | UniRef100_P16440 | *Bacillus subtilis* | RibE |
| 2370 | Riboflavin biosynthesis protein ribD [Includes: Diaminohydroxyphosphoribosylaminopyrimidine deaminase (EC 3.5.4.26) (Riboflavin-specific deaminase); 5-amino-6-(5-phosphoribosylamino)uracil reductase (EC 1.1.1.193) (HTP reductase)] [*Bacillus subtilis*] | UniRef100_P17618 | Includes: Diaminohydroxyphosphoribosylaminopyrimidine deaminase (EC 3.5.4.26) (Riboflavin-specific deaminase); 5-amino-6-(5-phosphoribosylamino) uracil reductase (EC 1.1.1.193) (HTP reductase) | RibD |
| 2371 | Hypothetical protein ypuD [*Bacillus subtilis*] | UniRef100_P17616 | *Bacillus subtilis* | YpuD |
| 2372 | Putative serine/threonine protein phosphatase [*Helicobacter hepaticus*] | UniRef100_Q7VFC1 | *Helicobacter hepaticus* | YjbP |
| 2373 | Stress response homolog Hsp [*Bacillus subtilis*] | UniRef100_Q9X3Z5 | *Bacillus subtilis* | |
| 2374 | Response regulator aspartate phosphatase A [*Bacillus subtilis*] | UniRef100_Q00828 | *Bacillus subtilis* | RapA |
| 2375 | Peptidyl-prolyl cis-trans isomerase B [*Bacillus subtilis*] | UniRef100_P35137 | *Bacillus subtilis* | PpiB |
| 2376 | | | | YpuA |
| 2377 | IS1627s1-related, transposase [*Bacillus anthracis* str. A2012] | UniRef100_Q7CMD0 | *Bacillus anthracis* str. A2012 | |
| 2378 | UPI00003CC069 UniRef100 entry | | UniRef100_UPI00003CC069 | |
| 2379 | | | | YndL |
| 2380 | Diaminopimelate decarboxylase [*Bacillus subtilis*] | UniRef100_P23630 | *Bacillus subtilis* | LysA |
| 2381 | | | | |
| 2382 | Stage V sporulation protein AF [*Bacillus subtilis*] | UniRef100_P31845 | *Bacillus subtilis* | SpoVAF |
| 2383 | Stage V sporulation protein AE [*Bacillus subtilis*] | UniRef100_P40870 | *Bacillus subtilis* | SpoVAE |
| 2384 | Stage V sporulation protein AE [*Bacillus subtilis*] | UniRef100_P40870 | *Bacillus subtilis* | SpoVAE |
| 2385 | Stage V sporulation protein AD [*Bacillus subtilis*] | UniRef100_P40869 | *Bacillus subtilis* | SpoVAD |
| 2386 | | | | SpoVAC |
| 2387 | Stage V sporulation protein AB [*Bacillus subtilis*] | UniRef100_P40867 | *Bacillus subtilis* | SpoVAB |
| 2388 | Stage V sporulation protein AA [*Bacillus subtilis*] | UniRef100_P40866 | *Bacillus subtilis* | SpoVAA |
| 2389 | | | | SigF |
| 2390 | | | | SpoIIAB |
| 2391 | | | | SpoIIAA |
| 2392 | Penicillin-binding protein dacF precursor [*Bacillus subtilis*] | UniRef100_P38422 | *Bacillus subtilis* | DacF |

TABLE 1-continued

Predicted functions

| SEQ ID NO. | Description | UniRef Accession No. | Organism | Bacillus subtilis homolog (Gene Name) |
|---|---|---|---|---|
| 2393 | Purine nucleoside phosphorylase I [*Bacillus subtilis*] | UniRef100_P46354 | *Bacillus subtilis* | PunA |
| 2394 | Phosphopentomutase [*Bacillus subtilis*] | UniRef100_P46353 | *Bacillus subtilis* | Drm |
| 2395 | Tyrosine recombinase xerD [*Bacillus subtilis*] | UniRef100_P46352 | *Bacillus subtilis* | RipX |
| 2396 | | | | |
| 2397 | Ferric uptake regulation protein [*Bacillus subtilis*] | UniRef100_P54574 | *Bacillus subtilis* | Fur |
| 2398 | Stage II sporulation protein M [*Bacillus subtilis*] | UniRef100_P37873 | *Bacillus subtilis* | SpoIIM |
| 2399 | Lmo2763 protein [*Listeria monocytogenes*] | UniRef100_Q926Y4 | *Listeria monocytogenes* | YdhO |
| 2400 | UPI00003CA2F1 UniRef100 entry | | UniRef100_UPI00003CA2F1 | |
| 2401 | Probable allantoin permease [*Bacillus subtilis*] | UniRef100_P94575 | *Bacillus subtilis* | YwoE |
| 2402 | | | | YdaF |
| 2403 | Hypothetical protein yqkK [*Bacillus subtilis*] | UniRef100_P54573 | *Bacillus subtilis* | |
| 2404 | | | | YybD |
| 2405 | Hypothetical protein [*Bacillus pumilus*] | UniRef100_Q93PN4 | *Bacillus pumilus* | YqxK |
| 2406 | ADP-ribose pyrophosphatase [*Bacillus subtilis*] | UniRef100_P54570 | *Bacillus subtilis* | NudE |
| 2407 | | | | |
| 2408 | YdgC protein [*Bacillus subtilis*] | UniRef100_P96701 | *Bacillus subtilis* | YdgC |
| 2409 | Hypothetical protein ydgD [*Bacillus subtilis*] | UniRef100_P96702 | *Bacillus subtilis* | YdgD |
| 2410 | Hypothetical oxidoreductase yqkF [*Bacillus subtilis*] | UniRef100_P54569 | *Bacillus subtilis* | YqkF |
| 2411 | | | | |
| 2412 | | | | YqkD |
| 2413 | Hypothetical protein yqkC [*Bacillus subtilis*] | UniRef100_P54566 | *Bacillus subtilis* | |
| 2414 | Hypothetical protein yqkB [*Bacillus subtilis*] | UniRef100_P54565 | *Bacillus subtilis* | YqkB |
| 2415 | UPI00003CBE2B UniRef100 entry | | UniRef100_UPI00003CBE2B | |
| 2416 | Hypothetical UPF0157 protein yqkA [*Bacillus subtilis*] | UniRef100_P54564 | *Bacillus subtilis* | YqkA |
| 2417 | Hypothetical protein yqjZ [*Bacillus subtilis*] | UniRef100_P54563 | *Bacillus subtilis* | YqjZ |
| 2418 | Lipase precursor [*Bacillus subtilis*] | UniRef100_P37957 | *Bacillus subtilis* | Lip |
| 2419 | | | | |
| 2420 | Nickel ABC transporter [*Bacillus halodurans*] | UniRef100_Q9KBX8 | *Bacillus halodurans* | AppA |
| 2421 | Nickel ABC transporter [*Bacillus halodurans*] | UniRef100_Q9KBX7 | *Bacillus halodurans* | AppB |
| 2422 | Nickel ABC transporter [*Bacillus halodurans*] | UniRef100_Q9KBX6 | *Bacillus halodurans* | AppC |
| 2423 | Putative oligopeptide ABC transporter [*Clostridium tetani*] | UniRef100_Q895A4 | *Clostridium tetani* | DppD |
| 2424 | Putative oligopeptide ABC transporter [*Clostridium tetani*] | UniRef100_Q895A5 | *Clostridium tetani* | OppF |
| 2425 | DNA-damage-inducible protein [*Bacillus halodurans*] | UniRef100_Q9KDR1 | *Bacillus halodurans* | YojI |
| 2426 | Fibronectin-binding protein [*Bacillus cereus* ZK] | UniRef100_Q63CW1 | *Bacillus cereus* ZK | |
| 2427 | Hypothetical protein yolD [Bacteriophage SPBc2] | UniRef100_O64030 | Bacteriophage SPBc2 | YolD |
| 2428 | | | | UvrX |
| 2429 | Hypothetical protein yqzH [*Bacillus subtilis*] | UniRef100_O32014 | *Bacillus subtilis* | |
| 2430 | Hypothetical transport protein yqjV [*Bacillus subtilis*] | UniRef100_P54559 | *Bacillus subtilis* | YqjV |
| 2431 | Hypothetical protein yqjT [*Bacillus subtilis*] | UniRef100_P54557 | *Bacillus subtilis* | YqjT |
| 2432 | | | | CoaA |
| 2433 | LacG [*Lactococcus lactis*] | UniRef100_Q9RAU9 | *Lactococcus lactis* | |
| 2434 | LacF [*Lactococcus lactis*] | UniRef100_Q9RAV2 | *Lactococcus lactis* | YdbJ |
| 2435 | | | | |
| 2436 | Hypothetical protein [*Bacillus amyloliquefaciens*] | UniRef100_Q70K07 | *Bacillus amyloliquefaciens* | |

TABLE 1-continued

Predicted functions

| SEQ ID NO. | Description | UniRef Accession No. | Organism | Bacillus subtilis homolog (Gene Name) |
|---|---|---|---|---|
| 2437 | Hypothetical protein [*Bacillus cereus*] | UniRef100_Q737G3 | *Bacillus cereus* | |
| 2438 | YmaC protein [*Bacillus subtilis*] | UniRef100_O31789 | *Bacillus subtilis* | YmaC |
| 2439 | Hypothetical oxidoreductase yqjQ [*Bacillus subtilis*] | UniRef100_P54554 | *Bacillus subtilis* | YqjQ |
| 2440 | | | | YqjP |
| 2441 | | | | ProI |
| 2442 | Hypothetical protein yqjN [*Bacillus subtilis*] | UniRef100_P54551 | *Bacillus subtilis* | YqjN |
| 2443 | Probable NADH-dependent flavin oxidoreductase yqjM [*Bacillus subtilis*] | UniRef100_P54550 | *Bacillus subtilis* | YqjM |
| 2444 | Hypothetical protein yqjL [*Bacillus subtilis*] | UniRef100_P54549 | *Bacillus subtilis* | YqjL |
| 2445 | | | | |
| 2446 | Ribonuclease Z [*Bacillus subtilis*] | UniRef100_P54548 | *Bacillus subtilis* | YqjK |
| 2447 | Glucose-6-phosphate 1-dehydrogenase [*Bacillus subtilis*] | UniRef100_P54547 | *Bacillus subtilis* | Zwf |
| 2448 | Hypothetical conserved protein [*Oceanobacillus iheyensis*] | UniRef100_Q8ELZ9 | *Oceanobacillus iheyensis* | CitH |
| 2449 | Hypothetical protein OB3065 [*Oceanobacillus iheyensis*] | UniRef100_Q8ELZ8 | *Oceanobacillus iheyensis* | |
| 2450 | Immunogenic protein [*Oceanobacillus iheyensis*] | UniRef100_Q8ELZ7 | *Oceanobacillus iheyensis* | SsuA |
| 2451 | YdhQ protein [*Bacillus subtilis*] | UniRef100_O05509 | *Bacillus subtilis* | YdhQ |
| 2452 | Beta-glucosidase [*Bacillus halodurans*] | UniRef100_Q9K615 | *Bacillus halodurans* | YdhP |
| 2453 | Putative cellobiose-specific enzyme IIC [*Bacillus pumilus*] | UniRef100_Q8KP28 | *Bacillus pumilus* | YdhO |
| 2454 | YdhO protein [*Bacillus subtilis*] | UniRef100_O05507 | *Bacillus subtilis* | YdhO |
| 2455 | YdhN protein [*Bacillus subtilis*] | UniRef100_O05506 | *Bacillus subtilis* | YdhN |
| 2456 | PTS system, cellobiose-specific enzyme II, B component [*Bacillus halodurans*] | UniRef100_Q9K613 | *Bacillus halodurans* | |
| 2457 | Alkaline phosphatase [*Bacillus cereus* ZK] | UniRef100_Q639W1 | *Bacillus cereus* ZK | PhoB |
| 2458 | Glucose 1-dehydrogenase A [*Bacillus megaterium*] | UniRef100_P10528 | *Bacillus megaterium* | Gdh |
| 2459 | 6-phosphogluconate dehydrogenase, decarboxylating II [*Bacillus subtilis*] | UniRef100_P80859 | *Bacillus subtilis* | YqjI |
| 2460 | DNA polymerase IV 1 [*Bacillus subtilis*] | UniRef100_P54545 | *Bacillus subtilis* | YqjH |
| 2461 | Hypothetical protein yqzJ [*Bacillus subtilis*] | UniRef100_Q7WY64 | *Bacillus subtilis* | |
| 2462 | | | | YqjG |
| 2463 | Hypothetical protein yqjE [*Bacillus subtilis*] | UniRef100_P54542 | *Bacillus subtilis* | YqjE |
| 2464 | Methylmalonyl-CoA decarboxylase alpha subunit [*Bacillus halodurans*] | UniRef100_Q9K8P6 | *Bacillus halodurans* | YqjD |
| 2465 | Hypothetical protein yqjA [*Bacillus subtilis*] | UniRef100_P54538 | *Bacillus subtilis* | YqjA |
| 2466 | Probable amino-acid ABC transporter ATP-binding protein yqiZ [*Bacillus subtilis*] | UniRef100_P54537 | *Bacillus subtilis* | YqiZ |
| 2467 | Probable amino-acid ABC transporter permease protein yqiY [*Bacillus subtilis*] | UniRef100_P54536 | *Bacillus subtilis* | YqiY |
| 2468 | Probable amino-acid ABC transporter extracellular binding protein yqiX precursor [*Bacillus subtilis*] | UniRef100_P54535 | *Bacillus subtilis* | YqiX |
| 2469 | Hypothetical protein yqiW [*Bacillus subtilis*] | UniRef100_P54534 | *Bacillus subtilis* | YqiW |
| 2470 | Protein bmrU [*Bacillus subtilis*] | UniRef100_P39074 | *Bacillus subtilis* | BmrU |
| 2471 | Lipoamide acyltransferase component of branched-chain alpha-keto acid dehydrogenase complex (EC 2.3.1.168) (Dihydrolipoyllysine-residue (2-methylpropanoyl)transferase) [*Bacillus subtilis*] | UniRef100_P37942 | *Bacillus subtilis* | BkdB |
| 2472 | 2-oxoisovalerate dehydrogenase beta subunit [*Bacillus subtilis*] | UniRef100_P37941 | *Bacillus subtilis* | BkdAB |
| 2473 | 2-oxoisovalerate dehydrogenase alpha subunit [*Bacillus subtilis*] | UniRef100_P37940 | *Bacillus subtilis* | BkdAA |

TABLE 1-continued

Predicted functions

| SEQ ID NO. | Description | UniRef Accession No. | Organism | Bacillus subtilis homolog (Gene Name) |
|---|---|---|---|---|
| 2474 | Dihydrolipoyl dehydrogenase [*Bacillus subtilis*] | UniRef100_P54533 | *Bacillus subtilis* | LpdV |
| 2475 | Probable butyrate kinase [*Bacillus subtilis*] | UniRef100_P54532 | *Bacillus subtilis* | Buk |
| 2476 | Leucine dehydrogenase [*Bacillus subtilis*] | UniRef100_P54531 | *Bacillus subtilis* | Bcd |
| 2477 | Probable phosphate butyryltransferase [*Bacillus subtilis*] | UniRef100_P54530 | *Bacillus subtilis* | Ptb |
| 2478 | Putative sigma L-dependent transcriptional regulator yqiR [*Bacillus subtilis*] | UniRef100_P54529 | *Bacillus subtilis* | BkdR |
| 2479 | Hypothetical protein yqzF [*Bacillus subtilis*] | UniRef100_O32015 | *Bacillus subtilis* | |
| 2480 | Hypothetical protein yqiK [*Bacillus subtilis*] | UniRef100_P54527 | *Bacillus subtilis* | YqiK |
| 2481 | Hypothetical protein yqiI [*Bacillus subtilis*] | UniRef100_P54525 | *Bacillus subtilis* | YqiI |
| 2482 | | | | YqiH |
| 2483 | Serine O-acetyltransferase [*Methanosarcina mazei*] | UniRef100_Q8PSY4 | *Methanosarcina mazei* | CysE |
| 2484 | | | | |
| 2485 | Stage 0 sporulation protein A [*Bacillus subtilis*] | UniRef100_P06534 | *Bacillus subtilis* | Spo0A |
| 2486 | | | | SpoIVB |
| 2487 | DNA repair protein recN [*Bacillus amyloliquefaciens*] | UniRef100_Q659H4 | *Bacillus amyloliquefaciens* | RecN |
| 2488 | Arginine repressor [*Bacillus subtilis*] | UniRef100_P17893 | *Bacillus subtilis* | AhrC |
| 2489 | Hypothetical protein yqxC [*Bacillus subtilis*] | UniRef100_P19672 | *Bacillus subtilis* | YqxC |
| 2490 | | | | Dxs |
| 2491 | Geranyltranstferase [*Bacillus subtilis*] | UniRef100_P54383 | *Bacillus subtilis* | YqiD |
| 2492 | Probable exodeoxyribonuclease VII small subunit [*Bacillus subtilis*] | UniRef100_P54522 | *Bacillus subtilis* | |
| 2493 | Probable exodeoxyribonuclease VII large subunit [*Bacillus subtilis*] | UniRef100_P54521 | *Bacillus subtilis* | YqiB |
| 2494 | FolD bifunctional protein [Includes: Methylenetetrahydrofolate dehydrogenase (EC 1.5.1.5); Methenyltetrahydrofolate cyclohydrolase (EC 3.5.4.9)] [*Bacillus subtilis*] | UniRef100_P54382 | Includes: Methylenetetrahydrofolate dehydrogenase (EC 1.5.1.5); Methenyltetrahydrofolate cyclohydrolase (EC 3.5.4.9) | FolD |
| 2495 | N utilization substance protein B homolog [*Bacillus subtilis*] | UniRef100_P54520 | *Bacillus subtilis* | NusB |
| 2496 | Hypothetical protein yqhY [*Bacillus subtilis*] | UniRef100_P54519 | *Bacillus subtilis* | YqhY |
| 2497 | | | | AccC |
| 2498 | Biotin carboxyl carrier protein of acetyl-CoA carboxylase [*Bacillus subtilis*] | UniRef100_P49786 | *Bacillus subtilis* | AccB |
| 2499 | Stage III sporulation protein AH [*Bacillus subtilis*] | UniRef100_P49785 | *Bacillus subtilis* | SpoIIIAH |
| 2500 | Stage III sporulation protein AG [*Bacillus subtilis*] | UniRef100_P49784 | *Bacillus subtilis* | SpoIIIAG |
| 2501 | Stage III sporulation protein AF [*Bacillus subtilis*] | UniRef100_P49783 | *Bacillus subtilis* | SpoIIIAF |
| 2502 | Stage III sporulation protein AE [*Bacillus subtilis*] | UniRef100_P49782 | *Bacillus subtilis* | SpoIIIAE |
| 2503 | Stage III sporulation protein AD [*Bacillus subtilis*] | UniRef100_P49781 | *Bacillus subtilis* | SpoIIIAD |
| 2504 | Stage III sporulation protein AC [*Bacillus subtilis*] | UniRef100_P49780 | *Bacillus subtilis* | |
| 2505 | Stage III sporulation protein AB [*Bacillus subtilis*] | UniRef100_Q01368 | *Bacillus subtilis* | SpoIIIAB |
| 2506 | | | | SpoIIIAA |
| 2507 | Hypothetical protein yqhV [*Bacillus subtilis*] | UniRef100_P49779 | *Bacillus subtilis* | |
| 2508 | Elongation factor P [*Bacillus subtilis*] | UniRef100_P49778 | *Bacillus subtilis* | Efp |
| 2509 | Putative peptidase yqhT [*Bacillus subtilis*] | UniRef100_P54518 | *Bacillus subtilis* | YqhT |

TABLE 1-continued

Predicted functions

| SEQ ID NO. | Description | UniRef Accession No. | Organism | Bacillus subtilis homolog (Gene Name) |
|---|---|---|---|---|
| 2510 | 3-dehydroquinate dehydratase [*Bacillus subtilis*] | UniRef100_P54517 | *Bacillus subtilis* | YqhS |
| 2511 | Hypothetical protein yqhR [*Bacillus subtilis*] | UniRef100_P54516 | *Bacillus subtilis* | YqhR |
| 2512 | Hypothetical protein yqhQ [*Bacillus subtilis*] | UniRef100_P54515 | *Bacillus subtilis* | YqhQ |
| 2513 | Hypothetical protein yqhP [*Bacillus subtilis*] | UniRef100_P54514 | *Bacillus subtilis* | YqhP |
| 2514 | Hypothetical protein yqhO [*Bacillus subtilis*] | UniRef100_P54513 | *Bacillus subtilis* | YqhO |
| 2515 | Transcriptional regulator mntR [*Bacillus subtilis*] | UniRef100_P54512 | *Bacillus subtilis* | MntR |
| 2516 | Hypothetical protein yqhM [*Bacillus subtilis*] | UniRef100_P54511 | *Bacillus subtilis* | YqhM |
| 2517 | Hypothetical protein yqhL [*Bacillus subtilis*] | UniRef100_P54510 | *Bacillus subtilis* | YqhL |
| 2518 | Glycine betaine-binding protein precursor [*Bacillus subtilis*] | UniRef100_P46922 | *Bacillus subtilis* | OpuAC |
| 2519 | Glycine betaine transport system permease protein opuAB [*Bacillus subtilis*] | UniRef100_P46921 | *Bacillus subtilis* | OpuAB |
| 2520 | Glycine betaine transport ATP-binding protein opuAA [*Bacillus subtilis*] | UniRef100_P46920 | *Bacillus subtilis* | OpuAA |
| 2521 | Probable glycine dehydrogenase [decarboxylating] subunit 2 [*Bacillus subtilis*] | UniRef100_P54377 | decarboxylating | GcvPB |
| 2522 | Probable glycine dehydrogenase [decarboxylating] subunit 1 [*Bacillus subtilis*] | UniRef100_P54376 | decarboxylating | GcvPA |
| 2523 | Aminomethyltransferase [*Bacillus subtilis*] | UniRef100_P54378 | *Bacillus subtilis* | GcvT |
| 2524 | Hypothetical helicase yqhH [*Bacillus subtilis*] | UniRef100_P54509 | *Bacillus subtilis* | YqhH |
| 2525 | Hypothetical protein yqhG [*Bacillus subtilis*] | UniRef100_P54508 | *Bacillus subtilis* | YqhG |
| 2526 | | | | |
| 2527 | | | | SinR |
| 2528 | Spore coat-associated protein N [*Bacillus subtilis*] | UniRef100_P54507 | *Bacillus subtilis* | TasA |
| 2529 | Signal peptidase I W [*Bacillus subtilis*] | UniRef100_P54506 | *Bacillus subtilis* | SipW |
| 2530 | Hypothetical protein yqxM [*Bacillus subtilis*] | UniRef100_P40949 | *Bacillus subtilis* | YqxM |
| 2531 | YqzG protein [*Bacillus subtilis*] | UniRef100_O32019 | *Bacillus subtilis* | |
| 2532 | YqzE protein [*Bacillus subtilis*] | UniRef100_O32020 | *Bacillus subtilis* | |
| 2533 | | | | ComGG |
| 2534 | | | | ComGF |
| 2535 | ComG operon protein 5 precursor [*Bacillus subtilis*] | UniRef100_P25957 | *Bacillus subtilis* | ComGE |
| 2536 | ComG operon protein 4 precursor [*Bacillus subtilis*] | UniRef100_P25956 | *Bacillus subtilis* | ComGD |
| 2537 | ComG operon protein 3 precursor [*Bacillus subtilis*] | UniRef100_P25955 | *Bacillus subtilis* | |
| 2538 | | | | ComGB |
| 2539 | ComG operon protein 1 [*Bacillus subtilis*] | UniRef100_P25953 | *Bacillus subtilis* | ComGA |
| 2540 | Hypothetical protein yqhA [*Bacillus subtilis*] | UniRef100_P54504 | *Bacillus subtilis* | YqhA |
| 2541 | Hypothetical protein yqgZ [*Bacillus subtilis*] | UniRef100_P54503 | *Bacillus subtilis* | YqgZ |
| 2542 | Hypothetical protein yqgY [*Bacillus subtilis*] | UniRef100_P54502 | *Bacillus subtilis* | |
| 2543 | Hypothetical protein yqgX [*Bacillus subtilis*] | UniRef100_P54501 | *Bacillus subtilis* | YqgX |
| 2544 | Hypothetical protein yqgW [*Bacillus subtilis*] | UniRef100_P54500 | *Bacillus subtilis* | |
| 2545 | Hypothetical protein [*Staphylococcus epidermidis*] | UniRef100_Q8CSE8 | *Staphylococcus epidermidis* | |
| 2546 | | | | YqgU |
| 2547 | Hypothetical protein yqgT [*Bacillus subtilis*] | UniRef100_P54497 | *Bacillus subtilis* | YqgT |

TABLE 1-continued

Predicted functions

| SEQ ID NO. | Description | UniRef Accession No. | Organism | Bacillus subtilis homolog (Gene Name) |
|---|---|---|---|---|
| 2548 | Ferrichrome-binding protein precursor [Bacillus subtilis] | UniRef100_P37580 | Bacillus subtilis | FhuD |
| 2549 | Hypothetical protein yqgS [Bacillus subtilis] | UniRef100_P54496 | Bacillus subtilis | YqgS |
| 2550 | Glucokinase [Bacillus subtilis] | UniRef100_P54495 | Bacillus subtilis | GlcK |
| 2551 | Hypothetical protein yqgQ [Bacillus subtilis] | UniRef100_P54494 | Bacillus subtilis | |
| 2552 | Stage V sporulation protein AF [Oceanobacillus iheyensis] | UniRef100_Q8EQ08 | Oceanobacillus iheyensis | SpoVAF |
| 2553 | Hypothetical protein yqgP [Bacillus subtilis] | UniRef100_P54493 | Bacillus subtilis | YqgP |
| 2554 | Hypothetical protein yqgO [Bacillus subtilis] | UniRef100_P54492 | Bacillus subtilis | |
| 2555 | Hypothetical protein yqgN [Bacillus subtilis] | UniRef100_P54491 | Bacillus subtilis | YqgN |
| 2556 | | | | |
| 2557 | | | | YqgM |
| 2558 | Hypothetical protein yqgL [Bacillus subtilis] | UniRef100_P54489 | Bacillus subtilis | YqgL |
| 2559 | | | | YqzD |
| 2560 | YqzC protein [Bacillus subtilis] | UniRef100_O32023 | Bacillus subtilis | YqzC |
| 2561 | Phosphate import ATP-binding protein pstB 1 [Bacillus subtilis] | UniRef100_P46342 | Bacillus subtilis | PstBB |
| 2562 | Phosphate import ATP-binding protein pstB 2 [Bacillus subtilis] | UniRef100_P46341 | Bacillus subtilis | PstBA |
| 2563 | Probable ABC transporter permease protein yqqI [Bacillus subtilis] | UniRef100_P46340 | Bacillus subtilis | PstA |
| 2564 | Probable ABC transporter permease protein yqgH [Bacillus subtilis] | UniRef100_P46339 | Bacillus subtilis | PstC |
| 2565 | Probable ABC transporter binding protein yqgG precursor [Bacillus subtilis] | UniRef100_P46338 | Bacillus subtilis | PstS |
| 2566 | Hypothetical protein yqgF [Bacillus subtilis] | UniRef100_P54488 | Bacillus subtilis | PbpA |
| 2567 | Hypothetical protein yqgE [Bacillus subtilis] | UniRef100_P54487 | Bacillus subtilis | YqgE |
| 2568 | | | | SodA |
| 2569 | Hypothetical protein yqgC [Bacillus subtilis] | UniRef100_P54486 | Bacillus subtilis | YqgC |
| 2570 | Hypothetical protein yqgB [Bacillus subtilis] | UniRef100_P54485 | Bacillus subtilis | YqgB |
| 2571 | Hypothetical protein yqfZ [Bacillus subtilis] | UniRef100_P54483 | Bacillus subtilis | |
| 2572 | 4-hydroxy-3-methylbut-2-en-1-yl diphosphate synthase (EC 1.17.4.3) (1-hydroxy-2-methyl-2-(E)-butenyl 4-diphosphate synthase) [Bacillus subtilis] | UniRef100_P54482 | Bacillus subtilis | YqfY |
| 2573 | Hypothetical protein yqfX [Bacillus subtilis] | UniRef100_P54481 | Bacillus subtilis | YqfX |
| 2574 | Putative nucleotidase yqfW [Bacillus subtilis] | UniRef100_P54480 | Bacillus subtilis | YqfW |
| 2575 | Zinc-specific metalloregulatory protein [Bacillus subtilis] | UniRef100_P54479 | Bacillus subtilis | Zur |
| 2576 | Metal (Zinc) transport protein [Listeria innocua] | UniRef100_Q926D9 | Listeria innocua | YceA |
| 2577 | | | | YcdI |
| 2578 | Hypothetical protein yqfU [Bacillus subtilis] | UniRef100_P54478 | Bacillus subtilis | YqfU |
| 2579 | | | | |
| 2580 | Probable endonuclease IV [Bacillus subtilis] | UniRef100_P54476 | Bacillus subtilis | YqfS |
| 2581 | Probable RNA helicase yqfR [Bacillus subtilis] | UniRef100_P54475 | Bacillus subtilis | YqfR |
| 2582 | Hypothetical protein yqfQ [Bacillus subtilis] | UniRef100_P54474 | Bacillus subtilis | YqfQ |
| 2583 | 4-hydroxy-3-methylbut-2-enyl diphosphate reductase [Bacillus subtilis] | UniRef100_P54473 | Bacillus subtilis | YqfP |
| 2584 | | | | YqfO |

TABLE 1-continued

Predicted functions

| SEQ ID NO. | Description | UniRef Accession No. | Organism | Bacillus subtilis homolog (Gene Name) |
|---|---|---|---|---|
| 2585 | Hypothetical protein yqfN [Bacillus subtilis] | UniRef100_P54471 | Bacillus subtilis | YqfN |
| 2586 | YwqL protein [Bacillus subtilis] | UniRef100_P96724 | Bacillus subtilis | YwqL |
| 2587 | | | | |
| 2588 | | | | |
| 2589 | | | | |
| 2590 | | | | |
| 2591 | Hypothetical protein CAC0336 [Clostridium acetobutylicum] | UniRef100_Q97M62 | Clostridium acetobutylicum | |
| 2592 | Hypothetical protein [Bacillus thuringiensis] | UniRef100_Q6HGF2 | Bacillus thuringiensis | |
| 2593 | | | | |
| 2594 | YwqJ protein [Bacillus subtilis] | UniRef100_P96722 | Bacillus subtilis | YwqJ |
| 2595 | Hypothetical protein ywqI [Bacillus subtilis] | UniRef100_P96721 | Bacillus subtilis | |
| 2596 | | | | YwqH |
| 2597 | Cytochrome c-550 [Bacillus subtilis] | UniRef100_P24469 | Bacillus subtilis | CccA |
| 2598 | | | | SigA |
| 2599 | DNA primase [Bacillus subtilis] | UniRef100_P05096 | Bacillus subtilis | DnaG |
| 2600 | Hypothetical UPF0178 protein yqxD [Bacillus subtilis] | UniRef100_P17868 | Bacillus subtilis | YqxD |
| 2601 | Hypothetical UPF0085 protein yqfL [Bacillus subtilis] | UniRef100_P54470 | Bacillus subtilis | YqfL |
| 2602 | YqzB protein [Bacillus subtilis] | UniRef100_O34994 | Bacillus subtilis | YqzB |
| 2603 | Glycyl-tRNA synthetase beta chain [Bacillus subtilis] | UniRef100_P54381 | Bacillus subtilis | GlyS |
| 2604 | Glycyl-tRNA synthetase alpha chain [Bacillus subtilis] | UniRef100_P54380 | Bacillus subtilis | GlyQ |
| 2605 | DNA repair protein recO [Bacillus subtilis] | UniRef100_P42095 | Bacillus subtilis | RecO |
| 2606 | | | | |
| 2607 | GTP-binding protein era homolog [Bacillus subtilis] | UniRef100_P42182 | Bacillus subtilis | Era |
| 2608 | Cytidine deaminase [Bacillus subtilis] | UniRef100_P19079 | Bacillus subtilis | Cdd |
| 2609 | | | | |
| 2610 | Hypothetical UPF0054 protein yqfG [Bacillus subtilis] | UniRef100_P46347 | Bacillus subtilis | YqfG |
| 2611 | Hypothetical protein yqfF [Bacillus subtilis] | UniRef100_P46344 | Bacillus subtilis | YqfF |
| 2612 | PhoH-like protein [Bacillus subtilis] | UniRef100_P46343 | Bacillus subtilis | PhoH |
| 2613 | | | | YqfD |
| 2614 | Hypothetical protein yqfC [Bacillus subtilis] | UniRef100_P54468 | Bacillus subtilis | |
| 2615 | Hypothetical protein yqfB [Bacillus subtilis] | UniRef100_P54467 | Bacillus subtilis | YqfB |
| 2616 | Hypothetical protein yqfA [Bacillus subtilis] | UniRef100_P54466 | Bacillus subtilis | YqfA |
| 2617 | | | | YqeZ |
| 2618 | Hypothetical protein yqeY [Bacillus subtilis] | UniRef100_P54464 | Bacillus subtilis | YqeY |
| 2619 | | | | |
| 2620 | Hypothetical protein yqeW [Bacillus subtilis] | UniRef100_P54463 | Bacillus subtilis | YqeW |
| 2621 | Deoxyribose-phosphate aldolase [Listeria innocua] | UniRef100_Q92A19 | Listeria innocua | Dra |
| 2622 | Hypothetical UPF0004 protein yqeV [Bacillus subtilis] | UniRef100_P54462 | Bacillus subtilis | YqeV |
| 2623 | Hypothetical UPF0088 protein yqeU [Bacillus subtilis] | UniRef100_P54461 | Bacillus subtilis | YqeU |
| 2624 | Ribosomal protein L11 methyltransferase [Bacillus subtilis] | UniRef100_P54460 | Bacillus subtilis | YqeT |
| 2625 | Chaperone protein dnaJ [Bacillus subtilis] | UniRef100_P17631 | Bacillus subtilis | DnaJ |
| 2626 | | | | DnaK |
| 2627 | | | | |
| 2628 | | | | |
| 2629 | Heat-inducible transcription repressor hrcA [Bacillus subtilis] | UniRef100_P25499 | Bacillus subtilis | HrcA |
| 2630 | Probable oxygen-independent coproporphyrinogen III oxidase [Bacillus subtilis] | UniRef100_P54304 | Bacillus subtilis | HemN |

TABLE 1-continued

Predicted functions

| SEQ ID NO. | Description | UniRef Accession No. | Organism | Bacillus subtilis homolog (Gene Name) |
|---|---|---|---|---|
| 2631 | | | | LepA |
| 2632 | Hypothetical protein yqxA [*Bacillus subtilis*] | UniRef100_P38425 | *Bacillus subtilis* | YqxA |
| 2633 | | | | SpoIIP |
| 2634 | Germination protease precursor [*Bacillus subtilis*] | UniRef100_P22322 | *Bacillus subtilis* | Gpr |
| 2635 | 30S ribosomal protein S20 [*Bacillus subtilis*] | UniRef100_P21477 | *Bacillus subtilis* | |
| 2636 | Hypothetical protein yqeN [*Bacillus subtilis*] | UniRef100_P54459 | *Bacillus subtilis* | YqeN |
| 2637 | | | | |
| 2638 | ComE operon protein 3 [*Bacillus subtilis*] | UniRef100_P39695 | *Bacillus subtilis* | ComEC |
| 2639 | ComE operon protein 2 [*Bacillus subtilis*] | UniRef100_P32393 | *Bacillus subtilis* | ComEB |
| 2640 | ComE operon protein 1 [*Bacillus subtilis*] | UniRef100_P39694 | *Bacillus subtilis* | ComEA |
| 2641 | ComE operon protein 4 [*Bacillus subtilis*] | UniRef100_P39696 | *Bacillus subtilis* | ComER |
| 2642 | Hypothetical protein yqeM [*Bacillus subtilis*] | UniRef100_P54458 | *Bacillus subtilis* | YqeM |
| 2643 | Hypothetical protein yqeL [*Bacillus subtilis*] | UniRef100_P54457 | *Bacillus subtilis* | YqeL |
| 2644 | Hypothetical protein yqeK [*Bacillus subtilis*] | UniRef100_P54456 | *Bacillus subtilis* | YqeK |
| 2645 | Nicotinate-nucleotide adenylyltransferase (EC 2.7.7.18) (Deamido-NAD(+) pyrophosphorylase) (Deamido-NAD(+) diphosphorylase) [*Bacillus subtilis*] | UniRef100_P54455 | *Bacillus subtilis* | YqeJ |
| 2646 | Hypothetical UPF0044 protein yqeI [*Bacillus subtilis*] | UniRef100_P54454 | *Bacillus subtilis* | |
| 2647 | Shikimate dehydrogenase [*Bacillus subtilis*] | UniRef100_P54374 | *Bacillus subtilis* | AroD |
| 2648 | Hypothetical protein yqeH [*Bacillus subtilis*] | UniRef100_P54453 | *Bacillus subtilis* | YqeH |
| 2649 | Hypothetical protein yqeG [*Bacillus subtilis*] | UniRef100_P54452 | *Bacillus subtilis* | YqeG |
| 2650 | | | | |
| 2651 | | | | |
| 2652 | Hypothetical lipoprotein yqeF precursor [*Bacillus subtilis*] | UniRef100_P54451 | *Bacillus subtilis* | YqeF |
| 2653 | Acetyltransferase, GNAT family [*Bacillus anthracis*] | UniRef100_Q81KW8 | *Bacillus anthracis* | YdfB |
| 2654 | Hypothetical protein yrhF [*Bacillus subtilis*] | UniRef100_O05398 | *Bacillus subtilis* | YrhF |
| 2655 | Formate dehydrogenase chain A [*Bacillus subtilis*] | UniRef100_O05397 | *Bacillus subtilis* | YrhE |
| 2656 | Hypothetical protein yrhD [*Bacillus subtilis*] | UniRef100_O05396 | *Bacillus subtilis* | YrhD |
| 2657 | | | | |
| 2658 | RNA polymerase sigma-K factor precursor [*Bacillus subtilis*] | UniRef100_P12254 | *Bacillus subtilis* | SpoIIIC |
| 2659 | | | | YcnB |
| 2660 | BH2157 protein [*Bacillus halodurans*] | UniRef100_Q9KAX9 | *Bacillus halodurans* | YuaI |
| 2661 | | | | |
| 2662 | | | | |
| 2663 | Alanyl-tRNA synthetase family protein [*Bacillus anthracis*] | UniRef100_Q81Y73 | *Bacillus anthracis* | AlaS |
| 2664 | METAL-ACTIVATED PYRIDOXAL ENZYME [*Brucella melitensis*] | UniRef100_Q8YCI2 | *Brucella melitensis* | |
| 2665 | Probable translation initiation inhibitor [*Photobacterium profundum*)] | UniRef100_Q6LKM3 | *Photobacterium profundum*) | YabJ |
| 2666 | | | | YccC |
| 2667 | Putative threonine synthase [*Streptomyces avermitilis*] | UniRef100_Q82IF6 | *Streptomyces avermitilis* | ThrC |
| 2668 | | | | YabJ |
| 2669 | Hypothetical protein [*Thermoanaerobacter tengcongensis*] | UniRef100_Q8RBA0 | *Thermoanaerobacter tengcongensis* | |
| 2670 | | | | |

TABLE 1-continued

Predicted functions

| SEQ ID NO. | Description | UniRef Accession No. | Organism | Bacillus subtilis homolog (Gene Name) |
|---|---|---|---|---|
| 2671 | UPI000032CE59 UniRef100 entry | | UniRef100_UPI000032CE59 | |
| 2672 | Multidrug-efflux transporter 1 regulator [*Bacillus subtilis*] | UniRef100_P39075 | *Bacillus subtilis* | BmrR |
| 2673 | Metallo-beta-lactamase/rhodanese-like domain protein [*Bacillus anthracis*] | UniRef100_Q81Q95 | *Bacillus anthracis* | YrkH |
| 2674 | Hypothetical protein [*Bacillus cereus* ZK] | UniRef100_Q63B51 | *Bacillus cereus* ZK | YumB |
| 2675 | NreC [*Staphylococcus carnosus*] | UniRef100_Q7WZY4 | *Staphylococcus carnosus* | DegU |
| 2676 | Two-component sensor histidine kinase [*Symbiobacterium thermophilum*] | UniRef100_Q67JE7 | *Symbiobacterium thermophilum* | DegS |
| 2677 | YdfQ protein [*Bacillus subtilis*] | UniRef100_P96695 | *Bacillus subtilis* | YdfQ |
| 2678 | Hypothetical Membrane Spanning Protein [*Bacillus cereus*] | UniRef100_Q813Y5 | *Bacillus cereus* | YrkJ |
| 2679 | Hypothetical UPF0033 protein yrkI [*Bacillus subtilis*] | UniRef100_P54436 | *Bacillus subtilis* | |
| 2680 | UPI00003CB3C6 UniRef100 entry | | UniRef100_UPI00003CB3C6 | YrkH |
| 2681 | Molybdopterin biosynthesis MoeB protein [*Bacillus cereus*] | UniRef100_Q81HL2 | *Bacillus cereus* | YrkF |
| 2682 | Hypothetical protein yrkE [*Bacillus subtilis*] | UniRef100_P54432 | *Bacillus subtilis* | YrkE |
| 2683 | Hypothetical conserved protein [*Oceanobacillus iheyensis*] | UniRef100_Q8EN37 | *Oceanobacillus iheyensis* | |
| 2684 | S-adenosylmethionine-dependent methyltransferase [*Clostridium acetobutylicum*] | UniRef100_Q97FB3 | *Clostridium acetobutylicum* | YcgJ |
| 2685 | Hypothetical protein [*Bacillus anthracis*] | UniRef100_Q81N81 | *Bacillus anthracis* | |
| 2686 | YciB protein [*Bacillus subtilis*] | UniRef100_P94399 | *Bacillus subtilis* | |
| 2687 | Acetylxylan esterase related enzyme [*Clostridium acetobutylicum*] | UniRef100_Q97LM8 | *Clostridium acetobutylicum* | |
| 2688 | Hypothetical UPF0161 protein BCE4947 [*Bacillus cereus*] | UniRef100_P61464 | *Bacillus cereus* | |
| 2689 | Delta-aminolevulinic acid dehydratase [*Bacillus halodurans*] | UniRef100_Q9K8G2 | *Bacillus halodurans* | |
| 2690 | 6-phospho-3-hexuloisomerase [*Bacillus methanolicus*] | UniRef100_Q6TV53 | *Bacillus methanolicus* | HxlB |
| 2691 | Probable hexulose-6-phosphate synthase [*Bacillus subtilis*] | UniRef100_P42405 | *Bacillus subtilis* | HxlA |
| 2692 | Transcriptional regulator [*Bacillus amyloliquefaciens*] | UniRef100_Q70KJ9 | *Bacillus amyloliquefaciens* | HxlR |
| 2693 | Fatty acid desaturase [*Bacillus subtilis*] | UniRef100_O34653 | *Bacillus subtilis* | Des |
| 2694 | Sensor kinase [*Bacillus subtilis*] | UniRef100_O34757 | *Bacillus subtilis* | YocF |
| 2695 | Sensor regulator [*Bacillus subtilis*] | UniRef100_O34723 | *Bacillus subtilis* | YocG |
| 2696 | UPI00003CC1E4 UniRef100 entry | | UniRef100_UPI00003CC1E4 | YcgT |
| 2697 | Nickel transport system [*Bacillus halodurans*] | UniRef100_Q9KFB8 | *Bacillus halodurans* | AppA |
| 2698 | Nickel transport system [*Bacillus halodurans*] | UniRef100_Q9KFB7 | *Bacillus halodurans* | AppB |
| 2699 | Nickel transport system [*Bacillus halodurans*] | UniRef100_Q9KFB6 | *Bacillus halodurans* | AppC |
| 2700 | Oligopeptide ABC transporter [*Bacillus halodurans*] | UniRef100_Q9KFB5 | *Bacillus halodurans* | DppD |
| 2701 | Oligopeptide ABC transporter [*Bacillus halodurans*] | UniRef100_Q9KFB4 | *Bacillus halodurans* | AppF |
| 2702 | UPI00003CB880 UniRef100 entry | | UniRef100_UPI00003CB880 | YdfL |
| 2703 | UPI00003CA374 UniRef100 entry | | UniRef100_UPI00003CA374 | YoeA |
| 2704 | PROBABLE TRANSCRIPTION REGULATOR PROTEIN [*Ralstonia solanacearum*] | UniRef100_Q8XS91 | *Ralstonia solanacearum* | |
| 2705 | Short chain dehydrogenase family protein [*Enterococcus faecalis*] | UniRef100_Q83AI5 | *Enterococcus faecalis* | YvaG |
| 2706 | Uncharacterized protein, containing predicted phosphatase domain [*Clostridium acetobutylicum*] | UniRef100_Q97L24 | *Clostridium acetobutylicum* | |
| 2707 | UPI000025758C UniRef100 entry | | UniRef100_UPI000025758C | PnbA |
| 2708 | Cytochrome P450 [*Bacillus subtilis*] | UniRef100_O08469 | *Bacillus subtilis* | CypA |
| 2709 | YtnM [*Bacillus subtilis*] | UniRef100_O34430 | *Bacillus subtilis* | YtnM |
| 2710 | Hypothetical protein yndA precursor [*Bacillus subtilis*] | UniRef100_O31805 | *Bacillus subtilis* | YndA |
| 2711 | YvaG protein [*Bacillus subtilis*] | UniRef100_O32229 | *Bacillus subtilis* | YvaG |

TABLE 1-continued

Predicted functions

| SEQ ID NO. | Description | UniRef Accession No. | Organism | Bacillus subtilis homolog (Gene Name) |
|---|---|---|---|---|
| 2712 | Levanase precursor [*Bacillus subtilis*] | UniRef100_P05656 | *Bacillus subtilis* | SacC |
| 2713 | PTS system, fructose-specific IID component [*Bacillus subtilis*] | UniRef100_P26382 | *Bacillus subtilis* | LevG |
| 2714 | PTS system, fructose-specific IIC component [*Bacillus subtilis*] | UniRef100_P26381 | *Bacillus subtilis* | LevF |
| 2715 | PTS system, fructose-specific IIB component [*Bacillus subtilis*] | UniRef100_P26380 | *Bacillus subtilis* | LevE |
| 2716 | PTS system, fructose-specific IIA component [*Bacillus subtilis*] | UniRef100_P26379 | *Bacillus subtilis* | LevD |
| 2717 | Transcriptional regulatory protein levR [*Bacillus subtilis*] | UniRef100_P23914 | *Bacillus subtilis* | LevR |
| 2718 | Hypothetical protein [*Bacillus cereus*] | UniRef100_Q734Q5 | *Bacillus cereus* | |
| 2719 | Hypothetical protein yrhK [*Bacillus subtilis*] | UniRef100_O05401 | *Bacillus subtilis* | |
| 2720 | UPI00003CB785 UniRef100 entry | | UniRef100_UPI00003CB785 | |
| 2721 | | | | AdaA |
| 2722 | Methylated-DNA-protein-cysteine S-methyltransferase [*Bacillus cereus*] | UniRef100_Q732Y7 | *Bacillus cereus* | AdaB |
| 2723 | Oxidoreductase, aldo/keto reductase family [*Bacillus thuringiensis*] | UniRef100_Q6HBJ5 | *Bacillus thuringiensis* | YtbE |
| 2724 | | | | YtbD |
| 2725 | Hypothetical UPF0087 protein ytcD [*Bacillus subtilis*] | UniRef100_O34533 | *Bacillus subtilis* | YtcD |
| 2726 | | | | |
| 2727 | Hypothetical protein yjjA [*Bacillus subtilis*] | UniRef100_O34394 | *Bacillus subtilis* | YjjA |
| 2728 | UPI000028298B UniRef100 entry | | UniRef100_UPI000028298B | |
| 2729 | | | | YxeB |
| 2730 | Putative HTH-type transcriptional regulator yybE [*Bacillus subtilis*] | UniRef100_P37499 | *Bacillus subtilis* | YybE |
| 2731 | Hypothetical transport protein yybF [*Bacillus subtilis*] | UniRef100_P37498 | *Bacillus subtilis* | YybF |
| 2732 | Hypothetical protein [*Bacillus cereus*] | UniRef100_Q732J0 | *Bacillus cereus* | |
| 2733 | Probable bifunctional P-450: NADPH-P450 reductase 2 [Includes: Cytochrome P450 102 (EC 1.14.14.1); NADPH--cytochrome P450 reductase (EC 1.6.2.4)] [*Bacillus subtilis*] | UniRef100_O08336 | Includes: Cytochrome P450 102 (EC 1.14.14.1); NADPH--cytochrome P450 reductase (EC 1.6.2.4) | YrhJ |
| 2734 | Regulatory protein [*Bacillus subtilis*] | UniRef100_O08335 | *Bacillus subtilis* | YrhI |
| 2735 | | | | WprA |
| 2736 | YrhH [*Bacillus subtilis*] | UniRef100_O05400 | *Bacillus subtilis* | YrhH |
| 2737 | | | | |
| 2738 | | | | |
| 2739 | | | | |
| 2740 | Cystathionine gamma-lyase [*Bacillus subtilis*] | UniRef100_O05394 | *Bacillus subtilis* | YrhB |
| 2741 | Cysteine synthase [*Bacillus subtilis*] | UniRef100_O05393 | *Bacillus subtilis* | YrhA |
| 2742 | MTA/SAH nucleosidase [*Bacillus subtilis*] | UniRef100_O32028 | *Bacillus subtilis* | Mtn |
| 2743 | YrrT protein [*Bacillus subtilis*] | UniRef100_O32029 | *Bacillus subtilis* | YrrT |
| 2744 | Hypothetical protein yrzA [*Bacillus subtilis*] | UniRef100_O32030 | *Bacillus subtilis* | |
| 2745 | | | | YrrS |
| 2746 | YrrR protein [*Bacillus subtilis*] | UniRef100_O32032 | *Bacillus subtilis* | YrrR |
| 2747 | Transcription elongation factor greA [*Bacillus subtilis*] | UniRef100_P80240 | *Bacillus subtilis* | GreA |
| 2748 | Uridine kinase [*Bacillus subtilis*] | UniRef100_O32033 | *Bacillus subtilis* | Udk |
| 2749 | YrrO protein [*Bacillus subtilis*] | UniRef100_O32034 | *Bacillus subtilis* | YrrO |
| 2750 | YrrN protein [*Bacillus subtilis*] | UniRef100_O32035 | *Bacillus subtilis* | YrrN |
| 2751 | YrrM protein [*Bacillus subtilis*] | UniRef100_O32036 | *Bacillus subtilis* | YrrM |
| 2752 | YrrL protein [*Bacillus subtilis*] | UniRef100_O34758 | *Bacillus subtilis* | YrrL |
| 2753 | YrzB protein [*Bacillus subtilis*] | UniRef100_O34828 | *Bacillus subtilis* | |
| 2754 | Putative Holliday junction resolvase [*Bacillus subtilis*] | UniRef100_O34634 | *Bacillus subtilis* | YrrK |
| 2755 | Hypothetical UPF0297 protein yrzL [*Bacillus subtilis*] | UniRef100_Q7WY61 | *Bacillus subtilis* | |
| 2756 | Alanyl-tRNA synthetase [*Bacillus subtilis*] | UniRef100_O34526 | *Bacillus subtilis* | AlaS |

TABLE 1-continued

Predicted functions

| SEQ ID NO. | Description | UniRef Accession No. | Organism | Bacillus subtilis homolog (Gene Name) |
|---|---|---|---|---|
| 2757 | Hypothetical UPF0118 protein yrrI [Bacillus subtilis] | UniRef100_O34472 | Bacillus subtilis | YrrI |
| 2758 | | | | |
| 2759 | Hypothetical protein [Bacillus cereus ZK] | UniRef100_Q634F2 | Bacillus cereus ZK | |
| 2760 | YrrD protein [Bacillus subtilis] | UniRef100_O34402 | Bacillus subtilis | YrrD |
| 2761 | YrrC protein [Bacillus subtilis] | UniRef100_O34481 | Bacillus subtilis | YrrC |
| 2762 | YrrB protein [Bacillus subtilis] | UniRef100_O34452 | Bacillus subtilis | YrrB |
| 2763 | Probable tRNA (5-methylaminomethyl-2-thiouridylate)-methyltransferase [Bacillus subtilis] | UniRef100_O35020 | Bacillus subtilis | TrmU |
| 2764 | YrvO protein [Bacillus subtilis] | UniRef100_O34599 | Bacillus subtilis | YrvO |
| 2765 | BH1259 protein [Bacillus halodurans] | UniRef100_Q9KDF4 | Bacillus halodurans | |
| 2766 | YrvN protein [Bacillus subtilis] | UniRef100_O34528 | Bacillus subtilis | YrvN |
| 2767 | YrvM protein [Bacillus subtilis] | UniRef100_O32037 | Bacillus subtilis | YrvM |
| 2768 | Aspartyl-tRNA synthetase [Bacillus subtilis] | UniRef100_O32038 | Bacillus subtilis | AspS |
| 2769 | Histidyl-tRNA synthetase [Bacillus subtilis] | UniRef100_O32039 | Bacillus subtilis | HisS |
| 2770 | | | | |
| 2771 | | | | YrvJ |
| 2772 | Putative D-tyrosyl-tRNA(Tyr) deacylase-like protein [Bacillus subtilis] | UniRef100_O32042 | Bacillus subtilis | YrvI |
| 2773 | GTP pyrophosphokinase (EC 2.7.6.5) (ATP:GTP 3'-pyrophosphotransferase) (ppGpp synthetase I) ((P)ppGpp synthetase) [Bacillus subtilis] | UniRef100_O54408 | Bacillus subtilis | RelA |
| 2774 | Adenine phosphoribosyltransferase [Bacillus subtilis] | UniRef100_O34443 | Bacillus subtilis | Apt |
| 2775 | YrvE protein [Bacillus subtilis] | UniRef100_O32044 | Bacillus subtilis | YrvE |
| 2776 | YrvD protein [Bacillus subtilis] | UniRef100_O32045 | Bacillus subtilis | |
| 2777 | SecDF protein [Bacillus subtilis] | UniRef100_O32047 | Bacillus subtilis | SecDF |
| 2778 | YrzD protein [Bacillus subtilis] | UniRef100_O32049 | Bacillus subtilis | |
| 2779 | | | | SpoVB |
| 2780 | Hypothetical protein yrbG [Bacillus subtilis] | UniRef100_O32050 | Bacillus subtilis | YrbG |
| 2781 | YrzE protein [Bacillus subtilis] | UniRef100_O32051 | Bacillus subtilis | YrzE |
| 2782 | Hypothetical UPF0092 protein yrbF [Bacillus subtilis] | UniRef100_O32052 | Bacillus subtilis | |
| 2783 | Queuine tRNA-ribosyltransferase [Bacillus subtilis] | UniRef100_O32053 | Bacillus subtilis | Tgt |
| 2784 | S-adenosylmethionine:tRNA ribosyltransferase-isomerase [Bacillus subtilis] | UniRef100_O32054 | Bacillus subtilis | QueA |
| 2785 | | | | |
| 2786 | Holliday junction DNA helicase ruvB [Bacillus subtilis] | UniRef100_O32055 | Bacillus subtilis | RuvB |
| 2787 | Holliday junction DNA helicase ruvA [Bacillus subtilis] | UniRef100_O05392 | Bacillus subtilis | RuvA |
| 2788 | BofC protein precursor [Bacillus subtilis] | UniRef100_O05391 | Bacillus subtilis | BofC |
| 2789 | Hypothetical conserved protein [Oceanobacillus iheyensis] | UniRef100_Q8ERL7 | Oceanobacillus iheyensis | YrzF |
| 2790 | | | | |
| 2791 | Small, acid-soluble spore protein H [Bacillus halodurans] | UniRef100_Q9KB75 | Bacillus halodurans | |
| 2792 | Hypothetical protein yjoA [Bacillus subtilis] | UniRef100_O34334 | Bacillus subtilis | YjoA |
| 2793 | YmaC protein [Bacillus subtilis] | UniRef100_O31789 | Bacillus subtilis | YmaC |
| 2794 | | | | |
| 2795 | | | | |
| 2796 | Hypothetical UPF0082 protein yrbC [Bacillus subtilis] | UniRef100_P94447 | Bacillus subtilis | YrbC |
| 2797 | Sporulation cortex protein coxA [Bacillus subtilis] | UniRef100_P94446 | Bacillus subtilis | CoxA |
| 2798 | Morphogenetic protein associated with SpoVID [Bacillus subtilis] | UniRef100_O32062 | Bacillus subtilis | SafA |
| 2799 | Quinolinate synthetase A [Bacillus subtilis] | UniRef100_Q9KWZ1 | Bacillus subtilis | NadA |

TABLE 1-continued

Predicted functions

| SEQ ID NO. | Description | UniRef Accession No. | Organism | Bacillus subtilis homolog (Gene Name) |
|---|---|---|---|---|
| 2800 | Probable nicotinate-nucleotide pyrophosphorylase [carboxylating] [Bacillus subtilis] | UniRef100_P39666 | carboxylating | NadC |
| 2801 | L-aspartate oxidase [Bacillus subtilis] | UniRef100_P38032 | Bacillus subtilis | NadB |
| 2802 | Probable cysteine desulfurase [Bacillus subtilis] | UniRef100_P38033 | Bacillus subtilis | NifS |
| 2803 | | | | YrxA |
| 2804 | Prephenate dehydratase [Bacillus subtilis] | UniRef100_P21203 | Bacillus subtilis | PheA |
| 2805 | ACT domain protein pheB [Bacillus subtilis] | UniRef100_P21204 | Bacillus subtilis | PheB |
| 2806 | Spo0B-associated GTP-binding protein [Bacillus amyloliquefaciens] | UniRef100_Q659J4 | Bacillus amyloliquefaciens | Obg |
| 2807 | Sporulation initiation phosphotransferase B [Bacillus subtilis] | UniRef100_P06535 | Bacillus subtilis | Spo0B |
| 2808 | 50S ribosomal protein L27 [Bacillus subtilis] | UniRef100_P05657 | Bacillus subtilis | |
| 2809 | | | | |
| 2810 | 50S ribosomal protein L21 [Bacillus subtilis] | UniRef100_P26908 | Bacillus subtilis | RplU |
| 2811 | Stage IV sporulation protein FB [Bacillus subtilis] | UniRef100_P26937 | Bacillus subtilis | SpoIVFB |
| 2812 | Stage IV sporulation protein FA [Bacillus subtilis] | UniRef100_P26936 | Bacillus subtilis | SpoIVFA |
| 2813 | Hypothetical protein [Bacillus cereus] | UniRef100_Q816V6 | Bacillus cereus | YndB |
| 2814 | Transcriptional regulator, ArsR family [Bacillus cereus ZK] | UniRef100_Q632Y0 | Bacillus cereus ZK | |
| 2815 | Septum site-determining protein minD [Bacillus subtilis] | UniRef100_Q01464 | Bacillus subtilis | MinD |
| 2816 | | | | MinC |
| 2817 | Rod shape-determining protein mreD [Bacillus subtilis] | UniRef100_Q01467 | Bacillus subtilis | MreD |
| 2818 | Rod shape-determining protein mreC [Bacillus subtilis] | UniRef100_Q01466 | Bacillus subtilis | MreC |
| 2819 | Rod shape-determining protein mreB [Bacillus subtilis] | UniRef100_Q01465 | Bacillus subtilis | MreB |
| 2820 | DNA repair protein radC homolog [Bacillus subtilis] | UniRef100_Q02170 | Bacillus subtilis | RadC |
| 2821 | Septum formation protein Maf [Bacillus subtilis] | UniRef100_Q02169 | Bacillus subtilis | Maf |
| 2822 | Stage II sporulation protein B [Bacillus subtilis] | UniRef100_P37575 | Bacillus subtilis | SpoIIB |
| 2823 | Type 4 prepilin-like proteins leader peptide processing enzyme (Late competence protein comC) [Includes: Leader peptidase (EC 3.4.23.43) (Prepilin peptidase); N-methyltransferase (EC 2.1.1.—)] [Bacillus subtilis] | UniRef100_P15378 | Includes: Leader peptidase (EC 3.4.23.43) (Prepilin peptidase); N-methyltransferase (EC 2.1.1.—) | ComC |
| 2824 | | | | FolC |
| 2825 | Valyl-tRNA synthetase [Bacillus subtilis] | UniRef100_Q05873 | Bacillus subtilis | ValS |
| 2826 | Hypothetical protein OB2062 [Oceanobacillus iheyensis] | UniRef100_Q8EPN1 | Oceanobacillus iheyensis | |
| 2827 | Hypothetical protein ysxE [Bacillus subtilis] | UniRef100_P37964 | Bacillus subtilis | YsxE |
| 2828 | Stage VI sporulation protein D [Bacillus subtilis] | UniRef100_P37963 | Bacillus subtilis | SpoVID |
| 2829 | Glutamate-1-semialdehyde 2,1-aminomutase [Bacillus subtilis] | UniRef100_P30949 | Bacillus subtilis | HemL |
| 2830 | Delta-aminolevulinic acid dehydratase [Bacillus subtilis] | UniRef100_P30950 | Bacillus subtilis | HemB |
| 2831 | Uroporphyrinogen-III synthase [Bacillus subtilis] | UniRef100_P21248 | Bacillus subtilis | HemD |
| 2832 | Porphobilinogen deaminase [Bacillus subtilis] | UniRef100_P16616 | Bacillus subtilis | HemC |
| 2833 | Protein hemX [Bacillus subtilis] | UniRef100_P16645 | Bacillus subtilis | HemX |
| 2834 | Glutamyl-tRNA reductase [Bacillus subtilis] | UniRef100_P16618 | Bacillus subtilis | HemA |
| 2835 | Hypothetical protein ysxD [Bacillus subtilis] | UniRef100_P40736 | Bacillus subtilis | YsxD |

TABLE 1-continued

Predicted functions

| SEQ ID NO. | Description | UniRef Accession No. | Organism | Bacillus subtilis homolog (Gene Name) |
|---|---|---|---|---|
| 2836 | Probable GTP-binding protein engB [Bacillus subtilis] | UniRef100_P38424 | Bacillus subtilis | YsxC |
| 2837 | ATP-dependent protease La 1 [Bacillus subtilis] | UniRef100_P37945 | Bacillus subtilis | LonA |
| 2838 | ATP-dependent protease La homolog [Bacillus subtilis] | UniRef100_P42425 | Bacillus subtilis | LonB |
| 2839 | ATP-dependent Clp protease ATP-binding subunit clpX [Bacillus subtilis] | UniRef100_P50866 | Bacillus subtilis | ClpX |
| 2840 | Trigger factor [Bacillus subtilis] | UniRef100_P80698 | Bacillus subtilis | Tig |
| 2841 | Hypothetical protein ysoA [Bacillus subtilis] | UniRef100_P94569 | Bacillus subtilis | YsoA |
| 2842 | 3-isopropylmalate dehydratase small subunit [Bacillus subtilis] | UniRef100_P94568 | Bacillus subtilis | LeuD |
| 2843 | 3-isopropylmalate dehydratase large subunit [Bacillus subtilis] | UniRef100_P80858 | Bacillus subtilis | LeuC |
| 2844 | | | | LeuB |
| 2845 | 2-isopropylmalate synthase [Bacillus subtilis] | UniRef100_P94565 | Bacillus subtilis | LeuA |
| 2846 | Ketol-acid reductoisomerase [Bacillus subtilis] | UniRef100_P37253 | Bacillus subtilis | IlvC |
| 2847 | Acetolactate synthase small subunit [Bacillus subtilis] | UniRef100_P37252 | Bacillus subtilis | IlvH |
| 2848 | Acetolactate synthase large subunit [Bacillus subtilis] | UniRef100_P37251 | Bacillus subtilis | IlvB |
| 2849 | Branched-chain amino acid aminotransferase [Bacillus thuringiensis] | UniRef100_Q6HLF7 | Bacillus thuringiensis | Dat |
| 2850 | | | | |
| 2851 | | | | RocG |
| 2852 | BH3337 protein [Bacillus halodurans] | UniRef100_Q9K7M4 | Bacillus halodurans | |
| 2853 | | | | YxeD |
| 2854 | Hypothetical protein yqbA [Bacillus subtilis] | UniRef100_P45917 | Bacillus subtilis | |
| 2855 | Hypothetical protein yqaT [Bacillus subtilis] | UniRef100_P45916 | Bacillus subtilis | YqaT |
| 2856 | Lin1266 protein [Listeria innocua] | UniRef100_Q92CC3 | Listeria innocua | |
| 2857 | Lin1733 protein [Listeria innocua] | UniRef100_Q92B18 | Listeria innocua | |
| 2858 | | | | |
| 2859 | | | | |
| 2860 | | | | |
| 2861 | | | | MtbP |
| 2862 | BH3535 protein [Bacillus halodurans] | UniRef100_Q9K738 | Bacillus halodurans | |
| 2863 | | | | YeeF |
| 2864 | | | | YxiD |
| 2865 | | | | RapI |
| 2866 | | | | |
| 2867 | | | | |
| 2868 | | | | |
| 2869 | Hypothetical UPF0025 protein ysnB [Bacillus subtilis] | UniRef100_P94559 | Bacillus subtilis | YsnB |
| 2870 | HAM1 protein homolog [Bacillus subtilis] | UniRef100_P94558 | Bacillus subtilis | YsnA |
| 2871 | | | | Rph |
| 2872 | Germination protein gerM [Bacillus subtilis] | UniRef100_P39072 | Bacillus subtilis | GerM |
| 2873 | | | | RacE |
| 2874 | Hypothetical protein ysmB [Bacillus subtilis] | UniRef100_P97247 | Bacillus subtilis | YsmB |
| 2875 | Germination protein gerE [Bacillus subtilis] | UniRef100_P11470 | Bacillus subtilis | |
| 2876 | Oxidoreductase [Clostridium acetobutylicum] | UniRef100_Q97TP7 | Clostridium acetobutylicum | YqjQ |
| 2877 | Hypothetical protein ysmA [Bacillus subtilis] | UniRef100_Q6L874 | Bacillus subtilis | YsmA |
| 2878 | Succinate dehydrogenase iron-sulfur protein [Bacillus subtilis] | UniRef100_P08066 | Bacillus subtilis | SdhB |
| 2879 | | | | SdhA |
| 2880 | | | | |
| 2881 | Succinate dehydrogenase cytochrome B-558 subunit [Bacillus subtilis] | UniRef100_P08064 | Bacillus subtilis | SdhC |

TABLE 1-continued

Predicted functions

| SEQ ID NO. | Description | UniRef Accession No. | Organism | Bacillus subtilis homolog (Gene Name) |
|---|---|---|---|---|
| 2882 | Hypothetical protein yslB [Bacillus subtilis] | UniRef100_P42955 | Bacillus subtilis | YslB |
| 2883 | Aspartokinase 2 (EC 2.7.2.4) (Aspartokinase II) (Aspartate kinase 2) [Contains: Aspartokinase II alpha subunit; Aspartokinase II beta subunit] [Bacillus subtilis] | UniRef100_P08495 | Contains: Aspartokinase II alpha subunit; Aspartokinase II beta subunit | LysC |
| 2884 | UvrABC system protein C [Bacillus subtilis] | UniRef100_P14951 | Bacillus subtilis | UvrC |
| 2885 | Thioredoxin [Bacillus subtilis] | UniRef100_P14949 | Bacillus subtilis | TrxA |
| 2886 | Electron transfer flavoprotein alpha-subunit [Bacillus subtilis] | UniRef100_P94551 | Bacillus subtilis | EtfA |
| 2887 | Electron transfer flavoprotein beta-subunit [Bacillus subtilis] | UniRef100_P94550 | Bacillus subtilis | EtfB |
| 2888 | Hypothetical protein ysiB [Bacillus subtilis] | UniRef100_P94549 | Bacillus subtilis | YsiB |
| 2889 | Hypothetical protein ysiA [Bacillus subtilis] | UniRef100_P94548 | Bacillus subtilis | YsiA |
| 2890 | Long-chain-fatty-acid-CoA ligase [Bacillus subtilis] | UniRef100_P94547 | Bacillus subtilis | LcfA |
| 2891 | Hypothetical protein yshE [Bacillus subtilis] | UniRef100_P94546 | Bacillus subtilis | YshE |
| 2892 | MutS2 protein [Bacillus subtilis] | UniRef100_P94545 | Bacillus subtilis | MutSB |
| 2893 | Hypothetical protein yshC [Bacillus subtilis] | UniRef100_P94544 | Bacillus subtilis | YshC |
| 2894 | | | | YshB |
| 2895 | | | | |
| 2896 | Ribonuclease HIII [Bacillus subtilis] | UniRef100_P94541 | Bacillus subtilis | RnhC |
| 2897 | | | | |
| 2898 | | | | |
| 2899 | | | | |
| 2900 | | | | |
| 2901 | | | | YxlF |
| 2902 | | | | |
| 2903 | Phenylalanyl-tRNA synthetase beta chain [Bacillus subtilis] | UniRef100_P17922 | Bacillus subtilis | PheT |
| 2904 | Phenylalanyl-tRNA synthetase alpha chain [Bacillus amyloliquefaciens] | UniRef100_Q659J3 | Bacillus amyloliquefaciens | PheS |
| 2905 | Hypothetical protein ysgA [Bacillus subtilis] | UniRef100_P94538 | Bacillus subtilis | YsgA |
| 2906 | Small, acid-soluble spore protein I [Bacillus subtilis] | UniRef100_P94537 | Bacillus subtilis | |
| 2907 | Carbon starvation protein A homolog [Bacillus subtilis] | UniRef100_P94532 | Bacillus subtilis | CstA |
| 2908 | Alpha-N-arabinofuranosidase [Bacillus stearothermophilus] | UniRef100_Q9XBQ3 | Bacillus stearothermophilus | AbfA |
| 2909 | L-arabinose transport system permease protein araQ [Bacillus subtilis] | UniRef100_P94530 | Bacillus subtilis | AraQ |
| 2910 | L-arabinose transport system permease protein araP [Bacillus subtilis] | UniRef100_P94529 | Bacillus subtilis | AraP |
| 2911 | Probable arabinose-binding protein precursor [Bacillus subtilis] | UniRef100_P94528 | Bacillus subtilis | AraN |
| 2912 | Arabinose operon protein araM [Bacillus subtilis] | UniRef100_P94527 | Bacillus subtilis | AraM |
| 2913 | L-ribulose-5-phosphate 4-epimerase [Bacillus subtilis] | UniRef100_P94525 | Bacillus subtilis | AraD |
| 2914 | Ribulokinase [Bacillus subtilis] | UniRef100_P94524 | Bacillus subtilis | AraB |
| 2915 | L-arabinose isomerase [Bacillus subtilis] | UniRef100_P94523 | Bacillus subtilis | AraA |
| 2916 | | | | AbnA |
| 2917 | Hypothetical protein ysdC [Bacillus subtilis] | UniRef100_P94521 | Bacillus subtilis | YsdC |
| 2918 | Hypothetical protein ysdB [Bacillus subtilis] | UniRef100_P94520 | Bacillus subtilis | YsdB |
| 2919 | Hypothetical protein ysdA [Bacillus subtilis] | UniRef100_P94519 | Bacillus subtilis | |
| 2920 | 50S ribosomal protein L20 [Bacillus subtilis] | UniRef100_P55873 | Bacillus subtilis | RplT |

TABLE 1-continued

Predicted functions

| SEQ ID NO. | Description | UniRef Accession No. | Organism | Bacillus subtilis homolog (Gene Name) |
|---|---|---|---|---|
| 2921 | 50S ribosomal protein L35 [Bacillus subtilis] | UniRef100_P55874 | Bacillus subtilis | |
| 2922 | | | | InfC |
| 2923 | Antiholin-like protein IrgB [Bacillus subtilis] | UniRef100_P94516 | Bacillus subtilis | YsbB |
| 2924 | Antiholin-like protein IrgA [Bacillus subtilis] | UniRef100_P94515 | Bacillus subtilis | YsbA |
| 2925 | | | | PhoD |
| 2926 | Sensory transduction protein lytT [Bacillus subtilis] | UniRef100_P94514 | Bacillus subtilis | LytT |
| 2927 | Sensor protein lytS [Bacillus subtilis] | UniRef100_P94513 | Bacillus subtilis | LytS |
| 2928 | Hypothetical protein [Bacillus anthracis] | UniRef100_Q81N00 | Bacillus anthracis | |
| 2929 | Hypothetical protein ysaA [Bacillus subtilis] | UniRef100_P94512 | Bacillus subtilis | YsaA |
| 2930 | Threonyl-tRNA synthetase 1 [Bacillus subtilis] | UniRef100_P18255 | Bacillus subtilis | ThrS |
| 2931 | Hypothetical protein ytxC [Bacillus subtilis] | UniRef100_P06569 | Bacillus subtilis | YtxC |
| 2932 | Hypothetical UPF0043 protein ytxB [Bacillus subtilis] | UniRef100_P06568 | Bacillus subtilis | YtxB |
| 2933 | Primosomal protein dnaI [Bacillus subtilis] | UniRef100_P06567 | Bacillus subtilis | DnaI |
| 2934 | Replication initiation and membrane attachment protein [Bacillus subtilis] | UniRef100_P07908 | Bacillus subtilis | DnaB |
| 2935 | Hypothetical UPF0168 protein ytcG [Bacillus subtilis] | UniRef100_Q45549 | Bacillus subtilis | YtcG |
| 2936 | | | | |
| 2937 | | | | SpeD |
| 2938 | | | | GapB |
| 2939 | Pectin lyase [Bacillus subtilis] | UniRef100_P94449 | Bacillus subtilis | PelB |
| 2940 | Dephospho-CoA kinase [Bacillus subtilis] | UniRef100_O34932 | Bacillus subtilis | YtaG |
| 2941 | | | | YtaF |
| 2942 | Formamidopyrimidine-DNA glycosylase [Bacillus subtilis] | UniRef100_O34403 | Bacillus subtilis | MutM |
| 2943 | DNA polymerase I [Bacillus subtilis] | UniRef100_O34996 | Bacillus subtilis | PolA |
| 2944 | Alkaline phosphatase synthesis sensor protein phoR [Bacillus subtilis] | UniRef100_P23545 | Bacillus subtilis | PhoR |
| 2945 | Alkaline phosphatase synthesis transcriptional regulatory protein phoP [Bacillus subtilis] | UniRef100_P13792 | Bacillus subtilis | PhoP |
| 2946 | Malate dehydrogenase [Bacillus subtilis] | UniRef100_P49814 | Bacillus subtilis | Mdh |
| 2947 | Isocitrate dehydrogenase [NADP] [Bacillus subtilis] | UniRef100_P39126 | NADP | Icd |
| 2948 | Citrate synthase II [Bacillus subtilis] | UniRef100_P39120 | Bacillus subtilis | CitZ |
| 2949 | YtwI [Bacillus subtilis] | UniRef100_O34811 | Bacillus subtilis | YtwI |
| 2950 | Hypothetical UPF0118 protein ytvI [Bacillus subtilis] | UniRef100_O34991 | Bacillus subtilis | YtvI |
| 2951 | YtzA protein [Bacillus subtilis] | UniRef100_O32064 | Bacillus subtilis | YtzA |
| 2952 | | | | Pyk |
| 2953 | 6-phosphofructokinase [Bacillus subtilis] | UniRef100_O34529 | Bacillus subtilis | PfkA |
| 2954 | Acetyl-coenzyme A carboxylase carboxyl transferase subunit alpha [Bacillus subtilis] | UniRef100_O34847 | Bacillus subtilis | AccA |
| 2955 | Acetyl-CoA carboxylase subunit [Bacillus subtilis] | UniRef100_O34571 | Bacillus subtilis | AccD |
| 2956 | | | | YtsJ |
| 2957 | DNA polymerase III alpha subunit [Bacillus subtilis] | UniRef100_O34623 | Bacillus subtilis | DnaE |
| 2958 | Hypothetical Membrane Spanning Protein [Bacillus cereus] | UniRef100_Q812P3 | Bacillus cereus | |
| 2959 | YtrI [Bacillus subtilis] | UniRef100_O34460 | Bacillus subtilis | YtrI |
| 2960 | BH3172 protein [Bacillus halodurans] | UniRef100_Q9K835 | Bacillus halodurans | |
| 2961 | YtqI [Bacillus subtilis] | UniRef100_O34600 | Bacillus subtilis | YtqI |
| 2962 | YtpI [Bacillus subtilis] | UniRef100_O34922 | Bacillus subtilis | |
| 2963 | | | | YtoI |
| 2964 | | | | PadR |
| 2965 | YtkL protein [Bacillus subtilis] | UniRef100_Q795U4 | Bacillus subtilis | YtkL |
| 2966 | | | | YtkK |

TABLE 1-continued

Predicted functions

| SEQ ID NO. | Description | UniRef Accession No. | Organism | Bacillus subtilis homolog (Gene Name) |
|---|---|---|---|---|
| 2967 | | | | |
| 2968 | Argininosuccinate lyase [*Bacillus subtilis*] | UniRef100_O34858 | *Bacillus subtilis* | ArgH |
| 2969 | Argininosuccinate synthase [*Bacillus subtilis*] | UniRef100_O34347 | *Bacillus subtilis* | ArgG |
| 2970 | Molybdenum cofactor biosynthesis protein B [*Bacillus subtilis*] | UniRef100_O34457 | *Bacillus subtilis* | MoaB |
| 2971 | | | | AckA |
| 2972 | Hypothetical protein ytxK [*Bacillus subtilis*] | UniRef100_P37876 | *Bacillus subtilis* | YtxK |
| 2973 | Probable thiol peroxidase [*Bacillus subtilis*] | UniRef100_P80864 | *Bacillus subtilis* | Tpx |
| 2974 | YtfJ [*Bacillus subtilis*] | UniRef100_O34806 | *Bacillus subtilis* | YtfJ |
| 2975 | | | | YtfI |
| 2976 | YteJ [*Bacillus subtilis*] | UniRef100_O34424 | *Bacillus subtilis* | YteJ |
| 2977 | Putative signal peptide peptidase sppA [*Bacillus subtilis*] | UniRef100_O34525 | *Bacillus subtilis* | SppA |
| 2978 | Probable inorganic polyphosphate/ATP-NAD kinase 2 (EC 2.7.1.23) (Poly(P)/ATP NAD kinase 2) [*Bacillus subtilis*] | UniRef100_O34934 | *Bacillus subtilis* | YtdI |
| 2979 | YhbJ protein [*Bacillus subtilis*] | UniRef100_O31593 | *Bacillus subtilis* | YhbJ |
| 2980 | Multidrug resistance protein [*Staphylococcus epidermidis*] | UniRef100_Q8CQB1 | *Staphylococcus epidermidis* | YubD |
| 2981 | Putative HTH-type transcriptional regulator yxaD [*Bacillus subtilis*] | UniRef100_P42103 | *Bacillus subtilis* | YxaD |
| 2982 | YtcI [*Bacillus subtilis*] | UniRef100_O34613 | *Bacillus subtilis* | YtcI |
| 2983 | Small, acid-soluble spore protein 1 [*Bacillus stearothermophilus*] | UniRef100_P06552 | *Bacillus stearothermophilus* | |
| 2984 | Probable thiamine biosynthesis protein thiI [*Bacillus subtilis*] | UniRef100_O34595 | *Bacillus subtilis* | YtbJ |
| 2985 | NifS2 [*Bacillus subtilis*] | UniRef100_O34874 | *Bacillus subtilis* | NifZ |
| 2986 | Branched-chain amino acid transport system carrier protein braB [*Bacillus subtilis*] | UniRef100_O34545 | *Bacillus subtilis* | BraB |
| 2987 | IS1627s1-related, transposase [*Bacillus anthracis* str. A2012] | UniRef100_Q7CMD0 | *Bacillus anthracis* str. A2012 | |
| 2988 | UPI00003CC069 UniRef100 entry | | UniRef100_UPI00003CC069 | |
| 2989 | Septation ring formation regulator ezrA [*Bacillus subtilis*] | UniRef100_O34894 | *Bacillus subtilis* | EzrA |
| 2990 | Histidinol-phosphatase [*Bacillus subtilis*] | UniRef100_O34411 | *Bacillus subtilis* | HisJ |
| 2991 | Probable HTH-type transcriptional regulator yttP [*Bacillus subtilis*] | UniRef100_O34970 | *Bacillus subtilis* | YttP |
| 2992 | Hypothetical conserved protein [*Oceanobacillus iheyensis*] | UniRef100_Q8EPB0 | *Oceanobacillus iheyensis* | |
| 2993 | YtrP [*Bacillus subtilis*] | UniRef100_O34325 | *Bacillus subtilis* | YtrP |
| 2994 | 30S ribosomal protein S4 [*Bacillus subtilis*] | UniRef100_P21466 | *Bacillus subtilis* | RpsD |
| 2995 | | | | |
| 2996 | | | | |
| 2997 | | | | YddR |
| 2998 | HTH-type transcriptional regulator lrpA [*Bacillus subtilis*] | UniRef100_P96652 | *Bacillus subtilis* | LrpA |
| 2999 | | | | |
| 3000 | Tyrosyl-tRNA synthetase 1 [*Bacillus subtilis*] | UniRef100_P22326 | *Bacillus subtilis* | TyrS |
| 3001 | Acetyl-coenzyme A synthetase [*Bacillus subtilis*] | UniRef100_P39062 | *Bacillus subtilis* | AcsA |
| 3002 | Acetoin utilization protein acuA [*Bacillus subtilis*] | UniRef100_P39065 | *Bacillus subtilis* | AcuA |
| 3003 | Acetoin utilization acuB protein [*Bacillus subtilis*] | UniRef100_P39066 | *Bacillus subtilis* | AcuB |
| 3004 | Acetoin utilization protein acuC [*Bacillus subtilis*] | UniRef100_P39067 | *Bacillus subtilis* | AcuC |
| 3005 | Hypothetical protein ytxE [*Bacillus subtilis*] | UniRef100_P39064 | *Bacillus subtilis* | YtxE |
| 3006 | Hypothetical protein ytxD [*Bacillus subtilis*] | UniRef100_P39063 | *Bacillus subtilis* | YtxD |
| 3007 | Catabolite control protein A [*Bacillus subtilis*] | UniRef100_P25144 | *Bacillus subtilis* | CcpA |

TABLE 1-continued

Predicted functions

| SEQ ID NO. | Description | UniRef Accession No. | Organism | Bacillus subtilis homolog (Gene Name) |
|---|---|---|---|---|
| 3008 | AroA(G) protein [Includes: Phospho-2-dehydro-3-deoxyheptonate aldolase (EC 2.5.1.54) (Phospho-2-keto-3-deoxyheptonate aldolase) (DAHP synthetase) (3-deoxy-D-arabino-heptulosonate 7-phosphate synthase); Chorismate mutase (EC 5.4.99.5)] [*Bacillus subtilis*] | UniRef100_P39912 | Includes: Phospho-2-dehydro-3-deoxyheptonate aldolase (EC 2.5.1.54) (Phospho-2-keto-3-deoxyheptonate aldolase) (DAHP synthetase) (3-deoxy-D-arabino-heptulosonate 7-phosphate synthase); Chorismate mutase (EC 5.4.99.5) | AroA |
| 3009 | Similar to hypothetical repeat containing protein [*Photorhabdus luminescens*] | UniRef100_Q7N3B8 | *Photorhabdus luminescens* | |
| 3010 | Hypothetical protein ytxJ [*Bacillus subtilis*] | UniRef100_P39914 | *Bacillus subtilis* | YtxJ |
| 3011 | Hypothetical protein ytxH [*Bacillus subtilis*] | UniRef100_P40780 | *Bacillus subtilis* | YtxH |
| 3012 | Hypothetical protein ytxG [*Bacillus subtilis*] | UniRef100_P40779 | *Bacillus subtilis* | YtxG |
| 3013 | | | | MurC |
| 3014 | YtpT [*Bacillus subtilis*] | UniRef100_O34749 | *Bacillus subtilis* | YtpT |
| 3015 | YtpR [*Bacillus subtilis*] | UniRef100_O34943 | *Bacillus subtilis* | YtpR |
| 3016 | YtpQ [*Bacillus subtilis*] | UniRef100_O34496 | *Bacillus subtilis* | YtpQ |
| 3017 | Putative thioredoxin [*Bacillus subtilis*] | UniRef100_O34357 | *Bacillus subtilis* | YtpP |
| 3018 | YtoQ [*Bacillus subtilis*] | UniRef100_O34305 | *Bacillus subtilis* | YtoQ |
| 3019 | YtoP [*Bacillus subtilis*] | UniRef100_O34924 | *Bacillus subtilis* | YtoP |
| 3020 | YtzB protein [*Bacillus subtilis*] | UniRef100_O32065 | *Bacillus subtilis* | YtzB |
| 3021 | Probable NAD-dependent malic enzyme 3 [*Bacillus subtilis*] | UniRef100_O34389 | *Bacillus subtilis* | MalS |
| 3022 | YtnP [*Bacillus subtilis*] | UniRef100_O34760 | *Bacillus subtilis* | YtnP |
| 3023 | tRNA (guanine-N(7)-)-methyltransferase (EC 2.1.1.33) (tRNA(m7G46)-methyltransferase) [*Bacillus subtilis*] | UniRef100_O34522 | *Bacillus subtilis* | YtmQ |
| 3024 | YtzH protein [*Bacillus subtilis*] | UniRef100_O32066 | *Bacillus subtilis* | |
| 3025 | YtmP [*Bacillus subtilis*] | UniRef100_O34935 | *Bacillus subtilis* | YtmP |
| 3026 | AmyX protein [*Bacillus subtilis*] | UniRef100_O34587 | *Bacillus subtilis* | AmyX |
| 3027 | YtlR [*Bacillus subtilis*] | UniRef100_O34799 | *Bacillus subtilis* | YtlR |
| 3028 | YtlQ [*Bacillus subtilis*] | UniRef100_O34471 | *Bacillus subtilis* | YtlQ |
| 3029 | Hypothetical UPF0097 protein ytlP [*Bacillus subtilis*] | UniRef100_O34570 | *Bacillus subtilis* | YtlP |
| 3030 | Probable cysteine synthase (EC 2.5.1.47) (O-acetylserine sulfhydrylase) (O-acetylserine (Thiol)-lyase) [*Bacillus subtilis*] | UniRef100_O34476 | *Bacillus subtilis* | YtkP |
| 3031 | Hypothetical protein [*Bacillus cereus*] | UniRef100_Q81BR8 | *Bacillus cereus* | YncE |
| 3032 | Putative peptidase [*Bacillus subtilis*] | UniRef100_O34944 | *Bacillus subtilis* | YtjP |
| 3033 | YtiP [*Bacillus subtilis*] | UniRef100_O34978 | *Bacillus subtilis* | YtiP |
| 3034 | YtzE protein [*Bacillus subtilis*] | UniRef100_O32067 | *Bacillus subtilis* | |
| 3035 | Ribosomal small subunit pseudouridine synthase A [*Bacillus cereus*] | UniRef100_Q816W1 | *Bacillus cereus* | YtzF |
| 3036 | YtgP [*Bacillus subtilis*] | UniRef100_O34674 | *Bacillus subtilis* | YtgP |
| 3037 | YtfP [*Bacillus subtilis*] | UniRef100_O30505 | *Bacillus subtilis* | YtfP |
| 3038 | | | | OpuD |
| 3039 | Protein cse60 [*Bacillus subtilis*] | UniRef100_P94496 | *Bacillus subtilis* | |
| 3040 | Rhodanese-like domain protein [*Bacillus cereus*] | UniRef100_Q72YZ9 | *Bacillus cereus* | |
| 3041 | | | | RapA |
| 3042 | Hypothetical protein [*Bacillus thuringiensis*] | UniRef100_Q6HI31 | *Bacillus thuringiensis* | |
| 3043 | YteU [*Bacillus subtilis*] | UniRef100_O34378 | *Bacillus subtilis* | YteU |
| 3044 | | | | YteT |
| 3045 | | | | YteS |

TABLE 1-continued

Predicted functions

| SEQ ID NO. | Description | UniRef Accession No. | Organism | Bacillus subtilis homolog (Gene Name) |
|---|---|---|---|---|
| 3046 | YteR [*Bacillus subtilis*] | UniRef100_O34559 | *Bacillus subtilis* | YteR |
| 3047 | Transmembrane lipoprotein [*Bacillus halodurans*] | UniRef100_Q9KFJ5 | *Bacillus halodurans* | LplB |
| 3048 | YtdP protein [*Bacillus subtilis*] | UniRef100_O32071 | *Bacillus subtilis* | YtdP |
| 3049 | YtcQ protein [*Bacillus subtilis*] | UniRef100_Q795R2 | *Bacillus subtilis* | YtcQ |
| 3050 | | | | YtcP |
| 3051 | Hypothetical protein ytbQ [*Bacillus subtilis*] | UniRef100_P53560 | *Bacillus subtilis* | YtbQ |
| 3052 | YtaP [*Bacillus subtilis*] | UniRef100_O34973 | *Bacillus subtilis* | YtaP |
| 3053 | Amino acid/polyamine transporter; family I [*Methanococcus maripaludis*] | UniRef100_Q6LYX9 | *Methanococcus maripaludis* | YecA |
| 3054 | Transcriptional regulator, LysR family [*Clostridium acetobutylicum*] | UniRef100_Q97DX1 | *Clostridium acetobutylicum* | YwqM |
| 3055 | Prolyl endopeptidase [*Bacillus cereus*] | UniRef100_Q81C54 | *Bacillus cereus* | YycE |
| 3056 | Leucyl-tRNA synthetase [*Bacillus subtilis*] | UniRef100_P36430 | *Bacillus subtilis* | LeuS |
| 3057 | | | | YtvB |
| 3058 | YttB [*Bacillus subtilis*] | UniRef100_O34546 | *Bacillus subtilis* | YttB |
| 3059 | Lipoprotein [*Oceanobacillus iheyensis*] | UniRef100_Q8EPK3 | *Oceanobacillus iheyensis* | YusA |
| 3060 | YttA [*Bacillus subtilis*] | UniRef100_O30500 | *Bacillus subtilis* | YttA |
| 3061 | YtrF [*Bacillus subtilis*] | UniRef100_O35005 | *Bacillus subtilis* | YtrF |
| 3062 | Hypothetical ABC transporter ATP-binding protein ytrE [*Bacillus subtilis*] | UniRef100_O34392 | *Bacillus subtilis* | YtrE |
| 3063 | YtrC [*Bacillus subtilis*] | UniRef100_O34898 | *Bacillus subtilis* | YtrC |
| 3064 | Transporter [*Bacillus subtilis*] | UniRef100_O34641 | *Bacillus subtilis* | YtrB |
| 3065 | Transcription regulator [*Bacillus subtilis*] | UniRef100_O34712 | *Bacillus subtilis* | YtrA |
| 3066 | Hypothetical protein ytzC [*Bacillus subtilis*] | UniRef100_O32073 | *Bacillus subtilis* | |
| 3067 | YtqA [*Bacillus subtilis*] | UniRef100_O35008 | *Bacillus subtilis* | YtqA |
| 3068 | | | | YtqB |
| 3069 | Proton glutamate symport protein [*Bacillus subtilis*] | UniRef100_P39817 | *Bacillus subtilis* | GltP |
| 3070 | Hypothetical protein ytpB [*Bacillus subtilis*] | UniRef100_O34707 | *Bacillus subtilis* | YtpB |
| 3071 | Probable lysophospholipase [*Bacillus subtilis*] | UniRef100_O34705 | *Bacillus subtilis* | YtpA |
| 3072 | YtoA [*Bacillus subtilis*] | UniRef100_O34696 | *Bacillus subtilis* | YtoA |
| 3073 | | | | YwoA |
| 3074 | Glycosyl transferase, group 1 family [*Bacillus thuringiensis*] | UniRef100_Q6HCB9 | *Bacillus thuringiensis* | TuaC |
| 3075 | Asparagine synthetase [glutamine-hydrolyzing] 1 [*Bacillus subtilis*] | UniRef100_P54420 | glutamine-hydrolyzing | AsnB |
| 3076 | S-adenosylmethionine synthetase [*Bacillus subtilis*] | UniRef100_P54419 | *Bacillus subtilis* | MetK |
| 3077 | Phosphoenolpyruvate carboxykinase [ATP] [*Bacillus subtilis*] | UniRef100_P54418 | ATP | PckA |
| 3078 | Sodium:dicarboxylate symporter [*Oceanobacillus iheyensis*] | UniRef100_Q8EP16 | *Oceanobacillus iheyensis* | DctP |
| 3079 | Hypothetical protein ytmB [*Bacillus subtilis*] | UniRef100_O34365 | *Bacillus subtilis* | |
| 3080 | Putative peptidase [*Bacillus subtilis*] | UniRef100_O34493 | *Bacillus subtilis* | YtmA |
| 3081 | ABC transporter substrate-binding protein [*Bacillus cereus*] | UniRef100_Q816P5 | *Bacillus cereus* | YtlA |
| 3082 | Putative transporter [*Bacillus subtilis*] | UniRef100_O34314 | *Bacillus subtilis* | YtlC |
| 3083 | | | | YtlD |
| 3084 | YtkD [*Bacillus subtilis*] | UniRef100_O35013 | *Bacillus subtilis* | YtkD |
| 3085 | Hypothetical protein [*Bacillus thuringiensis*] | UniRef100_Q6HC91 | *Bacillus thuringiensis* | |
| 3086 | Hypothetical protein ytkC [*Bacillus subtilis*] | UniRef100_O34883 | *Bacillus subtilis* | YtkC |
| 3087 | General stress protein 20U [*Bacillus subtilis*] | UniRef100_P80879 | *Bacillus subtilis* | Dps |
| 3088 | Hypothetical protein ytkA [*Bacillus subtilis*] | UniRef100_P40768 | *Bacillus subtilis* | YtkA |
| 3089 | S-ribosylhomocysteinase [*Bacillus subtilis*] | UniRef100_O34667 | *Bacillus subtilis* | LuxS |
| 3090 | Hypothetical UPF0161 protein ytjA [*Bacillus subtilis*] | UniRef100_O34601 | *Bacillus subtilis* | |
| 3091 | YtiB [*Bacillus subtilis*] | UniRef100_O34872 | *Bacillus subtilis* | YtiB |

TABLE 1-continued

Predicted functions

| SEQ ID NO. | Description | UniRef Accession No. | Organism | Bacillus subtilis homolog (Gene Name) |
|---|---|---|---|---|
| 3092 | Low-affinity zinc transport protein [Bacillus cereus] | UniRef100_Q81F90 | Bacillus cereus | YciC |
| 3093 | High-affinity zinc uptake system protein znuA [Bacillus cereus] | UniRef100_Q81EF8 | Bacillus cereus | YcdH |
| 3094 | 50S ribosomal protein L31 type B [Bacillus subtilis] | UniRef100_O34967 | Bacillus subtilis | |
| 3095 | YthA [Bacillus subtilis] | UniRef100_O34655 | Bacillus subtilis | YthA |
| 3096 | YthB [Bacillus subtilis] | UniRef100_O34505 | Bacillus subtilis | YthB |
| 3097 | Hypothetical protein [Bacillus cereus] | UniRef100_Q737J1 | Bacillus cereus | |
| 3098 | | | | |
| 3099 | O-succinylbenzoate synthase (EC 4.2.1.—) (OSB synthase) (OSBS) (4-(2'-carboxyphenyl)-4-oxybutyric acid synthase) [Bacillus subtilis] | UniRef100_O34514 | Bacillus subtilis | MenC |
| 3100 | O-succinylbenzoate--CoA ligase [Bacillus subtilis] | UniRef100_P23971 | Bacillus subtilis | MenE |
| 3101 | Naphthoate synthase [Bacillus subtilis] | UniRef100_P23966 | Bacillus subtilis | MenB |
| 3102 | | | | YtxM |
| 3103 | Menaquinone biosynthesis protein menD [Includes: 2-succinyl-6-hydroxy-2,4-cyclohexadiene-1-carboxylate synthase (EC 2.5.1.64) (SHCHC synthase); 2-oxoglutarate decarboxylase (EC 4.1.1.71) (Alpha-ketoglutarate decarboxylase) (KDC)] [Bacillus subtilis] | UniRef100_P23970 | Includes: 2-succinyl-6-hydroxy-2,4-cyclohexadiene-1-carboxylate synthase (EC 2.5.1.64) (SHCHC synthase); 2-oxoglutarate decarboxylase (EC 4.1.1.71) (Alpha-ketoglutarate decarboxylase) (KDC) | MenD |
| 3104 | Menaquinone-specific isochorismate synthase [Bacillus subtilis] | UniRef100_P23973 | Bacillus subtilis | MenF |
| 3105 | Probable 1,4-dihydroxy-2-naphthoate octaprenyltransferase [Bacillus subtilis] | UniRef100_P39582 | Bacillus subtilis | MenA |
| 3106 | Hypothetical protein yteA [Bacillus subtilis] | UniRef100_P42408 | Bacillus subtilis | YteA |
| 3107 | Glycogen phosphorylase [Bacillus subtilis] | UniRef100_P39123 | Bacillus subtilis | GlgP |
| 3108 | Glycogen synthase [Bacillus subtilis] | UniRef100_P39125 | Bacillus subtilis | GlgA |
| 3109 | Glycogen biosynthesis protein glgD [Bacillus subtilis] | UniRef100_P39124 | Bacillus subtilis | GlgD |
| 3110 | Glucose-1-phosphate adenylyltransferase [Bacillus subtilis] | UniRef100_P39122 | Bacillus subtilis | GlgC |
| 3111 | 1,4-alpha-glucan branching enzyme [Bacillus subtilis] | UniRef100_P39118 | Bacillus subtilis | GlgB |
| 3112 | | | | AraR |
| 3113 | YuaJ protein [Bacillus subtilis] | UniRef100_O32074 | Bacillus subtilis | YuaJ |
| 3114 | BH4010 protein [Bacillus halodurans] | UniRef100_Q9K5S8 | Bacillus halodurans | YhcS |
| 3115 | BH4011 protein [Bacillus halodurans] | UniRef100_Q9K5S7 | Bacillus halodurans | |
| 3116 | | | | |
| 3117 | | | | RapD |
| 3118 | Pyrrolidone-carboxylate peptidase [Bacillus amyloliquefaciens] | UniRef100_P46107 | Bacillus amyloliquefaciens | Pcp |
| 3119 | BH0597 protein [Bacillus halodurans] | UniRef100_Q9KF88 | Bacillus halodurans | YuaA |
| 3120 | | | | YubG |
| 3121 | | | | YxxF |
| 3122 | YuaE protein [Bacillus subtilis] | UniRef100_O32078 | Bacillus subtilis | YuaE |
| 3123 | YuaD protein [Bacillus subtilis] | UniRef100_O32079 | Bacillus subtilis | YuaD |
| 3124 | Alcohol dehydrogenase [Bacillus subtilis] | UniRef100_P71017 | Bacillus subtilis | GbsB |
| 3125 | Betaine aldehyde dehydrogenase [Bacillus subtilis] | UniRef100_P71016 | Bacillus subtilis | GbsA |
| 3126 | Hypothetical protein yuaC [Bacillus subtilis] | UniRef100_P71015 | Bacillus subtilis | YuaC |
| 3127 | UPI00002D3D35 UniRef100 entry | | UniRef100_UPI00002D3D35 | OpuE |

TABLE 1-continued

Predicted functions

| SEQ ID NO. | Description | UniRef Accession No. | Organism | Bacillus subtilis homolog (Gene Name) |
|---|---|---|---|---|
| 3128 | Hypothetical protein yktD [Bacillus subtilis] | UniRef100_Q45500 | Bacillus subtilis | YktD |
| 3129 | Alanine racemase 2 [Bacillus subtilis] | UniRef100_P94494 | Bacillus subtilis | YncD |
| 3130 | Oxalate decarboxylase [Bacillus cereus] | UniRef100_Q81GZ6 | Bacillus cereus | YoaN |
| 3131 | Hypothetical protein CAC0135 [Clostridium acetobutylicum] | UniRef100_Q97MQ7 | Clostridium acetobutylicum | |
| 3132 | Hypothetical protein [Bacillus thuringiensis] | UniRef100_Q6HGC9 | Bacillus thuringiensis | |
| 3133 | Hypothetical protein [Bacillus thuringiensis] | UniRef100_Q6HGC8 | Bacillus thuringiensis | |
| 3134 | | | | |
| 3135 | Hypothetical protein [Bacillus thuringiensis] | UniRef100_Q6HGC6 | Bacillus thuringiensis | |
| 3136 | Hypothetical protein [Bacillus thuringiensis] | UniRef100_Q6HGC5 | Bacillus thuringiensis | |
| 3137 | Hypothetical conserved protein [Oceanobacillus iheyensis] | UniRef100_Q8ETF5 | Oceanobacillus iheyensis | |
| 3138 | | | | |
| 3139 | | | | |
| 3140 | YkoN [Bacillus subtilis] | UniRef100_O34625 | Bacillus subtilis | YkoN |
| 3141 | Hypothetical protein ykoP [Bacillus subtilis] | UniRef100_O34495 | Bacillus subtilis | YkoP |
| 3142 | Hypothetical UPF0151 protein ykoQ [Bacillus subtilis] | UniRef100_O35040 | Bacillus subtilis | YkoQ |
| 3143 | Undecaprenyl-diphosphatase [Bacillus subtilis] | UniRef100_P94507 | Bacillus subtilis | YubB |
| 3144 | Hypothetical UPF0118 protein yubA [Bacillus subtilis] | UniRef100_O32086 | Bacillus subtilis | YubA |
| 3145 | Hypothetical oxidoreductase yulF [Bacillus subtilis] | UniRef100_O05265 | Bacillus subtilis | YulF |
| 3146 | Lmo2256 protein [Listeria monocytogenes] | UniRef100_Q929B9 | Listeria monocytogenes | YraA |
| 3147 | | | | McpA |
| 3148 | | | | McpA |
| 3149 | | | | McpA |
| 3150 | Protein-glutamine gamma-glutamyltransferase [Bacillus subtilis] | UniRef100_P40746 | Bacillus subtilis | Tgl |
| 3151 | 2-nitropropane dioxygenase [Bacillus subtilis] | UniRef100_O05413 | Bacillus subtilis | YrpB |
| 3152 | Hypothetical UPF0047 protein yugU [Bacillus subtilis] | UniRef100_O05243 | Bacillus subtilis | YugU |
| 3153 | Hypothetical protein yugT [Bacillus subtilis] | UniRef100_O05242 | Bacillus subtilis | YugT |
| 3154 | Transcriptional regulator, TetR family [Bacillus cereus] | UniRef100_Q81GX6 | Bacillus cereus | YfiR |
| 3155 | Hypothetical protein yqeB [Bacillus subtilis] | UniRef100_P54447 | Bacillus subtilis | YqeB |
| 3156 | Beta(1,4)-glucan glucanohydrolase [Erwinia carotovora] | UniRef100_Q6D3B7 | Erwinia carotovora | |
| 3157 | Hypothetical UPF0053 protein yugS [Bacillus subtilis] | UniRef100_O05241 | Bacillus subtilis | YugS |
| 3158 | Hypothetical protein yugP [Bacillus subtilis] | UniRef100_O05248 | Bacillus subtilis | YugP |
| 3159 | YugO protein [Bacillus subtilis] | UniRef100_Q795M8 | Bacillus subtilis | |
| 3160 | Hypothetical protein yugN [Bacillus subtilis] | UniRef100_O05246 | Bacillus subtilis | YugN |
| 3161 | Hypothetical protein [Bacillus thuringiensis] | UniRef100_Q6HIW1 | Bacillus thuringiensis | YdfR |
| 3162 | YtaB protein [Bacillus subtilis] | UniRef100_O34694 | Bacillus subtilis | YtaB |
| 3163 | Predicted acetyltransferase [Clostridium acetobutylicum] | UniRef100_Q97IT3 | Clostridium acetobutylicum | YkkB |
| 3164 | Glucose-6-phosphate isomerase [Bacillus subtilis] | UniRef100_P80860 | Bacillus subtilis | Pgi |
| 3165 | Probable NADH-dependent butanol dehydrogenase 1 [Bacillus subtilis] | UniRef100_O05239 | Bacillus subtilis | YugJ |
| 3166 | YuzA protein [Bacillus subtilis] | UniRef100_O32087 | Bacillus subtilis | |
| 3167 | General stress protein 13 [Bacillus subtilis] | UniRef100_P80870 | Bacillus subtilis | YugI |
| 3168 | Alanine transaminase [Bacillus subtilis] | UniRef100_Q795M6 | Bacillus subtilis | AlaT |

TABLE 1-continued

Predicted functions

| SEQ ID NO. | Description | UniRef Accession No. | Organism | Bacillus subtilis homolog (Gene Name) |
|---|---|---|---|---|
| 3169 | Transcriptional regulator [Bacillus subtilis] | UniRef100_O05236 | Bacillus subtilis | AlaR |
| 3170 | Hypothetical protein yugF [Bacillus subtilis] | UniRef100_O05235 | Bacillus subtilis | YugF |
| 3171 | Hypothetical protein yugE [Bacillus subtilis] | UniRef100_O05234 | Bacillus subtilis | |
| 3172 | Hypothetical protein SMU.305 [Streptococcus mutans] | UniRef100_Q9X669 | Streptococcus mutans | |
| 3173 | Putative aminotransferase B [Bacillus subtilis] | UniRef100_Q08432 | Bacillus subtilis | PatB |
| 3174 | | | | |
| 3175 | Kinase-associated lipoprotein B precursor [Bacillus subtilis] | UniRef100_Q08429 | Bacillus subtilis | KapB |
| 3176 | Hypothetical protein yugB [Bacillus subtilis] | UniRef100_O05231 | Bacillus subtilis | KapD |
| 3177 | | | | YuxJ |
| 3178 | | | | PbpD |
| 3179 | Hypothetical protein yuxK [Bacillus subtilis] | UniRef100_P40761 | Bacillus subtilis | YuxK |
| 3180 | Hypothetical protein yufK [Bacillus subtilis] | UniRef100_O05249 | Bacillus subtilis | YufK |
| 3181 | Hypothetical protein yufL [Bacillus subtilis] | UniRef100_O05250 | Bacillus subtilis | YufL |
| 3182 | Hypothetical protein yufM [Bacillus subtilis] | UniRef100_O05251 | Bacillus subtilis | YufM |
| 3183 | | | | |
| 3184 | UPI00003CB938 UniRef100 entry | | UniRef100_UPI00003CB938 | PssA |
| 3185 | Hypothetical protein ybfM [Bacillus subtilis] | UniRef100_O31453 | Bacillus subtilis | YbfM |
| 3186 | Phosphatidylserine decarboxylase [Bacillus thuringiensis] | UniRef100_Q6HDI5 | Bacillus thuringiensis | Psd |
| 3187 | UPI00003CC069 UniRef100 entry | | UniRef100_UPI00003CC069 | |
| 3188 | IS1627s1-related, transposase [Bacillus anthracis str. A2012] | UniRef100_Q7CMD0 | Bacillus anthracis str. A2012 | |
| 3189 | Na(+)-malate symporter [Bacillus subtilis] | UniRef100_O05256 | Bacillus subtilis | MaeN |
| 3190 | | | | |
| 3191 | Na(+)/H(+) antiporter subunit A [Bacillus subtilis] | UniRef100_Q9K2S2 | Bacillus subtilis | MrpA |
| 3192 | Na(+)/H(+) antiporter subunit B [Bacillus subtilis] | UniRef100_O05259 | Bacillus subtilis | MrpB |
| 3193 | Na(+)/H(+) antiporter subunit C [Bacillus subtilis] | UniRef100_O05260 | Bacillus subtilis | MrpC |
| 3194 | Na(+)/H(+) antiporter subunit D [Bacillus subtilis] | UniRef100_O05229 | Bacillus subtilis | MrpD |
| 3195 | Na(+)/H(+) antiporter subunit E [Bacillus subtilis] | UniRef100_Q7WY60 | Bacillus subtilis | MrpE |
| 3196 | Na(+)/H(+) antiporter subunit F [Bacillus subtilis] | UniRef100_O05228 | Bacillus subtilis | |
| 3197 | Na(+)/H(+) antiporter subunit G [Bacillus subtilis] | UniRef100_O05227 | Bacillus subtilis | MrpG |
| 3198 | | | | YuxO |
| 3199 | | | | ComA |
| 3200 | | | | ComP |
| 3201 | IS1627s1-related, transposase [Bacillus anthracis str. A2012] | UniRef100_Q7CMD0 | Bacillus anthracis str. A2012 | |
| 3202 | UPI00003CC069 UniRef100 entry | | UniRef100_UPI00003CC069 | |
| 3203 | | | | ComP |
| 3204 | | | | |
| 3205 | ComQ [Bacillus subtilis] | UniRef100_Q9K5L3 | Bacillus subtilis | ComQ |
| 3206 | | | | |
| 3207 | Hypothetical protein yuzC [Bacillus subtilis] | UniRef100_O32089 | Bacillus subtilis | YuzC |
| 3208 | Hypothetical protein yuxH [Bacillus subtilis] | UniRef100_P14203 | Bacillus subtilis | YuxH |
| 3209 | YueK protein [Bacillus subtilis] | UniRef100_O32090 | Bacillus subtilis | YueK |
| 3210 | YueJ protein [Bacillus subtilis] | UniRef100_O32091 | Bacillus subtilis | YueJ |
| 3211 | | | | YueI |
| 3212 | | | | |
| 3213 | Hypothetical protein yueG [Bacillus subtilis] | UniRef100_O32094 | Bacillus subtilis | |

TABLE 1-continued

Predicted functions

| SEQ ID NO. | Description | UniRef Accession No. | Organism | Bacillus subtilis homolog (Gene Name) |
|---|---|---|---|---|
| 3214 | | | | YueF |
| 3215 | RRF2 family protein [Bacillus cereus] | UniRef100_Q81EX1 | Bacillus cereus | YwnA |
| 3216 | Probable lipase/esterase [Rhodopirellula baltica] | UniRef100_Q7UUA2 | Rhodopirellula baltica | YuxL |
| 3217 | BH1896 protein [Bacillus halodurans] | UniRef100_Q9KBN0 | Bacillus halodurans | |
| 3218 | YueE protein [Bacillus subtilis] | UniRef100_O32098 | Bacillus subtilis | YueE |
| 3219 | YueD protein [Bacillus subtilis] | UniRef100_O32099 | Bacillus subtilis | YueD |
| 3220 | Hypothetical protein yueC [Bacillus subtilis] | UniRef100_O32100 | Bacillus subtilis | YueC |
| 3221 | YueB protein [Bacillus subtilis] | UniRef100_O32101 | Bacillus subtilis | YueB |
| 3222 | YukA protein [Bacillus subtilis] | UniRef100_P71068 | Bacillus subtilis | YukA |
| 3223 | YukC protein [Bacillus subtilis] | UniRef100_P71070 | Bacillus subtilis | YukC |
| 3224 | YukD protein [Bacillus subtilis] | UniRef100_P71071 | Bacillus subtilis | |
| 3225 | Lin0049 protein [Listeria innocua] | UniRef100_Q92FQ4 | Listeria innocua | |
| 3226 | | | | YflA |
| 3227 | YukF protein [Bacillus subtilis] | UniRef100_P71073 | Bacillus subtilis | YukF |
| 3228 | Alanine dehydrogenase [Bacillus subtilis] | UniRef100_Q08352 | Bacillus subtilis | Ald |
| 3229 | | | | |
| 3230 | YuiH protein [Bacillus subtilis] | UniRef100_O32103 | Bacillus subtilis | YuiH |
| 3231 | YuiG protein [Bacillus subtilis] | UniRef100_O32104 | Bacillus subtilis | YuiG |
| 3232 | YuiF protein [Bacillus subtilis] | UniRef100_O32105 | Bacillus subtilis | YuiF |
| 3233 | Probable cytosol aminopeptidase [Bacillus subtilis] | UniRef100_O32106 | Bacillus subtilis | YuiE |
| 3234 | YuiD protein [Bacillus subtilis] | UniRef100_O32107 | Bacillus subtilis | YuiD |
| 3235 | YuiC protein [Bacillus subtilis] | UniRef100_O32108 | Bacillus subtilis | YuiC |
| 3236 | YuiB protein [Bacillus subtilis] | UniRef100_O32109 | Bacillus subtilis | YuiB |
| 3237 | | | | |
| 3238 | | | | YumB |
| 3239 | Thioredoxin reductase [Bacillus subtilis] | UniRef100_O05268 | Bacillus subtilis | YumC |
| 3240 | | | | |
| 3241 | YdjO protein [Bacillus subtilis] | UniRef100_O34759 | Bacillus subtilis | |
| 3242 | | | | YxbD |
| 3243 | Hypothetical protein yutM [Bacillus subtilis] | UniRef100_O32113 | Bacillus subtilis | YutM |
| 3244 | Diaminopimelate epimerase [Bacillus subtilis] | UniRef100_O32114 | Bacillus subtilis | DapF |
| 3245 | YutK protein [Bacillus subtilis] | UniRef100_O32115 | Bacillus subtilis | YutK |
| 3246 | YuzB protein [Bacillus subtilis] | UniRef100_O32116 | Bacillus subtilis | |
| 3247 | YutJ protein [Bacillus subtilis] | UniRef100_O32117 | Bacillus subtilis | YutJ |
| 3248 | YdhG protein [Bacillus subtilis] | UniRef100_O05499 | Bacillus subtilis | YdhG |
| 3249 | Response regulator aspartate phosphatase [Bacillus halodurans] | UniRef100_Q9KBE1 | Bacillus halodurans | RapI |
| 3250 | Phenolic acid decarboxylase [Bacillus subtilis] | UniRef100_O07006 | Bacillus subtilis | PadC |
| 3251 | BH2266 protein [Bacillus halodurans] | UniRef100_Q9KAM1 | Bacillus halodurans | |
| 3252 | YuzD protein [Bacillus subtilis] | UniRef100_O32118 | Bacillus subtilis | YuzD |
| 3253 | YutI protein [Bacillus subtilis] | UniRef100_O32119 | Bacillus subtilis | |
| 3254 | Probable peptidase yuxL [Bacillus subtilis] | UniRef100_P39839 | Bacillus subtilis | YuxL |
| 3255 | Homoserine kinase [Bacillus subtilis] | UniRef100_P04948 | Bacillus subtilis | ThrB |
| 3256 | Threonine synthase [Bacillus subtilis] | UniRef100_P04990 | Bacillus subtilis | ThrC |
| 3257 | Homoserine dehydrogenase [Bacillus subtilis] | UniRef100_P19582 | Bacillus subtilis | Hom |
| 3258 | Glycerate dehydrogenase [Oceanobacillus iheyensis] | UniRef100_Q8ENW9 | Oceanobacillus iheyensis | YvcT |
| 3259 | YutH protein [Bacillus subtilis] | UniRef100_O32123 | Bacillus subtilis | YutH |
| 3260 | Hypothetical protein yutG [Bacillus subtilis] | UniRef100_O32124 | Bacillus subtilis | YutG |
| 3261 | YutF protein [Bacillus subtilis] | UniRef100_O32125 | Bacillus subtilis | YutF |
| 3262 | YutE protein [Bacillus subtilis] | UniRef100_O32126 | Bacillus subtilis | YutE |
| 3263 | YutD protein [Bacillus subtilis] | UniRef100_O32127 | Bacillus subtilis | |
| 3264 | YutC protein [Bacillus subtilis] | UniRef100_O32128 | Bacillus subtilis | YutC |
| 3265 | | | | LipA |
| 3266 | YunA protein [Bacillus subtilis] | UniRef100_O32130 | Bacillus subtilis | YunA |
| 3267 | | | | |
| 3268 | Sodium-dependent transporter [Bacillus halodurans] | UniRef100_Q9K7C5 | Bacillus halodurans | YocR |
| 3269 | YunB protein [Bacillus subtilis] | UniRef100_O32131 | Bacillus subtilis | YunB |
| 3270 | YunC protein [Bacillus subtilis] | UniRef100_O32132 | Bacillus subtilis | YunC |

TABLE 1-continued

Predicted functions

| SEQ ID NO. | Description | UniRef Accession No. | Organism | Bacillus subtilis homolog (Gene Name) |
|---|---|---|---|---|
| 3271 | YunD protein [*Bacillus subtilis*] | UniRef100_O32133 | *Bacillus subtilis* | YunD |
| 3272 | YunE protein [*Bacillus subtilis*] | UniRef100_O32134 | *Bacillus subtilis* | YunE |
| 3273 | YunF protein [*Bacillus subtilis*] | UniRef100_O32135 | *Bacillus subtilis* | YunF |
| 3274 | | | | YmcC |
| 3275 | TetR family transcriptional regulator? [*Symbiobacterium thermophilum*] | UniRef100_Q67KA4 | *Symbiobacterium thermophilum* | PksA |
| 3276 | | | | |
| 3277 | Purine catabolism protein pucG [*Bacillus subtilis*] | UniRef100_O32148 | *Bacillus subtilis* | YurG |
| 3278 | Allantoate amidohydrolase [*Bacillus subtilis*] | UniRef100_O32149 | *Bacillus subtilis* | YurH |
| 3279 | Purine catabolism regulatory protein [*Bacillus subtilis*] | UniRef100_O32138 | *Bacillus subtilis* | PucR |
| 3280 | Multidrug resistance protein B [*Bacillus cereus* ZK] | UniRef100_Q63FH7 | *Bacillus cereus* ZK | Blt |
| 3281 | BH2308 protein [*Bacillus halodurans*] | UniRef100_Q9KAH9 | *Bacillus halodurans* | YcgA |
| 3282 | | | | TrpD |
| 3283 | Anthranilate phosphoribosyltransferase [*Pyrococcus furiosus*] | UniRef100_Q8U089 | *Pyrococcus furiosus* | |
| 3284 | Extracellular ribonuclease precursor [*Bacillus subtilis*] | UniRef100_O32150 | *Bacillus subtilis* | YurI |
| 3285 | BH1977 protein [*Bacillus halodurans*] | UniRef100_Q9KBF1 | *Bacillus halodurans* | |
| 3286 | | | | YurR |
| 3287 | Putative membrane protein [*Bordetella bronchiseptica*] | UniRef100_Q7WGW7 | *Bordetella bronchiseptica* | |
| 3288 | UPI00003CB453 UniRef100 entry | UniRef100_UPI00003CB453 | | |
| 3289 | Response regulator aspartate phosphatase I [*Bacillus subtilis*] | UniRef100_P96649 | *Bacillus subtilis* | RapI |
| 3290 | YurU protein [*Bacillus subtilis*] | UniRef100_O32162 | *Bacillus subtilis* | YurU |
| 3291 | NifU-like protein [*Bacillus subtilis*] | UniRef100_O32163 | *Bacillus subtilis* | YurV |
| 3292 | Probable cysteine desulfurase [*Bacillus subtilis*] | UniRef100_O32164 | *Bacillus subtilis* | Csd |
| 3293 | YurX protein [*Bacillus subtilis*] | UniRef100_O32165 | *Bacillus subtilis* | YurX |
| 3294 | Vegetative protein 296 [*Bacillus subtilis*] | UniRef100_P80866 | *Bacillus subtilis* | YurY |
| 3295 | Lmo2575 protein [*Listeria monocytogenes*] | UniRef100_Q8Y480 | *Listeria monocytogenes* | CzcD |
| 3296 | | | | |
| 3297 | BH3473 protein [*Bacillus halodurans*] | UniRef100_Q9K796 | *Bacillus halodurans* | YurZ |
| 3298 | YusA protein [*Bacillus subtilis*] | UniRef100_O32167 | *Bacillus subtilis* | YusA |
| 3299 | YusB protein [*Bacillus subtilis*] | UniRef100_O32168 | *Bacillus subtilis* | YusB |
| 3300 | YusC protein [*Bacillus subtilis*] | UniRef100_O32169 | *Bacillus subtilis* | YusC |
| 3301 | Hypothetical protein yusD [*Bacillus subtilis*] | UniRef100_O32170 | *Bacillus subtilis* | YusD |
| 3302 | YusE protein [*Bacillus subtilis*] | UniRef100_O32171 | *Bacillus subtilis* | |
| 3303 | YusF protein [*Bacillus subtilis*] | UniRef100_O32172 | *Bacillus subtilis* | YusF |
| 3304 | | | | |
| 3305 | Glycine cleavage system H protein [*Bacillus subtilis*] | UniRef100_O32174 | *Bacillus subtilis* | GcvH |
| 3306 | Hypothetical protein yusI [*Bacillus subtilis*] | UniRef100_O32175 | *Bacillus subtilis* | YusI |
| 3307 | YusJ protein [*Bacillus subtilis*] | UniRef100_O32176 | *Bacillus subtilis* | YusJ |
| 3308 | YusK protein [*Bacillus subtilis*] | UniRef100_O32177 | *Bacillus subtilis* | YusK |
| 3309 | YusL protein [*Bacillus subtilis*] | UniRef100_O32178 | *Bacillus subtilis* | YusL |
| 3310 | | | | |
| 3311 | | | | |
| 3312 | YusN protein [*Bacillus subtilis*] | UniRef100_O32180 | *Bacillus subtilis* | YusN |
| 3313 | Hypothetical protein yusU [*Bacillus subtilis*] | UniRef100_O32187 | *Bacillus subtilis* | |
| 3314 | BH1040 protein [*Bacillus halodurans*] | UniRef100_Q9KE18 | *Bacillus halodurans* | |
| 3315 | YusV protein [*Bacillus subtilis*] | UniRef100_O32188 | *Bacillus subtilis* | YusV |
| 3316 | | | | YfhA |
| 3317 | YfiZ protein [*Bacillus subtilis*] | UniRef100_O31568 | *Bacillus subtilis* | YfiZ |
| 3318 | YfiY protein [*Bacillus subtilis*] | UniRef100_O31567 | *Bacillus subtilis* | YfiY |
| 3319 | Hypothetical protein yusW precursor [*Bacillus subtilis*] | UniRef100_O32189 | *Bacillus subtilis* | YusW |
| 3320 | YusX protein [*Bacillus subtilis*] | UniRef100_O32190 | *Bacillus subtilis* | YusX |
| 3321 | D-alanyl-D-alanine carboxypeptidase [*Oceanobacillus iheyensis*] | UniRef100_Q8ERG0 | *Oceanobacillus iheyensis* | DacB |

TABLE 1-continued

Predicted functions

| SEQ ID NO. | Description | UniRef Accession No. | Organism | Bacillus subtilis homolog (Gene Name) |
|---|---|---|---|---|
| 3322 | Hypothetical oxidoreductase yusZ [Bacillus subtilis] | UniRef100_P37959 | Bacillus subtilis | YusZ |
| 3323 | Metalloregulation DNA-binding stress protein [Bacillus subtilis] | UniRef100_P37960 | Bacillus subtilis | MrgA |
| 3324 | Probable serine protease yvtA [Bacillus subtilis] | UniRef100_Q9R9I1 | Bacillus subtilis | YvtA |
| 3325 | Transcriptional regulatory protein cssR [Bacillus subtilis] | UniRef100_O32192 | Bacillus subtilis | CssR |
| 3326 | Sensor protein cssS [Bacillus subtilis] | UniRef100_O32193 | Bacillus subtilis | CssS |
| 3327 | YirB [Bacillus subtilis] | UniRef100_O32302 | Bacillus subtilis | |
| 3328 | Putative HTH-type transcriptional regulator yuxN [Bacillus subtilis] | UniRef100_P40950 | Bacillus subtilis | YuxN |
| 3329 | Fumarate hydratase class II [Bacillus subtilis] | UniRef100_P07343 | Bacillus subtilis | CitG |
| 3330 | | | | |
| 3331 | Spore germination protein A1 [Bacillus subtilis] | UniRef100_P07868 | Bacillus subtilis | GerAA |
| 3332 | Spore germination protein A2 [Bacillus subtilis] | UniRef100_P07869 | Bacillus subtilis | GerAB |
| 3333 | Spore germination protein A3 precursor [Bacillus subtilis] | UniRef100_P07870 | Bacillus subtilis | GerAC |
| 3334 | | | | |
| 3335 | | | | YvqC |
| 3336 | YvqE protein [Bacillus subtilis] | UniRef100_O32198 | Bacillus subtilis | YvqE |
| 3337 | YvqF protein [Bacillus subtilis] | UniRef100_O32199 | Bacillus subtilis | YvqF |
| 3338 | YvqG protein [Bacillus subtilis] | UniRef100_O32200 | Bacillus subtilis | YvqG |
| 3339 | Hypothetical protein yvqH [Bacillus subtilis] | UniRef100_O32201 | Bacillus subtilis | YvqH |
| 3340 | Hypothetical protein yvqI [Bacillus subtilis] | UniRef100_O32202 | Bacillus subtilis | YvqI |
| 3341 | Pectate lyase P358 [Bacillus sp. P-358] | UniRef100_Q8RR73 | Bacillus sp. P-358 | |
| 3342 | YvqK protein [Bacillus subtilis] | UniRef100_O34899 | Bacillus subtilis | YvqK |
| 3343 | UPI00002E3648 UniRef100 entry | | UniRef100_UPI00002E3648 | FabG |
| 3344 | | | | |
| 3345 | | | | GbsB |
| 3346 | | | | DapA |
| 3347 | Putative metal binding protein, YvrA [Bacillus subtilis] | UniRef100_O34631 | Bacillus subtilis | YvrA |
| 3348 | Putative hemin permease, YvrB [Bacillus subtilis] | UniRef100_O34451 | Bacillus subtilis | YvrB |
| 3349 | Putative metal binding protein, YvrC [Bacillus subtilis] | UniRef100_O34805 | Bacillus subtilis | YvrC |
| 3350 | Transcriptional regulator, GntR family [Bacillus anthracis] | UniRef100_O815A7 | Bacillus anthracis | YdhC |
| 3351 | Putative ketoreductase, YvrD [Bacillus subtilis] | UniRef100_O34782 | Bacillus subtilis | YvrD |
| 3352 | UPI00003CC410 UniRef100 entry | | UniRef100_UPI00003CC410 | YflK |
| 3353 | Transcriptional regulators, LysR family [Bacillus cereus] | UniRef100_Q81DJ6 | Bacillus cereus | AlsR |
| 3354 | Exo-poly-alpha-D-galacturonosidase, putative [Thermotoga maritima] | UniRef100_Q9WYR8 | Thermotoga maritima | |
| 3355 | Altronate hydrolase [Bacillus subtilis] | UniRef100_O34673 | Bacillus subtilis | UxaA |
| 3356 | Altronate oxidoreductase [Bacillus subtilis] | UniRef100_O34354 | Bacillus subtilis | UxaB |
| 3357 | LacI repressor-like protein [Bacillus subtilis] | UniRef100_Q9JMQ1 | Bacillus subtilis | ExuR |
| 3358 | Hypothetical symporter yjmB [Bacillus subtilis] | UniRef100_O34961 | Bacillus subtilis | YjmB |
| 3359 | Uronate isomerase [Bacillus subtilis] | UniRef100_O34808 | Bacillus subtilis | UxaC |
| 3360 | Putative sensory protein kinase, YvrG [Bacillus subtilis] | UniRef100_O34989 | Bacillus subtilis | YvrG |
| 3361 | Putative DNA binding response regulator, YvrH [Bacillus subtilis] | UniRef100_P94504 | Bacillus subtilis | YvrH |
| 3362 | Ferrichrome transport ATP-binding protein fhuC [Bacillus subtilis] | UniRef100_P49938 | Bacillus subtilis | FhuC |
| 3363 | Ferrichrome transport system permease protein fhuG [Bacillus subtilis] | UniRef100_P49937 | Bacillus subtilis | FhuG |
| 3364 | Ferrichrome transport system permease protein fhuB [Bacillus subtilis] | UniRef100_P49936 | Bacillus subtilis | FhuB |

TABLE 1-continued

Predicted functions

| SEQ ID NO. | Description | UniRef Accession No. | Organism | Bacillus subtilis homolog (Gene Name) |
|---|---|---|---|---|
| 3365 | Putative arginine ornithine antiporter, YvsH [Bacillus subtilis] | UniRef100_O32204 | Bacillus subtilis | YvsH |
| 3366 | Hypothetical protein yvsG precursor [Bacillus subtilis] | UniRef100_O32205 | Bacillus subtilis | YvsG |
| 3367 | Putative molybdate binding protein, YvgJ [Bacillus subtilis] | UniRef100_O32206 | Bacillus subtilis | YvgJ |
| 3368 | | | | YcnB |
| 3369 | Putative reductase protein, YvgN [Bacillus subtilis] | UniRef100_O32210 | Bacillus subtilis | YvgN |
| 3370 | Fructokinase [Listeria monocytogenes] | UniRef100_Q722A5 | Listeria monocytogenes | YdhR |
| 3371 | Hypothetical protein ycbU precursor [Bacillus subtilis] | UniRef100_P42253 | Bacillus subtilis | YcbU |
| 3372 | Hypothetical protein CPE0889 [Clostridium perfringens] | UniRef100_Q8XM01 | Clostridium perfringens | |
| 3373 | YvgS protein [Bacillus subtilis] | UniRef100_O32215 | Bacillus subtilis | YvgS |
| 3374 | Hypothetical UPF0126 protein yvgT [Bacillus subtilis] | UniRef100_O32216 | Bacillus subtilis | YvgT |
| 3375 | Glutamate-rich protein grpB [Bacillus cereus] | UniRef100_Q81CT5 | Bacillus cereus | YqkA |
| 3376 | Acetyltransferase, GNAT family [Bacillus thuringiensis] | UniRef100_Q6HJN8 | Bacillus thuringiensis | YuaI |
| 3377 | Disulfide bond formation protein C [Bacillus subtilis] | UniRef100_O32217 | Bacillus subtilis | BdbC |
| 3378 | Disulfide bond formation protein D precursor [Bacillus subtilis] | UniRef100_O32218 | Bacillus subtilis | BdbD |
| 3379 | YvgW protein [Bacillus subtilis] | UniRef100_O32219 | Bacillus subtilis | YvgW |
| 3380 | ABC transporter, substrate binding protein [Agrobacterium tumefaciens] | UniRef100_Q8U7T8 | Agrobacterium tumefaciens | YvfK |
| 3381 | Putative sugar transport integral membrane protein [Streptomyces coelicolor] | UniRef100_Q9K442 | Streptomyces coelicolor | YurN |
| 3382 | Putative sugar transport integral membrane protein [Streptomyces coelicolor] | UniRef100_Q9K441 | Streptomyces coelicolor | YurM |
| 3383 | Alpha-glucosidase [Clostridium acetobutylicum] | UniRef100_Q97K36 | Clostridium acetobutylicum | |
| 3384 | Glucan-glucohydrolase [Microbispora bispora] | UniRef100_Q59506 | Microbispora bispora | YbbD |
| 3385 | ABC transporter, ATP-binding protein [Bacillus anthracis] | UniRef100_Q81NK1 | Bacillus anthracis | MntB |
| 3386 | ABC transporter, permease protein [Bacillus anthracis] | UniRef100_Q81NK2 | Bacillus anthracis | MntD |
| 3387 | ABC transporter, manganese-binding protein [Listeria monocytogenes] | UniRef100_Q71YG9 | Listeria monocytogenes | YcdH |
| 3388 | Hypothetical protein [Bacillus cereus] | UniRef100_Q74NQ1 | Bacillus cereus | YhjQ |
| 3389 | Phosphosugar-binding transcriptional regulator, RpiR family, putative [Enterococcus faecalis] | UniRef100_Q837Y3 | Enterococcus faecalis | YfiA |
| 3390 | 1-phosphofructokinase [Enterococcus faecalis] | UniRef100_Q837Y2 | Enterococcus faecalis | FruK |
| 3391 | PTS system, fructose-specific family, IIBC components [Enterococcus faecalis] | UniRef100_Q837Y1 | Enterococcus faecalis | FruA |
| 3392 | PTS system, IIA component [Enterococcus faecalis] | UniRef100_Q837Y0 | Enterococcus faecalis | FruA |
| 3393 | Fructose/tagatose bisphosphate aldolase [Vibrio vulnificus] | UniRef100_Q7MC78 | Vibrio vulnificus | FbaA |
| 3394 | | | | |
| 3395 | Heavy metal-transporting ATPase [Bacillus thuringiensis] | UniRef100_Q6HF81 | Bacillus thuringiensis | YvgX |
| 3396 | Copper chaperone copZ [Bacillus subtilis] | UniRef100_O32221 | Bacillus subtilis | |
| 3397 | YvgZ protein [Bacillus subtilis] | UniRef100_O32222 | Bacillus subtilis | YvgZ |
| 3398 | Intracellular proteinase [Thermoplasma volcanium] | UniRef100_Q97BN0 | Thermoplasma volcanium | YraA |
| 3399 | Putative HTH-type transcriptional regulator yulB [Bacillus subtilis] | UniRef100_O05261 | Bacillus subtilis | YulB |
| 3400 | Rhamnulose kinase/L-fuculose kinase [Bacteroides thetaiotaomicron] | UniRef100_Q8A1A3 | Bacteroides thetaiotaomicron | YulC |

TABLE 1-continued

Predicted functions

| SEQ ID NO. | Description | UniRef Accession No. | Organism | Bacillus subtilis homolog (Gene Name) |
|---|---|---|---|---|
| 3401 | Putative sugar isomerase [*Streptomyces coelicolor*] | UniRef100_Q9XAB3 | *Streptomyces coelicolor* | |
| 3402 | Hypothetical protein [*Polyangium cellulosum*] | UniRef100_Q9L8B7 | *Polyangium cellulosum* | |
| 3403 | Hypothetical oxidoreductase yuxG [*Bacillus subtilis*] | UniRef100_P40747 | *Bacillus subtilis* | YuxG |
| 3404 | YfhI protein [*Bacillus subtilis*] | UniRef100_O31577 | *Bacillus subtilis* | YfhI |
| 3405 | YvmA [*Bacillus subtilis*] | UniRef100_O34307 | *Bacillus subtilis* | YvmA |
| 3406 | YvmC [*Bacillus subtilis*] | UniRef100_O34351 | *Bacillus subtilis* | YvmC |
| 3407 | Putative cytochrome P450 CYPX [*Bacillus subtilis*] | UniRef100_O34926 | *Bacillus subtilis* | CypX |
| 3408 | Hypothetical protein [*Chromobacterium violaceum*] | UniRef100_Q7NRR6 | *Chromobacterium violaceum* | |
| 3409 | | | | YvnA |
| 3410 | Hypothetical protein BRA0099 [*Brucella suis*] | UniRef100_Q8FXH8 | *Brucella suis* | |
| 3411 | Chloroplast Toc64-2 [*Physcomitrella patens*] | UniRef100_Q6RJN6 | *Physcomitrella patens* | GatA |
| 3412 | Hypothetical oxidoreductase yvaA [*Bacillus subtilis*] | UniRef100_O32223 | *Bacillus subtilis* | YvaA |
| 3413 | Putative acyl carrier protein phosphodiesterase 2 [*Bacillus subtilis*] | UniRef100_O32224 | *Bacillus subtilis* | YvaB |
| 3414 | Hypothetical UPF0176 protein ybfQ [*Bacillus subtilis*] | UniRef100_O31457 | *Bacillus subtilis* | YbfQ |
| 3415 | Putative DNA binding response regulator, YvrH [*Bacillus subtilis*] | UniRef100_P94504 | *Bacillus subtilis* | |
| 3416 | YvrI protein [*Bacillus subtilis*] | UniRef100_O34843 | *Bacillus subtilis* | YvrI |
| 3417 | | | | |
| 3418 | Oxalate decarboxylase oxdC [*Bacillus subtilis*] | UniRef100_O34714 | *Bacillus subtilis* | OxdC |
| 3419 | Hypothetical protein yvrL [*Bacillus subtilis*] | UniRef100_O34686 | *Bacillus subtilis* | YvrL |
| 3420 | BH3120 protein [*Bacillus halodurans*] | UniRef100_Q9K886 | *Bacillus halodurans* | |
| 3421 | | | | |
| 3422 | Group-specific protein [*Bacillus cereus* ZK] | UniRef100_Q633V1 | *Bacillus cereus* ZK | |
| 3423 | | | | |
| 3424 | | | | |
| 3425 | | | | |
| 3426 | UPI00003CC069 UniRef100 entry | UniRef100_UPI00003CC069 | | |
| 3427 | IS1627s1-related, transposase [*Bacillus anthracis str. A2012*] | UniRef100_Q7CMD0 | *Bacillus anthracis* str. A2012 | |
| 3428 | LexA repressor [*Listeria monocytogenes*] | UniRef100_Q720B9 | *Listeria monocytogenes* | |
| 3429 | Hypothetical protein [*Bacillus cereus* ZK] | UniRef100_Q630E5 | *Bacillus cereus* ZK | |
| 3430 | Hypothetical protein [*Bacillus anthracis*] | UniRef100_Q81XX1 | *Bacillus anthracis* | |
| 3431 | | | | |
| 3432 | Hypothetical protein RSc1705 [*Ralstonia solanacearum*] | UniRef100_Q8XYQ3 | *Ralstonia solanacearum* | |
| 3433 | | | | YxiD |
| 3434 | Hypothetical protein [*Bacillus thuringiensis*] | UniRef100_Q6HH72 | *Bacillus thuringiensis* | |
| 3435 | | | | BlyA |
| 3436 | | | | |
| 3437 | | | | |
| 3438 | | | | |
| 3439 | YomQ protein [Bacteriophage SPBc2] | UniRef100_O64053 | Bacteriophage SPBc2 | YomQ |
| 3440 | | | | XkdV |
| 3441 | | | | |
| 3442 | | | | |
| 3443 | | | | YubE |
| 3444 | ORF38 [Bacteriophage phi-105] | UniRef100_Q9ZXE5 | Bacteriophage phi-105 | |
| 3445 | | | | YqbO |
| 3446 | Hypothetical protein MW1895 [*Staphylococcus aureus*] | UniRef100_Q8NVQ7 | *Staphylococcus aureus* | |
| 3447 | | | | |
| 3448 | | | | |
| 3449 | Prophage LambdaBa02, major tail protein, putative [*Bacillus anthracis*] | UniRef100_Q81W97 | *Bacillus anthracis* | |

TABLE 1-continued

Predicted functions

| SEQ ID NO. | Description | UniRef Accession No. | Organism | Bacillus subtilis homolog (Gene Name) |
|---|---|---|---|---|
| 3450 | | | | |
| 3451 | ORF32 [Bacteriophage phi-105] | UniRef100_Q9ZXF1 | Bacteriophage phi-105 | |
| 3452 | | | | |
| 3453 | Gp7 protein [Bacteriophage phi3626] | UniRef100_Q8SBP7 | Bacteriophage phi3626 | |
| 3454 | ORF29 [Bacteriophage phi-105] | UniRef100_Q9ZXF4 | Bacteriophage phi-105 | |
| 3455 | ORF27 [Bacteriophage phi-105] | UniRef100_Q9ZXF6 | Bacteriophage phi-105 | |
| 3456 | ClpP family serine protease, possible phage related [Clostridium acetobutylicum] | UniRef100_Q97HW4 | Clostridium acetobutylicum | ClpP |
| 3457 | ORF25 [Bacteriophage phi-105] | UniRef100_Q9ZXF8 | Bacteriophage phi-105 | |
| 3458 | | | | |
| 3459 | Putative terminase large subunit [Bacteriophage phi3626] | UniRef100_Q8SBQ2 | Bacteriophage phi3626 | |
| 3460 | Phage terminase-like protein, small subunit [Clostridium acetobutylicum] | UniRef100_Q97HW1 | Clostridium acetobutylicum | |
| 3461 | Prophage LambdaBa02, HNH endonuclease family protein [Bacillus anthracis] | UniRef100_Q81W86 | Bacillus anthracis | |
| 3462 | Spore coat protein D [Bacillus subtilis] | UniRef100_P07791 | Bacillus subtilis | |
| 3463 | ORF16 [Bacteriophage phi-105] | UniRef100_Q9ZXB9 | Bacteriophage phi-105 | |
| 3464 | | | | |
| 3465 | | | | |
| 3466 | ORF14 [Bacteriophage phi-105] | UniRef100_Q9ZXC1 | Bacteriophage phi-105 | |
| 3467 | ORF13 [Bacteriophage phi-105] | UniRef100_Q9ZXC2 | Bacteriophage phi-105 | |
| 3468 | ORF12 [Bacteriophage phi-105] | UniRef100_Q9ZXC3 | Bacteriophage phi-105 | |
| 3469 | | | | |
| 3470 | ORF11 [Bacteriophage phi-105] | UniRef100_Q9ZXC4 | Bacteriophage phi-105 | |
| 3471 | ORF10 [Bacteriophage phi-105] | UniRef100_Q9ZXC5 | Bacteriophage phi-105 | |
| 3472 | DNA, complete sequence [Bacteriophage phi-105] | UniRef100_Q9ZXC7 | Bacteriophage phi-105 | |
| 3473 | DNA, complete sequence [Bacteriophage phi-105] | UniRef100_Q9ZXC8 | Bacteriophage phi-105 | |
| 3474 | | | | |
| 3475 | | | | |
| 3476 | | | | |
| 3477 | Orf 36 [Staphylococcus aureus bacteriophage PVL] | UniRef100_Q9T1Z5 | Staphylococcus aureus bacteriophage PVL | |
| 3478 | | | | |
| 3479 | Orf16 [Bacteriophage bIL312] | UniRef100_Q9AZE4 | Bacteriophage bIL312 | |
| 3480 | Gp26 protein [Bacteriophage phi3626] | UniRef100_Q8SBM8 | Bacteriophage phi3626 | |
| 3481 | CI like protein [Lactobacillus casei bacteriophage A2] | UniRef100_O64370 | Lactobacillus casei bacteriophage A2 | |
| 3482 | Int gene product [Staphylococcus aureus] | UniRef100_Q932E5 | Staphylococcus aureus | YdcL |
| 3483 | SsrA-binding protein [Bacillus subtilis] | UniRef100_O32230 | Bacillus subtilis | SmpB |
| 3484 | Ribonuclease R [Bacillus subtilis] | UniRef100_O32231 | Bacillus subtilis | Rnr |
| 3485 | YvaK protein [Bacillus subtilis] | UniRef100_O32232 | Bacillus subtilis | YvaK |
| 3486 | | | | |
| 3487 | | | | |
| 3488 | | | | |
| 3489 | | | | YvaO |
| 3490 | | | | YvaO |
| 3491 | Glycine betaine/carnitine/choline transport system permease protein opuCD [Bacillus subtilis] | UniRef100_O34742 | Bacillus subtilis | OpuCD |
| 3492 | Glycine betaine/carnitine/choline-binding protein precursor [Bacillus subtilis] | UniRef100_O32243 | Bacillus subtilis | OpuCC |
| 3493 | Glycine betaine/carnitine/choline transport system permease protein opuCB [Bacillus subtilis] | UniRef100_O34878 | Bacillus subtilis | OpuCB |
| 3494 | Glycine betaine/carnitine/choline transport ATP-binding protein opuCA [Bacillus subtilis] | UniRef100_O34992 | Bacillus subtilis | OpuCA |
| 3495 | ORF-1 [Bacillus subtilis] | UniRef100_O34709 | Bacillus subtilis | YvaV |
| 3496 | | | | YvbG |
| 3497 | | | | YvbI |
| 3498 | YvbJ protein [Bacillus subtilis] | UniRef100_O32247 | Bacillus subtilis | YvbJ |
| 3499 | UPI00003CBDCC UniRef100 entry | | UniRef100_UPI00003CBDCC | YfiY |
| 3500 | | | | |
| 3501 | YoaZ [Bacillus subtilis] | UniRef100_O34947 | Bacillus subtilis | YoaZ |

TABLE 1-continued

Predicted functions

| SEQ ID NO. | Description | UniRef Accession No. | Organism | Bacillus subtilis homolog (Gene Name) |
|---|---|---|---|---|
| 3502 | Enolase [*Bacillus subtilis*] | UniRef100_P37869 | *Bacillus subtilis* | Eno |
| 3503 | 2,3-bisphosphoglycerate-independent phosphoglycerate mutase [*Bacillus subtilis*] | UniRef100_P39773 | *Bacillus subtilis* | Pgm |
| 3504 | Triosephosphate isomerase [*Bacillus subtilis*] | UniRef100_P27876 | *Bacillus subtilis* | TpiA |
| 3505 | Phosphoglycerate kinase [*Bacillus subtilis*] | UniRef100_P40924 | *Bacillus subtilis* | Pgk |
| 3506 | Glyceraldehyde-3-phosphate dehydrogenase 1 [*Bacillus subtilis*] | UniRef100_P09124 | *Bacillus subtilis* | GapA |
| 3507 | Central glycolytic genes regulator [*Bacillus subtilis*] | UniRef100_O32253 | *Bacillus subtilis* | CggR |
| 3508 | Hypothetical protein yvbT [*Bacillus subtilis*] | UniRef100_O32254 | *Bacillus subtilis* | YvbT |
| 3509 | YvbW protein [*Bacillus subtilis*] | UniRef100_O32257 | *Bacillus subtilis* | YvbW |
| 3510 | | | | |
| 3511 | ABC-type multidrug transport system, ATPase component [*Thermoanaerobacter tengcongensis*] | UniRef100_Q8R7K3 | *Thermoanaerobacter tengcongensis* | YfiL |
| 3512 | | | | |
| 3513 | YvbY protein [*Bacillus subtilis*] | UniRef100_O32259 | *Bacillus subtilis* | YvbY |
| 3514 | YvfW protein [*Bacillus subtilis*] | UniRef100_O07021 | *Bacillus subtilis* | YvfW |
| 3515 | | | | YvfV |
| 3516 | Hypothetical protein yvfI [*Bacillus subtilis*] | UniRef100_O07007 | *Bacillus subtilis* | YvfI |
| 3517 | Putative L-lactate permease yvfH [*Bacillus subtilis*] | UniRef100_P71067 | *Bacillus subtilis* | YvfH |
| 3518 | RNA polymerase sigma-54 factor [*Bacillus subtilis*] | UniRef100_P24219 | *Bacillus subtilis* | SigL |
| 3519 | Hypothetical protein yvfG [*Bacillus subtilis*] | UniRef100_P71066 | *Bacillus subtilis* | |
| 3520 | Hypothetical protein yvfF [*Bacillus subtilis*] | UniRef100_P71065 | *Bacillus subtilis* | YvfF |
| 3521 | YvfE protein [*Bacillus subtilis*] | UniRef100_Q795J3 | *Bacillus subtilis* | YvfE |
| 3522 | Hypothetical protein yvfD [*Bacillus subtilis*] | UniRef100_P71063 | *Bacillus subtilis* | YvfD |
| 3523 | Hypothetical protein yvfC [*Bacillus subtilis*] | UniRef100_P71062 | *Bacillus subtilis* | YvfC |
| 3524 | | | | YvfB |
| 3525 | | | | YvfA |
| 3526 | Hypothetical protein yveT [*Bacillus subtilis*] | UniRef100_P71059 | *Bacillus subtilis* | YveT |
| 3527 | Hypothetical protein yveS [*Bacillus subtilis*] | UniRef100_P71058 | *Bacillus subtilis* | YveS |
| 3528 | Hypothetical protein yveR [*Bacillus subtilis*] | UniRef100_P71057 | *Bacillus subtilis* | YveR |
| 3529 | Hypothetical protein yveQ [*Bacillus subtilis*] | UniRef100_P71056 | *Bacillus subtilis* | YveQ |
| 3530 | Hypothetical protein yveP [*Bacillus subtilis*] | UniRef100_P71055 | *Bacillus subtilis* | YveP |
| 3531 | Hypothetical protein yveO [*Bacillus subtilis*] | UniRef100_P71054 | *Bacillus subtilis* | YveO |
| 3532 | Hypothetical protein yveN [*Bacillus subtilis*] | UniRef100_P71053 | *Bacillus subtilis* | YveN |
| 3533 | Hypothetical protein yveM [*Bacillus subtilis*] | UniRef100_P71052 | *Bacillus subtilis* | YveM |
| 3534 | | | | YveL |
| 3535 | Chain length determinant protein [*Bacillus cereus*] | UniRef100_Q72XH7 | *Bacillus cereus* | YveK |
| 3536 | Hypothetical protein yveJ [*Bacillus subtilis*] | UniRef100_P71049 | *Bacillus subtilis* | Slr |
| 3537 | General stress protein 14 [*Bacillus subtilis*] | UniRef100_P80871 | *Bacillus subtilis* | YwrO |
| 3538 | | | | YcbE |
| 3539 | UPI000027D43B UniRef100 entry | UniRef100_UPI000027D43B | | YvcT |
| 3540 | 4-hydroxythreonine-4-phosphate dehydrogenase (EC 1.1.1.262) (4-(phosphohydroxy)-L-threonine dehydrogenase) [*Oceanobacillus iheyensis*] | UniRef100_Q8CUU4 | *Oceanobacillus iheyensis* | |

TABLE 1-continued

Predicted functions

| SEQ ID NO. | Description | UniRef Accession No. | Organism | *Bacillus subtilis* homolog (Gene Name) |
|---|---|---|---|---|
| 3541 | Hypothetical conserved protein [*Oceanobacillus iheyensis*] | UniRef100_Q8CUU5 | *Oceanobacillus iheyensis* | |
| 3542 | | | | GbsB |
| 3543 | | | | DapA |
| 3544 | Transcriptional regulator [*Oceanobacillus iheyensis*] | UniRef100_Q8CUU7 | *Oceanobacillus iheyensis* | RocR |
| 3545 | Hypothetical protein [*Bdellovibrio bacteriovorus*] | UniRef100_Q6MH73 | *Bdellovibrio bacteriovorus* | |
| 3546 | NADH-dependent flavin oxidoreductase [*Oceanobacillus iheyensis*] | UniRef100_Q8ELB6 | *Oceanobacillus iheyensis* | YqiG |
| 3547 | Levansucrase precursor [*Bacillus subtilis*] | UniRef100_P05655 | *Bacillus subtilis* | SacB |
| 3548 | Hypothetical protein yveB [*Bacillus subtilis*] | UniRef100_O07003 | *Bacillus subtilis* | YveB |
| 3549 | Hypothetical protein [*Pseudomonas aeruginosa*] | UniRef100_Q9I5B4 | *Pseudomonas aeruginosa* | |
| 3550 | ATP-dependent Clp protease proteolytic subunit [*Bacillus subtilis*] | UniRef100_P80244 | *Bacillus subtilis* | ClpP |
| 3551 | Hypothetical protein yvdD [*Bacillus subtilis*] | UniRef100_O06986 | *Bacillus subtilis* | YvdD |
| 3552 | | | | |
| 3553 | Possible metal-dependent phosphohydrolase; possible oxetanocin A resistance protein [*Bacillus thuringiensis*] | UniRef100_Q6HM73 | *Bacillus thuringiensis* | YdhJ |
| 3554 | Hypothetical protein yvdB [*Bacillus subtilis*] | UniRef100_O06984 | *Bacillus subtilis* | YvdB |
| 3555 | Hypothetical protein yvdA [*Bacillus subtilis*] | UniRef100_O06983 | *Bacillus subtilis* | YvdA |
| 3556 | Probable 2-ketogluconate reductase [*Bacillus subtilis*] | UniRef100_O32264 | *Bacillus subtilis* | YvcT |
| 3557 | BH0392 protein [*Bacillus halodurans*] | UniRef100_Q9KFT5 | *Bacillus halodurans* | YdfE |
| 3558 | BH0391 protein [*Bacillus halodurans*] | UniRef100_Q9KFT6 | *Bacillus halodurans* | YdfF |
| 3559 | Ribonuclease [*Paenibacillus polymyxa*] | UniRef100_Q7M0X3 | *Paenibacillus polymyxa* | |
| 3560 | Barstar [*Bacillus amyloliquefaciens*] | UniRef100_P11540 | *Bacillus amyloliquefaciens* | |
| 3561 | Hypothetical protein yvcN [*Bacillus subtilis*] | UniRef100_O06977 | *Bacillus subtilis* | YvcN |
| 3562 | HPr-like protein crh [*Bacillus subtilis*] | UniRef100_O06976 | *Bacillus subtilis* | |
| 3563 | Hypothetical protein yvcL [*Bacillus subtilis*] | UniRef100_O06975 | *Bacillus subtilis* | YvcL |
| 3564 | Hypothetical UPF0052 protein yvcK [*Bacillus subtilis*] | UniRef100_O06974 | *Bacillus subtilis* | YvcK |
| 3565 | Hypothetical UPF0042 protein yvcJ [*Bacillus subtilis*] | UniRef100_O06973 | *Bacillus subtilis* | YvcJ |
| 3566 | Hypothetical protein yvcI [*Bacillus subtilis*] | UniRef100_O06972 | *Bacillus subtilis* | YvcI |
| 3567 | Thioredoxin reductase [*Bacillus subtilis*] | UniRef100_P80880 | *Bacillus subtilis* | TrxB |
| 3568 | Hypothetical protein yvcD [*Bacillus subtilis*] | UniRef100_O06968 | *Bacillus subtilis* | YvcD |
| 3569 | Hypothetical conserved protein [*Oceanobacillus iheyensis*] | UniRef100_Q8ETL1 | *Oceanobacillus iheyensis* | YbbJ |
| 3570 | Histidine biosynthesis bifunctional protein hisIE [Includes: Phosphoribosyl-AMP cyclohydrolase (EC 3.5.4.19) (PRA-CH); Phosphoribosyl-ATP pyrophosphatase (EC 3.6.1.31) (PRA-PH)] [*Bacillus subtilis*] | UniRef100_O34912 | Includes: Phosphoribosyl-AMP cyclohydrolase (EC 3.5.4.19) (PRA-CH); Phosphoribosyl-ATP pyrophosphatase (EC 3.6.1.31) (PRA-PH) | HisI |
| 3571 | Imidazole glycerol phosphate synthase subunit hisF [*Bacillus subtilis*] | UniRef100_O34727 | *Bacillus subtilis* | HisF |
| 3572 | 1-(5-phosphoribosyl)-5-[(5-phosphoribosylamino)methylideneamino] imidazole-4-carboxamide isomerase [*Bacillus subtilis*] | UniRef100_O35006 | (5-phosphoribosylamino) methylideneamino | HisA |

TABLE 1-continued

Predicted functions

| SEQ ID NO. | Description | UniRef Accession No. | Organism | Bacillus subtilis homolog (Gene Name) |
|---|---|---|---|---|
| 3573 | Imidazole glycerol phosphate synthase subunit hisH [*Bacillus subtilis*] | UniRef100_O34565 | *Bacillus subtilis* | HisH |
| 3574 | Imidazoleglycerol-phosphate dehydratase [*Bacillus subtilis*] | UniRef100_O34683 | *Bacillus subtilis* | HisB |
| 3575 | Histidinol dehydrogenase [*Bacillus subtilis*] | UniRef100_O34651 | *Bacillus subtilis* | HisD |
| 3576 | ATP phosphoribosyltransferase [*Bacillus subtilis*] | UniRef100_O34520 | *Bacillus subtilis* | HisG |
| 3577 | | | | HisZ |
| 3578 | YvpB [*Bacillus subtilis*] | UniRef100_O34735 | *Bacillus subtilis* | YvpB |
| 3579 | Pectate lyase Pel-28K [*Bacillus* sp. P-2850] | UniRef100_Q8L0R5 | *Bacillus* sp. P-2850 | YvpA |
| 3580 | Putative acetyltransferase [*Bacillus subtilis*] | UniRef100_O34993 | *Bacillus subtilis* | YvoF |
| 3581 | Pyrophosphatase ppaX [*Bacillus subtilis*] | UniRef100_Q9JMQ2 | *Bacillus subtilis* | HprP |
| 3582 | YvoD [*Bacillus subtilis*] | UniRef100_O34382 | *Bacillus subtilis* | YvoD |
| 3583 | Prolipoprotein diacylglyceryl transferase [*Bacillus subtilis*] | UniRef100_O34752 | *Bacillus subtilis* | Lgt |
| 3584 | HPr kinase/phosphorylase (EC 2.7.1.—) (EC 2.7.4.—) (HPrK/P) (HPr(Ser) kinase/phosphorylase) [*Bacillus subtilis*] | UniRef100_O34483 | *Bacillus subtilis* | HprK |
| 3585 | YfiV protein [*Bacillus subtilis*] | UniRef100_O31564 | *Bacillus subtilis* | YfiV |
| 3586 | YfiU protein [*Bacillus subtilis*] | UniRef100_O31563 | *Bacillus subtilis* | YfiU |
| 3587 | YvnB [*Bacillus subtilis*] | UniRef100_O34986 | *Bacillus subtilis* | YvnB |
| 3588 | YvlD [*Bacillus subtilis*] | UniRef100_O34648 | *Bacillus subtilis* | YvlD |
| 3589 | YvlC [*Bacillus subtilis*] | UniRef100_O34719 | *Bacillus subtilis* | |
| 3590 | YvlB [*Bacillus subtilis*] | UniRef100_O34628 | *Bacillus subtilis* | YvlB |
| 3591 | Hypothetical protein yvlA [*Bacillus subtilis*] | UniRef100_O34322 | *Bacillus subtilis* | YvlA |
| 3592 | Hypothetical protein yvkN [*Bacillus subtilis*] | UniRef100_O34604 | *Bacillus subtilis* | |
| 3593 | | | | |
| 3594 | UvrABC system protein A [*Bacillus subtilis*] | UniRef100_O34863 | *Bacillus subtilis* | UvrA |
| 3595 | UvrABC system protein B [*Bacillus amyloliquefaciens*] | UniRef100_Q659H3 | *Bacillus amyloliquefaciens* | UvrB |
| 3596 | CsbA protein [*Bacillus subtilis*] | UniRef100_P37953 | *Bacillus subtilis* | |
| 3597 | | | | |
| 3598 | YvjD [*Bacillus subtilis*] | UniRef100_O34375 | *Bacillus subtilis* | YvjD |
| 3599 | | | | YvzD |
| 3600 | Putative protease [*Bacillus subtilis*] | UniRef100_O35002 | *Bacillus subtilis* | YvjB |
| 3601 | Tartrate dehydrogenase [*Oceanobacillus iheyensis*] | UniRef100_Q8ESH5 | *Oceanobacillus iheyensis* | YcsA |
| 3602 | Cell wall-binding protein [*Bacillus halodurans*] | UniRef100_Q9K6X4 | *Bacillus halodurans* | YvcE |
| 3603 | Cell division protein ftsX homolog [*Bacillus subtilis*] | UniRef100_O34876 | *Bacillus subtilis* | FtsX |
| 3604 | Cell division ATP-binding protein [*Bacillus subtilis*] | UniRef100_O34814 | *Bacillus subtilis* | FtsE |
| 3605 | Cytochrome c-551 [*Bacillus subtilis*] | UniRef100_O34594 | *Bacillus subtilis* | CccB |
| 3606 | YvjA [*Bacillus subtilis*] | UniRef100_O34792 | *Bacillus subtilis* | YvjA |
| 3607 | Peptide chain release factor 2 [*Bacillus subtilis*] | UniRef100_P28367 | *Bacillus subtilis* | PrfB |
| 3608 | Preprotein translocase secA subunit [*Bacillus subtilis*] | UniRef100_P28366 | *Bacillus subtilis* | SecA |
| 3609 | Hypothetical protein yvyD [*Bacillus subtilis*] | UniRef100_P28368 | *Bacillus subtilis* | YvyD |
| 3610 | | | | |
| 3611 | Flagellar protein fliT [*Bacillus subtilis*] | UniRef100_P39740 | *Bacillus subtilis* | FliT |
| 3612 | Flagellar protein fliS [*Bacillus subtilis*] | UniRef100_P39739 | *Bacillus subtilis* | FliS |
| 3613 | Flagellar hook-associated protein 2 [*Bacillus subtilis*] | UniRef100_P39738 | *Bacillus subtilis* | FliD |
| 3614 | Hypothetical protein yvyC [*Bacillus subtilis*] | UniRef100_P39737 | *Bacillus subtilis* | YvyC |
| 3615 | Flagellin [*Bacillus subtilis*] | UniRef100_P02968 | *Bacillus subtilis* | Hag |
| 3616 | Carbon storage regulator homolog [*Bacillus subtilis*] | UniRef100_P33911 | *Bacillus subtilis* | |
| 3617 | Transmembrane protein [*Bacillus subtilis*] | UniRef100_P96503 | *Bacillus subtilis* | YviF |

TABLE 1-continued

Predicted functions

| SEQ ID NO. | Description | UniRef Accession No. | Organism | Bacillus subtilis homolog (Gene Name) |
|---|---|---|---|---|
| 3618 | YviE protein [*Bacillus subtilis*] | UniRef100_P96502 | *Bacillus subtilis* | YviE |
| 3619 | Flagellar hook-associated protein 3 [*Bacillus subtilis*] | UniRef100_P96501 | *Bacillus subtilis* | FlgL |
| 3620 | Flagellar hook-associated protein 1 [*Bacillus subtilis*] | UniRef100_P39810 | *Bacillus subtilis* | FlgK |
| 3621 | Hypothetical protein yvyG [*Bacillus subtilis*] | UniRef100_P39808 | *Bacillus subtilis* | YvyG |
| 3622 | Negative regulator of flagellin synthesis [*Bacillus subtilis*] | UniRef100_P39809 | *Bacillus subtilis* | |
| 3623 | Hypothetical protein yvyF [*Bacillus subtilis*] | UniRef100_P39807 | *Bacillus subtilis* | YvyF |
| 3624 | | | | ComFC |
| 3625 | | | | |
| 3626 | | | | ComFA |
| 3627 | DegV protein [*Bacillus subtilis*] | UniRef100_P32436 | *Bacillus subtilis* | YviA |
| 3628 | Transcriptional regulatory protein degU [*Bacillus subtilis*] | UniRef100_P13800 | *Bacillus subtilis* | DegU |
| 3629 | | | | DegS |
| 3630 | Hypothetical UPF0029 protein yvyE [*Bacillus subtilis*] | UniRef100_P32437 | *Bacillus subtilis* | YvyE |
| 3631 | Putative transcriptional regulator [*Bacillus subtilis*] | UniRef100_P96499 | *Bacillus subtilis* | YvhJ |
| 3632 | Hypothetical protein yunG [*Bacillus cereus* ZK] | UniRef100_Q63CU2 | *Bacillus cereus* ZK | YunG |
| 3633 | Probable undecaprenyl-phosphate N-acetylglucosaminyl 1-phosphate transferase [*Bacillus subtilis*] | UniRef100_O34753 | *Bacillus subtilis* | TagO |
| 3634 | Putative teichuronic acid biosynthesis glycosyl transferase tuaH [*Bacillus subtilis*] | UniRef100_O32267 | *Bacillus subtilis* | TuaH |
| 3635 | Putative teichuronic acid biosynthesis glycosyl transferase tuaG [*Bacillus subtilis*] | UniRef100_O32268 | *Bacillus subtilis* | TuaG |
| 3636 | Teichuronic acid biosynthesis protein tuaF [*Bacillus subtilis*] | UniRef100_O32269 | *Bacillus subtilis* | TuaF |
| 3637 | Teichuronic acid biosynthesis protein tuaE (Bacillus subtilis] | UniRef100_O32270 | *Bacillus subtilis* | TuaE |
| 3638 | Putative UDP-glucose 4-epimerase [*Methanococcus jannaschii*] | UniRef100_Q57664 | *Methanococcus jannaschii* | GalE |
| 3639 | UDP-glucose 6-dehydrogenase [*Bacillus subtilis*] | UniRef100_O32271 | *Bacillus subtilis* | TuaD |
| 3640 | Putative teichuronic acid biosynthesis glycosyl transferase tuaC [*Bacillus subtilis*] | UniRef100_O32272 | *Bacillus subtilis* | TuaC |
| 3641 | Teichuronic acid biosynthesis protein tuaB [*Bacillus subtilis*] | UniRef100_O32273 | *Bacillus subtilis* | TuaB |
| 3642 | UPI00003CB85E UniRef100 entry | UniRef100_UPI00003CB85E | | TuaA |
| 3643 | | | | LytC |
| 3644 | Amidase enhancer precursor [*Bacillus subtilis*] | UniRef100_Q02113 | *Bacillus subtilis* | LytB |
| 3645 | | | | LytA |
| 3646 | Membrane-bound protein lytR [*Bacillus subtilis*] | UniRef100_Q02115 | *Bacillus subtilis* | LytR |
| 3647 | UDP-N-acetylglucosamine 2-epimerase [*Bacillus subtilis*] | UniRef100_P39131 | *Bacillus subtilis* | YvyH |
| 3648 | UTP--glucose-1-phosphate uridylyltransferase [*Bacillus subtilis*] | UniRef100_Q05852 | *Bacillus subtilis* | GtaB |
| 3649 | | | | TagH |
| 3650 | Teichoic acid translocation permease protein tagG [*Bacillus subtilis*] | UniRef100_P42953 | *Bacillus subtilis* | TagG |
| 3651 | Teichoic acid biosynthesis protein [*Lactococcus lactis*] | UniRef100_Q9CH20 | *Lactococcus lactis* | TagF |
| 3652 | CDP-glycerol: poly(glycerophosphate) glycerophotransferase [*Bacillus subtilis*] | UniRef100_P13485 | *Bacillus subtilis* | TagF |
| 3653 | | | | TagD |
| 3654 | | | | TagA |
| 3655 | Putative CDP-glycerol: glycerophosphate glycerophosphotransferase [*Bacillus subtilis*] | UniRef100_P27621 | *Bacillus subtilis* | TagB |

TABLE 1-continued

Predicted functions

| SEQ ID NO. | Description | UniRef Accession No. | Organism | Bacillus subtilis homolog (Gene Name) |
|---|---|---|---|---|
| 3656 | Beta-N-acetylglucosaminidase precursor [Bacillus subtilis] | UniRef100_P39848 | Bacillus subtilis | LytD |
| 3657 | Mannose-6-phosphate isomerase [Bacillus subtilis] | UniRef100_P39841 | Bacillus subtilis | Pmi |
| 3658 | | | | |
| 3659 | Anaerobic ribonucleoside-triphosphate reductase, putative [Bacillus cereus] | UniRef100_Q733N6 | Bacillus cereus | |
| 3660 | 2-keto-3-deoxygluconate permease [Bacillus subtilis] | UniRef100_P50847 | Bacillus subtilis | KdgT |
| 3661 | KHG/KDPG aldolase [Includes: 4-hydroxy-2-oxoglutarate aldolase (EC 4.1.3.16) (2-keto-4-hydroxyglutarate aldolase) (KHG-aldolase); 2-dehydro-3-deoxy-phosphogluconate aldolase (EC 4.1.2.14) (Phospho-2-dehydro-3-deoxygluconate aldolase) (Phospho-2-keto-3-d | UniRef100_P50846 | Includes: 4-hydroxy-2-oxoglutarate aldolase (EC 4.1.3.16) (2-keto-4-hydroxyglutarate aldolase) (KHG-aldolase); 2-dehydro-3-deoxy-phosphogluconate aldolase (EC 4.1.2.14) (Phospho-2-dehydro-3-deoxygluconate aldolase) (Phospho-2-keto-3-deoxygluconate aldol | KdgA |
| 3662 | 2-dehydro-3-deoxygluconokinase [Bacillus subtilis] | UniRef100_P50845 | Bacillus subtilis | KdgK |
| 3663 | HTH-type transcriptional regulator kdgR [Bacillus subtilis] | UniRef100_P50844 | Bacillus subtilis | KdgR |
| 3664 | | | | KduI |
| 3665 | 2-deoxy-D-gluconate 3-dehydrogenase [Bacillus subtilis] | UniRef100_P50842 | Bacillus subtilis | KduD |
| 3666 | Alcohol dehydrogenase, glutathione-dependent formaldehyde dehydrogenase [Bacillus thuringiensis] | UniRef100_Q6HGX1 | Bacillus thuringiensis | AdhB |
| 3667 | YwtG protein [Bacillus subtilis] | UniRef100_P96742 | Bacillus subtilis | YwtG |
| 3668 | Hypothetical transcriptional regulator ywtF [Bacillus subtilis] | UniRef100_Q7WY78 | Bacillus subtilis | YwtF |
| 3669 | YwtE protein [Bacillus subtilis] | UniRef100_P96741 | Bacillus subtilis | YwtE |
| 3670 | Gamma-DL-glutamyl hydrolase precursor [Bacillus subtilis] | UniRef100_P96740 | Bacillus subtilis | YwtD |
| 3671 | | | | |
| 3672 | YwtB protein [Bacillus subtilis] | UniRef100_P96738 | Bacillus subtilis | YwtB |
| 3673 | YwtA protein [Bacillus subtilis] | UniRef100_P96737 | Bacillus subtilis | YwtA |
| 3674 | YwsC protein [Bacillus subtilis] | UniRef100_P96736 | Bacillus subtilis | YwsC |
| 3675 | | | | RbsR |
| 3676 | Ribokinase [Bacillus subtilis] | UniRef100_P36945 | Bacillus subtilis | RbsK |
| 3677 | High affinity ribose transport protein rbsD [Bacillus subtilis] | UniRef100_P36946 | Bacillus subtilis | RbsD |
| 3678 | Ribose transport ATP-binding protein rbsA [Bacillus subtilis] | UniRef100_P36947 | Bacillus subtilis | RbsA |
| 3679 | Ribose transport system permease protein rbsC [Bacillus subtilis] | UniRef100_P36948 | Bacillus subtilis | RbsC |
| 3680 | D-ribose-binding protein precursor [Bacillus subtilis] | UniRef100_P36949 | Bacillus subtilis | RbsB |
| 3681 | Alpha-acetolactate decarboxylase [Bacillus subtilis] | UniRef100_Q04777 | Bacillus subtilis | AlsD |
| 3682 | Acetolactate synthase [Bacillus subtilis] | UniRef100_Q04789 | Bacillus subtilis | AlsS |
| 3683 | HTH-type transcriptional regulator alsR [Bacillus subtilis] | UniRef100_Q04778 | Bacillus subtilis | AlsR |
| 3684 | YwrD protein [Bacillus subtilis] | UniRef100_O05218 | Bacillus subtilis | YwrD |
| 3685 | YwrC protein [Bacillus subtilis] | UniRef100_O05217 | Bacillus subtilis | YwrC |
| 3686 | YwrB protein [Bacillus subtilis] | UniRef100_O05216 | Bacillus subtilis | YwrB |
| 3687 | YwrA protein [Bacillus subtilis] | UniRef100_O05215 | Bacillus subtilis | YwrA |

TABLE 1-continued

Predicted functions

| SEQ ID NO. | Description | UniRef Accession No. | Organism | Bacillus subtilis homolog (Gene Name) |
|---|---|---|---|---|
| 3688 | Putative protein-tyrosine phosphatase ywqE [Bacillus subtilis] | UniRef100_P96717 | Bacillus subtilis | YwqE |
| 3689 | Hypothetical protein ywqC [Bacillus subtilis] | UniRef100_P96715 | Bacillus subtilis | YwqC |
| 3690 | Hypothetical protein ywqB [Bacillus subtilis] | UniRef100_P96714 | Bacillus subtilis | YwqB |
| 3691 | YwqA protein [Bacillus subtilis] | UniRef100_P94593 | Bacillus subtilis | YwqA |
| 3692 | YwpJ protein [Bacillus subtilis] | UniRef100_P94592 | Bacillus subtilis | YwpJ |
| 3693 | YwpI protein [Bacillus subtilis] | UniRef100_P94591 | Bacillus subtilis | GlcR |
| 3694 | Fructose-6-phosphate aldolase 2 [Escherichia coli O157:H7] | UniRef100_P58424 | Escherichia coli O157:H7 | YwjH |
| 3695 | Hypothetical protein PM1968 [Pasteurella multocida] | UniRef100_Q9CJM9 | Pasteurella multocida | FabG |
| 3696 | PTS system, sorbitol-specific IIA component [Enterococcus faecalis] | UniRef100_Q82YX6 | Enterococcus faecalis | |
| 3697 | PTS system, sorbitol-specific IIBC components [Enterococcus faecalis] | UniRef100_Q82YX5 | Enterococcus faecalis | |
| 3698 | UPI00002F4A3A UniRef100 entry | | UniRef100_UPI00002F4A3A | |
| 3699 | Sorbitol operon activator [Streptococcus mutans] | UniRef100_Q9X673 | Streptococcus mutans | |
| 3700 | Putative transcriptional regulator of sorbose uptake and utilization genes [Shigella flexneri] | UniRef100_Q83PA8 | Shigella flexneri | DeoR |
| 3701 | YwpH protein [Bacillus subtilis] | UniRef100_P94590 | Bacillus subtilis | YwpH |
| 3702 | Hypothetical protein ywpG [Bacillus subtilis] | UniRef100_P94589 | Bacillus subtilis | YwpG |
| 3703 | YwpF protein [Bacillus subtilis] | UniRef100_P94588 | Bacillus subtilis | YwpF |
| 3704 | Large-conductance mechanosensitive channel [Bacillus subtilis] | UniRef100_P94585 | Bacillus subtilis | MscL |
| 3705 | (3R)-hydroxymyristoyl-[acyl carrier protein] dehydratase (EC 4.2.1.—) ((3R)-hydroxymyristoyl ACP dehydrase) [Bacillus anthracis] | UniRef100_Q81JE0 | acyl carrier protein | YwpB |
| 3706 | Flagellar hook-basal body complex protein flhP [Bacillus subtilis] | UniRef100_P39753 | Bacillus subtilis | FlhP |
| 3707 | Flagellar hook-basal body complex protein flhO [Bacillus subtilis] | UniRef100_P39752 | Bacillus subtilis | FlhO |
| 3708 | MreB-like protein [Bacillus subtilis] | UniRef100_P39751 | Bacillus subtilis | MbI |
| 3709 | Stage III sporulation protein D [Bacillus subtilis] | UniRef100_P15281 | Bacillus subtilis | |
| 3710 | | | | |
| 3711 | Hypothetical protein ywoH [Bacillus subtilis] | UniRef100_P94578 | Bacillus subtilis | YwoH |
| 3712 | Hypothetical protein ywoG [Bacillus subtilis] | UniRef100_P94577 | Bacillus subtilis | YwoG |
| 3713 | Hypothetical protein ywoA [Bacillus subtilis] | UniRef100_P94571 | Bacillus subtilis | YwoA |
| 3714 | Manganese-dependent inorganic pyrophosphatase [Bacillus cereus ZK] | UniRef100_Q63AC7 | Bacillus cereus ZK | PpaC |
| 3715 | Probable manganese catalase [Bacillus subtilis] | UniRef100_P80878 | Bacillus subtilis | YdbD |
| 3716 | Hypothetical protein yqjF [Bacillus subtilis] | UniRef100_P54543 | Bacillus subtilis | YqjF |
| 3717 | BH2605 protein [Bacillus halodurans] | UniRef100_Q9K9P0 | Bacillus halodurans | YhcV |
| 3718 | Hypothetical protein yqxL [Bacillus subtilis] | UniRef100_P40948 | Bacillus subtilis | YqxL |
| 3719 | Hypothetical UPF0053 protein yqhB [Bacillus subtilis] | UniRef100_P54505 | Bacillus subtilis | YqhB |
| 3720 | Ammonium transporter nrgA [Bacillus subtilis] | UniRef100_Q07429 | Bacillus subtilis | NrgA |
| 3721 | Nitrogen regulatory PII-like protein [Bacillus subtilis] | UniRef100_Q07428 | Bacillus subtilis | NrgB |
| 3722 | ATP-dependent Clp protease proteolytic subunit [Bacillus cereus] | UniRef100_Q81CH1 | Bacillus cereus | ClpP |
| 3723 | RNA polymerase ECF-type sigma factor [Bacillus cereus ZK] | UniRef100_Q63AF9 | Bacillus cereus ZK | SigM |
| 3724 | Hypothetical protein ywnI [Bacillus subtilis] | UniRef100_P71044 | Bacillus subtilis | SpoIIQ |
| 3725 | Hypothetical protein ywnH [Bacillus subtilis] | UniRef100_P71043 | Bacillus subtilis | YwnH |

TABLE 1-continued

Predicted functions

| SEQ ID NO. | Description | UniRef Accession No. | Organism | Bacillus subtilis homolog (Gene Name) |
|---|---|---|---|---|
| 3726 | Hypothetical protein ywnF [Bacillus subtilis] | UniRef100_P71041 | Bacillus subtilis | YwnF |
| 3727 | Probable cardiolipin synthetase 2 [Bacillus subtilis] | UniRef100_P71040 | Bacillus subtilis | YwnE |
| 3728 | UPI00003CB764 UniRef100 entry | | UniRef100_UPI00003CB764 | YhcA |
| 3729 | Antibiotic/siderophore biosynthesis protein [Bacillus cereus] | UniRef100_Q81DP7 | Bacillus cereus | |
| 3730 | Probable serine activating enzyme [Bacillus subtilis] | UniRef100_P45745 | Bacillus subtilis | DhbF |
| 3731 | Isochorismatase [Bacillus subtilis] | UniRef100_P45743 | Bacillus subtilis | DhbB |
| 3732 | 2,3-dihydroxybenzoate-AMP ligase [Bacillus subtilis] | UniRef100_P40871 | Bacillus subtilis | DhbE |
| 3733 | Isochorismate synthase dhbC [Bacillus subtilis] | UniRef100_P45744 | Bacillus subtilis | DhbC |
| 3734 | 2,3-dihydro-2,3-dihydroxybenzoate dehydrogenase [Bacillus subtilis] | UniRef100_P39071 | Bacillus subtilis | DhbA |
| 3735 | YuiI protein [Bacillus subtilis] | UniRef100_O32102 | Bacillus subtilis | YuiI |
| 3736 | Iron-uptake system permease protein feuC [Bacillus subtilis] | UniRef100_P40411 | Bacillus subtilis | FeuC |
| 3737 | Iron-uptake system permease protein feuB [Bacillus subtilis] | UniRef100_P40410 | Bacillus subtilis | FeuB |
| 3738 | Iron-uptake system binding protein precursor [Bacillus subtilis] | UniRef100_P40409 | Bacillus subtilis | FeuA |
| 3739 | Putative HTH-type transcriptional regulator ybbB [Bacillus subtilis] | UniRef100_P40408 | Bacillus subtilis | YbbB |
| 3740 | Hypothetical protein ywnG [Bacillus subtilis] | UniRef100_P71042 | Bacillus subtilis | YwnC |
| 3741 | UPI00003CC069 UniRef100 entry | | UniRef100_UPI00003CC069 | |
| 3742 | IS1627s1-related, transposase [Bacillus anthracis str. A2012] | UniRef100_Q7CMD0 | Bacillus anthracis str. A2012 | |
| 3743 | Hypothetical protein ywnB [Bacillus subtilis] | UniRef100_P71037 | Bacillus subtilis | YwnB |
| 3744 | Hypothetical protein ywnA [Bacillus subtilis] | UniRef100_P71036 | Bacillus subtilis | YwnA |
| 3745 | | | | |
| 3746 | Hypothetical protein ywmF [Bacillus subtilis] | UniRef100_P70963 | Bacillus subtilis | YwmF |
| 3747 | | | | MoaA |
| 3748 | FdhD protein homolog [Bacillus subtilis] | UniRef100_P39756 | Bacillus subtilis | FdhD |
| 3749 | BH2528 protein [Bacillus halodurans] | UniRef100_Q9K9W7 | Bacillus halodurans | YbfB |
| 3750 | Formate dehydrogenase alpha chain [Bacillus halodurans] | UniRef100_Q9K9W5 | Bacillus halodurans | YjgC |
| 3751 | | | | YwmD |
| 3752 | Hypothetical protein ywmC precursor [Bacillus subtilis] | UniRef100_P70960 | Bacillus subtilis | YwmC |
| 3753 | Stage II sporulation protein D [Bacillus subtilis] | UniRef100_P07372 | Bacillus subtilis | SpoIID |
| 3754 | UDP-N-acetylglucosamine 1-carboxyvinyltransferase 1 [Bacillus subtilis] | UniRef100_P70965 | Bacillus subtilis | MurAA |
| 3755 | YwmB protein [Bacillus subtilis] | UniRef100_O32277 | Bacillus subtilis | YwmB |
| 3756 | YwzB protein [Bacillus subtilis] | UniRef100_O32278 | Bacillus subtilis | |
| 3757 | ATP synthase epsilon chain [Bacillus subtilis] | UniRef100_P37812 | Bacillus subtilis | AtpC |
| 3758 | ATP synthase beta chain [Bacillus subtilis] | UniRef100_P37809 | Bacillus subtilis | AtpD |
| 3759 | ATP synthase gamma chain [Bacillus subtilis] | UniRef100_P37810 | Bacillus subtilis | AtpG |
| 3760 | ATP synthase alpha chain [Bacillus amyloliquefaciens] | UniRef100_Q659H2 | Bacillus amyloliquefaciens | AtpA |
| 3761 | ATP synthase delta chain [Bacillus subtilis] | UniRef100_P37811 | Bacillus subtilis | AtpH |
| 3762 | ATP synthase B chain [Bacillus subtilis] | UniRef100_P37814 | Bacillus subtilis | AtpF |
| 3763 | ATP synthase a chain [Bacillus subtilis] | UniRef100_P37813 | Bacillus subtilis | AtpB |
| 3764 | | | | AtpI |
| 3765 | Uracil phosphoribosyltransferase [Bacillus subtilis] | UniRef100_P39149 | Bacillus subtilis | Upp |
| 3766 | Serine hydroxymethyltransferase [Bacillus subtilis] | UniRef100_P39148 | Bacillus subtilis | GlyA |

TABLE 1-continued

Predicted functions

| SEQ ID NO. | Description | UniRef Accession No. | Organism | Bacillus subtilis homolog (Gene Name) |
|---|---|---|---|---|
| 3767 | Hypothetical protein ywlG [Bacillus subtilis] | UniRef100_P39157 | Bacillus subtilis | YwlG |
| 3768 | Hypothetical lacA/rpiB family protein ywlF [Bacillus subtilis] | UniRef100_P39156 | Bacillus subtilis | YwlF |
| 3769 | Putative low molecular weight protein-tyrosine-phosphatase ywlE [Bacillus subtilis] | UniRef100_P39155 | Bacillus subtilis | YwlE |
| 3770 | Hypothetical UPF0059 protein ywlD [Bacillus subtilis] | UniRef100_P39154 | Bacillus subtilis | YwlD |
| 3771 | Hypothetical protein ywlC [Bacillus subtilis] | UniRef100_P39153 | Bacillus subtilis | YwlC |
| 3772 | Hypothetical protein ywlB [Bacillus subtilis] | UniRef100_P39152 | Bacillus subtilis | YwlB |
| 3773 | Stage II sporulation protein R [Bacillus subtilis] | UniRef100_P39151 | Bacillus subtilis | SpoIIR |
| 3774 | Hypothetical protein yhjI [Bacillus subtilis] | UniRef100_O07563 | Bacillus subtilis | GlcP |
| 3775 | Hypothetical protein yhjJ [Bacillus subtilis] | UniRef100_O07564 | Bacillus subtilis | YhjJ |
| 3776 | Hypothetical protein [Bacillus anthracis] | UniRef100_Q81NC8 | Bacillus anthracis | YhjK |
| 3777 | Hypothetical protein yhjL [Bacillus subtilis] | UniRef100_O07566 | Bacillus subtilis | YhjL |
| 3778 | Hypothetical protein yhjM [Bacillus subtilis] | UniRef100_O07567 | Bacillus subtilis | YhjM |
| 3779 | HemK protein homolog [Bacillus subtilis] | UniRef100_P45873 | Bacillus subtilis | YwkE |
| 3780 | Peptide chain release factor 1 [Bacillus subtilis] | UniRef100_P45872 | Bacillus subtilis | PrfA |
| 3781 | Hypothetical protein ywkD [Bacillus subtilis] | UniRef100_P45871 | Bacillus subtilis | YwkD |
| 3782 | Hypothetical protein ywkC [Bacillus subtilis] | UniRef100_P45870 | Bacillus subtilis | YwkC |
| 3783 | Hypothetical protein ywkB [Bacillus subtilis] | UniRef100_P45869 | Bacillus subtilis | YwkB |
| 3784 | Probable NAD-dependent malic enzyme 2 [Bacillus subtilis] | UniRef100_P45868 | Bacillus subtilis | YwkA |
| 3785 | Thymidine kinase [Bacillus subtilis] | UniRef100_Q03221 | Bacillus subtilis | Tdk |
| 3786 | 50S ribosomal protein L31 [Bacillus subtilis] | UniRef100_Q03223 | Bacillus subtilis | |
| 3787 | Transcription termination factor rho [Bacillus subtilis] | UniRef100_Q03222 | Bacillus subtilis | Rho |
| 3788 | Hypothetical protein ywjI [Bacillus subtilis] | UniRef100_Q03224 | Bacillus subtilis | YwjI |
| 3789 | UDP-N-acetylglucosamine 1-carboxyvinyltransferase 2 [Bacillus subtilis] | UniRef100_P19670 | Bacillus subtilis | MurAB |
| 3790 | Transaldolase [Bacillus subtilis] | UniRef100_P19669 | Bacillus subtilis | YwjH |
| 3791 | Probable fructose-bisphosphate aldolase 1 [Bacillus subtilis] | UniRef100_P13243 | Bacillus subtilis | FbaA |
| 3792 | Sporulation initiation phosphotransferase F [Bacillus subtilis] | UniRef100_P06628 | Bacillus subtilis | Spo0F |
| 3793 | Hypothetical protein ywjG [Bacillus subtilis] | UniRef100_P06629 | Bacillus subtilis | YwjG |
| 3794 | | | | PyrG |
| 3795 | DNA-directed RNA polymerase delta subunit [Bacillus subtilis] | UniRef100_P12464 | Bacillus subtilis | RpoE |
| 3796 | Acyl-CoA dehydrogenase [Bacillus cereus] | UniRef100_Q814S9 | Bacillus cereus | AcdA |
| 3797 | Acyl-CoA dehydrogenase [Bacillus anthracis] | UniRef100_Q81JV7 | Bacillus anthracis | MmgC |
| 3798 | UPI00003CC303 UniRef100 entry | UniRef100_UPI00003CC303 | | MmgB |
| 3799 | Acetyl-CoA acetyltransferase [Oceanobacillus iheyensis] | UniRef100_Q8EM47 | Oceanobacillus iheyensis | MmgA |
| 3800 | Hypothetical protein ywjF [Bacillus subtilis] | UniRef100_P45866 | Bacillus subtilis | YwjF |
| 3801 | | | | YwjE |
| 3802 | Hypothetical protein ywjC [Bacillus subtilis] | UniRef100_P45863 | Bacillus subtilis | |
| 3803 | Arginyl-tRNA synthetase [Bacillus subtilis] | UniRef100_P46906 | Bacillus subtilis | ArgS |

TABLE 1-continued

Predicted functions

| SEQ ID NO. | Description | UniRef Accession No. | Organism | Bacillus subtilis homolog (Gene Name) |
|---|---|---|---|---|
| 3804 | | | | YwlB |
| 3805 | Agmatinase [Bacillus subtilis] | UniRef100_P70999 | Bacillus subtilis | SpeB |
| 3806 | Spermidine synthase [Bacillus subtilis] | UniRef100_P70998 | Bacillus subtilis | SpeE |
| 3807 | UPI00002A1DD1 UniRef100 entry | | UniRef100_UPI00002A1DD1 | |
| 3808 | Hypothetical protein ywhE [Bacillus subtilis] | UniRef100_P70997 | Bacillus subtilis | YwhE |
| 3809 | Hypothetical protein ywhD [Bacillus subtilis] | UniRef100_P70996 | Bacillus subtilis | YwhD |
| 3810 | Hypothetical protein ywhC [Bacillus subtilis] | UniRef100_P70995 | Bacillus subtilis | YwhC |
| 3811 | Probable tautomerase ywhB [Bacillus subtilis] | UniRef100_P70994 | Bacillus subtilis | |
| 3812 | Conserved protein [Methanosarcina mazei] | UniRef100_Q8PUC6 | Methanosarcina mazei | |
| 3813 | Hypothetical protein ywgA [Bacillus subtilis] | UniRef100_P71046 | Bacillus subtilis | YwgA |
| 3814 | Hypothetical protein ywfO [Bacillus subtilis] | UniRef100_P39651 | Bacillus subtilis | YwfO |
| 3815 | YwzC protein [Bacillus subtilis] | UniRef100_O32280 | Bacillus subtilis | |
| 3816 | Prespore specific transcriptional regulator rsfA [Bacillus subtilis] | UniRef100_P39650 | Bacillus subtilis | RsfA |
| 3817 | Hypothetical protein yjdJ precursor [Bacillus subtilis] | UniRef100_O31651 | Bacillus subtilis | |
| 3818 | Hypothetical protein ywfL [Bacillus subtilis] | UniRef100_P39648 | Bacillus subtilis | YwfL |
| 3819 | 4-hydroxybenzoate 3-monooxygenase [Pseudomonas sp] | UniRef100_Q59724 | Pseudomonas sp | YhjG |
| 3820 | Benzoate transporter protein [Pseudomonas sp. ND6] | UniRef100_Q6XUN5 | Pseudomonas sp. ND6 | YceI |
| 3821 | Putative 3,4-dihydroxyphenylacetate 2,3-dioxygenase [Rhodopseudomonas palustris] | UniRef100_Q6N986 | Rhodopseudomonas palustris | |
| 3822 | 4-oxalocrotonate tautomerase [Pseudomonas putida] | UniRef100_Q9Z431 | Pseudomonas putida | |
| 3823 | 4-oxalocrotonate decarboxylase [Pseudomonas sp. S-47] | UniRef100_Q84I96 | Pseudomonas sp. S-47 | |
| 3824 | | | | DhaS |
| 3825 | Putative transcriptional regulator [Agrobacterium tumefaciens] | UniRef100_Q9F7C7 | Agrobacterium tumefaciens | KipR |
| 3826 | Hypothetical protein SCO6305 [Streptomyces coelicolor] | UniRef100_Q93RT6 | Streptomyces coelicolor | |
| 3827 | Phosphate acetyltransferase [Bacillus subtilis] | UniRef100_P39646 | Bacillus subtilis | Pta |
| 3828 | Hypothetical protein ywfI [Bacillus subtilis] | UniRef100_P39645 | Bacillus subtilis | YwfI |
| 3829 | | | | YuaB |
| 3830 | Na+-transporting ATP synthase [Bacillus halodurans] | UniRef100_Q9KF87 | Bacillus halodurans | YubG |
| 3831 | Hypothetical protein ywdL [Bacillus subtilis] | UniRef100_P39620 | Bacillus subtilis | YwdL |
| 3832 | Multidrug ABC transporter, permease [Bacillus cereus ZK] | UniRef100_Q63D13 | Bacillus cereus ZK | YfiN |
| 3833 | ABC transporter, permease protein [Bacillus cereus] | UniRef100_Q73AB4 | Bacillus cereus | YfiM |
| 3834 | Multidrug ABC transporter, ATP-binding protein [Bacillus cereus ZK] | UniRef100_Q63D15 | Bacillus cereus ZK | YfiL |
| 3835 | Sensor histidine kinase, putative [Bacillus cereus] | UniRef100_Q73AB6 | Bacillus cereus | YfiJ |
| 3836 | DNA-binding response regulator, LuxR family [Bacillus cereus] | UniRef100_Q73AB7 | Bacillus cereus | YfiK |
| 3837 | | | | YwdK |
| 3838 | Putative purine permease ywdJ [Bacillus subtilis] | UniRef100_P39618 | Bacillus subtilis | YwdJ |
| 3839 | Hypothetical protein ywdI [Bacillus subtilis] | UniRef100_P39617 | Bacillus subtilis | YwdI |
| 3840 | Probable aldehyde dehydrogenase ywdH [Bacillus subtilis] | UniRef100_P39616 | Bacillus subtilis | YwdH |
| 3841 | Uracil-DNA glycosylase [Bacillus subtilis] | UniRef100_P39615 | Bacillus subtilis | Ung |
| 3842 | | | | YwdF |

TABLE 1-continued

Predicted functions

| SEQ ID NO. | Description | UniRef Accession No. | Organism | Bacillus subtilis homolog (Gene Name) |
|---|---|---|---|---|
| 3843 | Phosphomethylpyrimidine kinase [Bacillus subtilis] | UniRef100_P39610 | Bacillus subtilis | ThiD |
| 3844 | Hypothetical protein ywdA [Bacillus subtilis] | UniRef100_P39609 | Bacillus subtilis | |
| 3845 | Sucrose-6-phosphate hydrolase [Bacillus subtilis] | UniRef100_P07819 | Bacillus subtilis | SacA |
| 3846 | PTS system, sucrose-specific IIBC component [Bacillus subtilis] | UniRef100_P05306 | Bacillus subtilis | SacP |
| 3847 | | | | SacT |
| 3848 | | | | |
| 3849 | Minor extracellular protease vpr precursor [Bacillus subtilis] | UniRef100_P29141 | Bacillus subtilis | Vpr |
| 3850 | | | | |
| 3851 | | | | YwcH |
| 3852 | Nitro/flavin reductase [Bacillus subtilis] | UniRef100_P39605 | Bacillus subtilis | NfrA |
| 3853 | N-acyl-L-amino acid amidohydrolase [Bacillus halodurans] | UniRef100_Q9KCF8 | Bacillus halodurans | YhaA |
| 3854 | Hypothetical protein ywcF [Bacillus subtilis] | UniRef100_P39604 | Bacillus subtilis | RodA |
| 3855 | | | | RodA |
| 3856 | Membrane protein [Clostridium tetani] | UniRef100_Q897A1 | Clostridium tetani | |
| 3857 | Hypothetical protein ywcE precursor [Bacillus subtilis] | UniRef100_P39603 | Bacillus subtilis | |
| 3858 | Clostripain [Methanosarcina acetivorans] | UniRef100_Q8TIY6 | Methanosarcina acetivorans | |
| 3859 | YfmK protein [Bacillus subtilis] | UniRef100_Q34536 | Bacillus subtilis | YfmK |
| 3860 | ABC transporter, ATP-binding/permease protein [Pseudomonas syringae] | UniRef100_Q882Y2 | Pseudomonas syringae | YgaD |
| 3861 | HlyB/MsbA family ABC transporter [Gloeobacter violaceus] | UniRef100_Q7NIB9 | Gloeobacter violaceus | YwjA |
| 3862 | | | | |
| 3863 | | | | |
| 3864 | | | | |
| 3865 | | | | |
| 3866 | Response regulator [Bacillus cereus ZK] | UniRef100_Q63FE4 | Bacillus cereus ZK | ComA |
| 3867 | | | | |
| 3868 | Quinol oxidase polypeptide IV [Bacillus subtilis] | UniRef100_P34959 | Bacillus subtilis | QoxD |
| 3869 | Quinol oxidase polypeptide III (EC 1.10.3.—) (Quinol oxidase aa3-600, subunit qoxC) (Oxidase aa(3)-600 subunit 3) [Bacillus subtilis] | UniRef100_P34958 | Bacillus subtilis | QoxC |
| 3870 | Quinol oxidase polypeptide I (EC 1.10.3.—) (Quinol oxidase aa3-600, subunit qoxB) (Oxidase aa(3)-600 subunit 1) [Bacillus subtilis] | UniRef100_P34956 | Bacillus subtilis | QoxB |
| 3871 | | | | QoxA |
| 3872 | UDP-glucose 4-epimerase [Thermoanaerobacter tengcongensis] | UniRef100_Q8R8R8 | Thermoanaerobacter tengcongensis | GalE |
| 3873 | | | | |
| 3874 | | | | |
| 3875 | | | | |
| 3876 | Hypothetical protein ywqN [Bacillus subtilis] | UniRef100_P96726 | Bacillus subtilis | YwqN |
| 3877 | Hypothetical protein ywcB [Bacillus subtilis] | UniRef100_P39600 | Bacillus subtilis | |
| 3878 | Putative symporter ywcA [Bacillus subtilis] | UniRef100_P39599 | Bacillus subtilis | YwcA |
| 3879 | | | | XylB |
| 3880 | Xylose isomerase [Bacillus sp.] | UniRef100_P54272 | Bacillus sp. | XylA |
| 3881 | | | | XylR |
| 3882 | Thiamine-phosphate pyrophosphorylase [Bacillus subtilis] | UniRef100_P39594 | Bacillus subtilis | ThiE |
| 3883 | Hydroxyethylthiazole kinase [Bacillus subtilis] | UniRef100_P39593 | Bacillus subtilis | ThiM |
| 3884 | Putative HTH-type transcriptional regulator ywbI [Bacillus subtilis] | UniRef100_P39592 | Bacillus subtilis | YwbI |

TABLE 1-continued

Predicted functions

| SEQ ID NO. | Description | UniRef Accession No. | Organism | Bacillus subtilis homolog (Gene Name) |
|---|---|---|---|---|
| 3885 | Putative HTH-type transcriptional regulator ywbI [*Bacillus subtilis*] | UniRef100_P39592 | *Bacillus subtilis* | YwbI |
| 3886 | | | | |
| 3887 | | | | YwqH |
| 3888 | Holin-like protein cidA [*Bacillus subtilis*] | UniRef100_P39591 | *Bacillus subtilis* | YwbH |
| 3889 | Hypothetical protein ywbG [*Bacillus subtilis*] | UniRef100_P39590 | *Bacillus subtilis* | YwbG |
| 3890 | HlyC domain protein [*Bacillus cereus*] | UniRef100_Q731T5 | *Bacillus cereus* | |
| 3891 | | | | OpuE |
| 3892 | Hypothetical UPF0064 protein ywbD [*Bacillus subtilis*] | UniRef100_P39587 | *Bacillus subtilis* | YwbD |
| 3893 | Hypothetical protein ywbC [*Bacillus subtilis*] | UniRef100_P39586 | *Bacillus subtilis* | YwbC |
| 3894 | Phosphoglycerate dehydrogenase [*Bacillus coagulans*] | UniRef100_Q8GCC8 | *Bacillus coagulans* | YvcT |
| 3895 | Glycerate dehydrogenase [*Oceanobacillus iheyensis*] | UniRef100_Q8EP33 | *Oceanobacillus iheyensis* | |
| 3896 | General stress protein A [*Bacillus subtilis*] | UniRef100_P25148 | *Bacillus subtilis* | GspA |
| 3897 | YdfH protein [*Bacillus subtilis*] | UniRef100_P96685 | *Bacillus subtilis* | YdfH |
| 3898 | YdfI protein [*Bacillus subtilis*] | UniRef100_P96686 | *Bacillus subtilis* | YdfI |
| 3899 | YdfJ protein [*Bacillus subtilis*] | UniRef100_P96687 | *Bacillus subtilis* | YdfJ |
| 3900 | Hypothetical protein ywaF [*Bacillus subtilis*] | UniRef100_P25149 | *Bacillus subtilis* | YwaF |
| 3901 | MFS transporter, phthalate permease family [*Pseudomonas syringae*] | UniRef100_Q884B5 | *Pseudomonas syringae* | YcbE |
| 3902 | Hypothetical protein OB2215 [*Oceanobacillus iheyensis*] | UniRef100_Q8EP98 | *Oceanobacillus iheyensis* | YitF |
| 3903 | 2-dehydro-3-deoxyphosphogluconate aldolase [*Oceanobacillus iheyensis*] | UniRef100_Q8EP99 | *Oceanobacillus iheyensis* | KdgA |
| 3904 | 2-keto-3-deoxygluconate kinase [*Oceanobacillus iheyensis*] | UniRef100_Q8EPA0 | *Oceanobacillus iheyensis* | KdgK |
| 3905 | Transcriptional regulator [*Oceanobacillus iheyensis*] | UniRef100_Q8EPA1 | *Oceanobacillus iheyensis* | KipR |
| 3906 | | | | YwaD |
| 3907 | Hypothetical protein ywoD [*Bacillus subtilis*] | UniRef100_P94574 | *Bacillus subtilis* | YwoD |
| 3908 | | | | |
| 3909 | Hypothetical protein ywaC [*Bacillus subtilis*] | UniRef100_P39583 | *Bacillus subtilis* | YwaC |
| 3910 | | | | |
| 3911 | | | | DltA |
| 3912 | Protein dltB [*Bacillus subtilis*] | UniRef100_P39580 | *Bacillus subtilis* | DltB |
| 3913 | D-alanine--poly(phosphoribitol) ligase subunit 2 [*Bacillus subtilis*] | UniRef100_P39579 | *Bacillus subtilis* | |
| 3914 | Protein dltD precursor [*Bacillus subtilis*] | UniRef100_P39578 | *Bacillus subtilis* | DltD |
| 3915 | Putative branched-chain-amino-acid aminotransferase [*Bacillus subtilis*] | UniRef100_P39576 | *Bacillus subtilis* | YwaA |
| 3916 | Putative macrolide-efflux determinant, YvgJ [*Bacillus subtilis*] | UniRef100_O32203 | *Bacillus subtilis* | YvgJ |
| 3917 | Probable 6-phospho-beta-glucosidase [*Bacillus subtilis*] | UniRef100_P46320 | *Bacillus subtilis* | LicH |
| 3918 | PTS system, lichenan-specific IIA component [*Bacillus subtilis*] | UniRef100_P46319 | *Bacillus subtilis* | LicA |
| 3919 | PTS system, lichenan-specific IIC component [*Bacillus subtilis*] | UniRef100_P46317 | *Bacillus subtilis* | LicC |
| 3920 | PTS system, lichenan-specific IIB component [*Bacillus subtilis*] | UniRef100_P46318 | *Bacillus subtilis* | |
| 3921 | Probable licABCH operon regulator [*Bacillus subtilis*] | UniRef100_P46321 | *Bacillus subtilis* | LicR |
| 3922 | | | | |
| 3923 | Putative 3-methyladenine DNA glycosylase [*Bacillus subtilis*] | UniRef100_P94378 | *Bacillus subtilis* | YxlJ |
| 3924 | Transcriptional regulator [*Rhizobium loti*] | UniRef100_Q988D9 | *Rhizobium loti* | YdhC |
| 3925 | Citrate synthase III [*Bacillus subtilis*] | UniRef100_P45858 | *Bacillus subtilis* | MmgD |
| 3926 | 2-methylisocitrate dehydratase [*Bacillus thuringiensis*] | UniRef100_Q6HJ23 | *Bacillus thuringiensis* | MmgE |
| 3927 | Putative carboxyvinyl-carboxyphosphonate phosphorylmutase [*Bacillus subtilis*] | UniRef100_P54528 | *Bacillus subtilis* | YqiQ |

TABLE 1-continued

Predicted functions

| SEQ ID NO. | Description | UniRef Accession No. | Organism | Bacillus subtilis homolog (Gene Name) |
|---|---|---|---|---|
| 3928 | Chromate transporter [*Bacillus thuringiensis*] | UniRef100_Q6HIU6 | *Bacillus thuringiensis* | YwrA |
| 3929 | BH0575 protein [*Bacillus halodurans*] | UniRef100_Q9KFB0 | *Bacillus halodurans* | |
| 3930 | | | | YwjA |
| 3931 | YesT protein [*Bacillus subtilis*] | UniRef100_O31523 | *Bacillus subtilis* | YesT |
| 3932 | | | | YweA |
| 3933 | | | | YweA |
| 3934 | Drug resistance transporter Bcr/CflA subfamily; possible bicyclomycin resistance protein [*Bacillus thuringiensis*] | UniRef100_Q6HPJ5 | *Bacillus thuringiensis* | YdgK |
| 3935 | YxlG protein [*Bacillus subtilis*] | UniRef100_P94375 | *Bacillus subtilis* | YxlG |
| 3936 | YxlF protein [*Bacillus subtilis*] | UniRef100_P94374 | *Bacillus subtilis* | YxlF |
| 3937 | YxlE protein [*Bacillus subtilis*] | UniRef100_P94373 | *Bacillus subtilis* | |
| 3938 | | | | |
| 3939 | Hypothetical protein yxlC [*Bacillus subtilis*] | UniRef100_P94371 | *Bacillus subtilis* | |
| 3940 | RNA polymerase sigma factor sigY [*Bacillus subtilis*] | UniRef100_P94370 | *Bacillus subtilis* | SigY |
| 3941 | YxlH protein [*Bacillus subtilis*] | UniRef100_P94376 | *Bacillus subtilis* | YxlH |
| 3942 | Catalase [*Bacillus halodurans*] | UniRef100_Q9KDA8 | *Bacillus halodurans* | KatX |
| 3943 | Catalase [*Bacillus subtilis*] | UniRef100_Q9AQQ9 | *Bacillus subtilis* | KatA |
| 3944 | Peroxide operon transcriptional regulator [*Listeria monocytogenes*] | UniRef100_Q71YY4 | *Listeria monocytogenes* | PerR |
| 3945 | Ferrochelatase [*Oceanobacillus iheyensis*] | UniRef100_Q8ERX9 | *Oceanobacillus iheyensis* | HemH |
| 3946 | Hypothetical protein yhcI [*Bacillus subtilis*] | UniRef100_P54593 | *Bacillus subtilis* | YhcI |
| 3947 | Bacitracin transport ATP-binding protein bcrA [*Bacillus cereus*] | UniRef100_Q81AB3 | *Bacillus cereus* | YhcH |
| 3948 | MrsE protein [*Bacillus* sp.] | UniRef100_Q9RC25 | *Bacillus* sp. | |
| 3949 | | | | |
| 3950 | ABC-2 type transport system ATP-binding protein [*Pyrobaculum aerophilum*] | UniRef100_Q8ZZG9 | *Pyrobaculum aerophilum* | YdbJ |
| 3951 | | | | |
| 3952 | Transcriptional regulator [*Bacillus halodurans*] | UniRef100_Q9KFL9 | *Bacillus halodurans* | |
| 3953 | | | | |
| 3954 | ClyA protein [Plasmid pAD1] | UniRef100_Q52055 | Plasmid pAD1 | IspA |
| 3955 | Lantibiotic mersacidin transporter system [*Bacillus halodurans*] | UniRef100_Q9KFM8 | *Bacillus halodurans* | YgaD |
| 3956 | | | | |
| 3957 | Lantibiotic mersacidin [*Bacillus halodurans*] | UniRef100_Q9KFM5 | *Bacillus halodurans* | |
| 3958 | Lantibiotic mersacidin modifying enzyme [*Bacillus halodurans*] | UniRef100_Q9KFM4 | *Bacillus halodurans* | |
| 3959 | Pectate lyase Pel-34K [*Bacillus* sp. P-2850] | UniRef100_Q8L0S6 | *Bacillus* sp. P-2850 | Pel |
| 3960 | Hypothetical UPF0031 protein yxkO [*Bacillus subtilis*] | UniRef100_P94368 | *Bacillus subtilis* | YxkO |
| 3961 | Transport ATP-binding protein cydD [*Bacillus subtilis*] | UniRef100_P94367 | *Bacillus subtilis* | CydD |
| 3962 | Transport ATP-binding protein cydC [*Bacillus subtilis*] | UniRef100_P94366 | *Bacillus subtilis* | CydC |
| 3963 | Cytochrome d ubiquinol oxidase subunit II [*Bacillus subtilis*] | UniRef100_P94365 | *Bacillus subtilis* | CydB |
| 3964 | Cytochrome d ubiquinol oxidase subunit I [*Bacillus subtilis*] | UniRef100_P94364 | *Bacillus subtilis* | CydA |
| 3965 | Hypothetical transport protein ywcJ [*Bacillus subtilis*] | UniRef100_P39608 | *Bacillus subtilis* | YwcJ |
| 3966 | Hypothetical protein [*Bacillus cereus*] | UniRef100_Q735J7 | *Bacillus cereus* | |
| 3967 | Probable NAD-dependent malic enzyme 1 [*Bacillus subtilis*] | UniRef100_P54572 | *Bacillus subtilis* | MleA |
| 3968 | Malate-2H(+)/Na(+)-lactate antiporter [*Bacillus subtilis*] | UniRef100_P54571 | *Bacillus subtilis* | MleN |
| 3969 | | | | AnsB |
| 3970 | L-asparaginase [*Bacillus subtilis*] | UniRef100_P26900 | *Bacillus subtilis* | AnsA |
| 3971 | | | | AnsR |

TABLE 1-continued

Predicted functions

| SEQ ID NO. | Description | UniRef Accession No. | Organism | Bacillus subtilis homolog (Gene Name) |
|---|---|---|---|---|
| 3972 | Hypothetical protein ykgB [Bacillus subtilis] | UniRef100_O34499 | Bacillus subtilis | YkgB |
| 3973 | Hypothetical sensory transduction protein yxdJ [Bacillus subtilis] | UniRef100_P42421 | Bacillus subtilis | YxdJ |
| 3974 | Hypothetical sensor-like histidine kinase yxdK [Bacillus subtilis] | UniRef100_P42422 | Bacillus subtilis | YxdK |
| 3975 | Hypothetical ABC transporter ATP-binding protein yxdL [Bacillus subtilis] | UniRef100_P42423 | Bacillus subtilis | YxdL |
| 3976 | Hypothetical protein yxdM [Bacillus subtilis] | UniRef100_P42424 | Bacillus subtilis | YxdM |
| 3977 | Hypothetical protein yxeA precursor [Bacillus subtilis] | UniRef100_P54940 | Bacillus subtilis | YxeA |
| 3978 | YxkH protein [Bacillus subtilis] | UniRef100_P94361 | Bacillus subtilis | YxkH |
| 3979 | Transcriptional regulator [Bacillus halodurans] | UniRef100_Q9KFA7 | Bacillus halodurans | YdeL |
| 3980 | Hypothetical protein orfD [Lactococcus lactis] | UniRef100_O86288 | Lactococcus lactis | YdaM |
| 3981 | Citrate/malate transporter [Bacillus subtilis] | UniRef100_P94363 | Bacillus subtilis | YxkJ |
| 3982 | Glycerophosphodiester phosphodiesterase [Oceanobacillus iheyensis] | UniRef100_Q8EMK9 | Oceanobacillus iheyensis | YhdW |
| 3983 | Hypothetical protein yhjA precursor [Bacillus subtilis] | UniRef100_O07555 | Bacillus subtilis | |
| 3984 | | | | |
| 3985 | YfnI [Bacillus subtilis] | UniRef100_O06487 | Bacillus subtilis | YfnI |
| 3986 | Hypothetical lipoprotein yfjD precursor [Bacillus subtilis] | UniRef100_O31555 | Bacillus subtilis | YfjD |
| 3987 | YxkD protein [Bacillus subtilis] | UniRef100_P94357 | Bacillus subtilis | YxkD |
| 3988 | Arginine repressor, argR [Bacillus cereus] | UniRef100_Q81II2 | Bacillus cereus | AhrC |
| 3989 | Arginine deiminase [Bacillus cereus] | UniRef100_Q73E87 | Bacillus cereus | YkgA |
| 3990 | Ornithine carbamoyltransferase [Bacillus cereus] | UniRef100_Q73E86 | Bacillus cereus | ArgF |
| 3991 | Arginine/ornithine antiporter [Bacillus cereus] | UniRef100_Q73E85 | Bacillus cereus | YvsH |
| 3992 | Carbamate kinase [Bacillus cereus] | UniRef100_Q81IH8 | Bacillus cereus | |
| 3993 | Transcriptional regulator, Crp family [Bacillus thuringiensis] | UniRef100_Q6HP25 | Bacillus thuringiensis | Fnr |
| 3994 | Beta-glucosidase [Oceanobacillus iheyensis] | UniRef100_Q8ES64 | Oceanobacillus iheyensis | YdhP |
| 3995 | PTS system, lichenan-specific IIc component [Erwinia carotovora] | UniRef100_Q6D101 | Erwinia carotovora | LicC |
| 3996 | Hypothetical protein [Bacillus thuringiensis] | UniRef100_Q6HC13 | Bacillus thuringiensis | |
| 3997 | | | | SigV |
| 3998 | Anaerobic ribonucleoside-triphosphate reductase activating protein [Methanobacterium thermoautotrophicum] | UniRef100_O26387 | Methanobacterium thermoautotrophicum | |
| 3999 | Hypothetical protein yxeC [Bacillus subtilis] | UniRef100_P54942 | Bacillus subtilis | |
| 4000 | | | | |
| 4001 | | | | |
| 4002 | Hypothetical protein [Anabaena sp.] | UniRef100_Q9AIM4 | Anabaena sp. | FtsH |
| 4003 | Peptidase T [Bacillus subtilis] | UniRef100_P55179 | Bacillus subtilis | PepT |
| 4004 | Beta-fructosidase FruA [Bacillus megaterium] | UniRef100_Q8GM36 | Bacillus megaterium | SacA |
| 4005 | Sugar transporter FruP [Bacillus megaterium] | UniRef100_Q8GM37 | Bacillus megaterium | YwbF |
| 4006 | ABC transporter membrane-spanning permease-sugar transport [Streptococcus pneumoniae] | UniRef100_Q8DNN9 | Streptococcus pneumoniae | YesQ |
| 4007 | ABC transporter membrane-spanning permease-sugar transporter [Streptococcus pneumoniae] | UniRef100_Q8DNN8 | Streptococcus pneumoniae | YurN |
| 4008 | | | | YesO |
| 4009 | Repressor FruR [Bacillus megaterium] | UniRef100_Q8GM38 | Bacillus megaterium | RbsR |
| 4010 | Hypothetical protein [Bacillus cereus] | UniRef100_Q73I8 | Bacillus cereus | |
| 4011 | | | | YjeA |

TABLE 1-continued

Predicted functions

| SEQ ID NO. | Description | UniRef Accession No. | Organism | Bacillus subtilis homolog (Gene Name) |
|---|---|---|---|---|
| 4012 | Hypothetical protein yxjG [Bacillus subtilis] | UniRef100_P42318 | Bacillus subtilis | YxjG |
| 4013 | YkcB protein [Bacillus subtilis] | UniRef100_O34575 | Bacillus subtilis | YkcB |
| 4014 | Putative glycosyl transferase ykcC [Bacillus subtilis] | UniRef100_O34319 | Bacillus subtilis | YkcC |
| 4015 | | | | GalE |
| 4016 | | | | |
| 4017 | | | | |
| 4018 | | | | |
| 4019 | Hypothetical 10.1 kDa protein [Bacillus pseudofirmus] | UniRef100_O50571 | Bacillus pseudofirmus | |
| 4020 | | | | |
| 4021 | Hypothetical transport protein yxjA [Bacillus subtilis] | UniRef100_P42312 | Bacillus subtilis | YxjA |
| 4022 | Catalase 2 [Bacillus subtilis] | UniRef100_P42234 | Bacillus subtilis | KatE |
| 4023 | Catalase 2 [Bacillus subtilis] | UniRef100_P42234 | Bacillus subtilis | KatE |
| 4024 | DNA gyrase inhibitory protein, GyrI [Clostridium acetobutylicum] | UniRef100_Q97DI7 | Clostridium acetobutylicum | YosT |
| 4025 | Probable glycosyl hydrolase [Erwinia carotovora] | UniRef100_Q6D774 | Erwinia carotovora | YckE |
| 4026 | PTS system, beta-glucoside-specific enzyme II, ABC component [Bacillus halodurans] | UniRef100_Q9KG19 | Bacillus halodurans | BglP |
| 4027 | Transcription antiterminator licT [Bacillus subtilis] | UniRef100_P39805 | Bacillus subtilis | LicT |
| 4028 | Hypothetical conserved protein [Oceanobacillus iheyensis] | UniRef100_Q8ES40 | Oceanobacillus iheyensis | YkoC |
| 4029 | Cation ABC transporter ATP-binding protein [Oceanobacillus iheyensis] | UniRef100_Q8ES39 | Oceanobacillus iheyensis | YkoD |
| 4030 | Hypothetical conserved protein [Oceanobacillus iheyensis] | UniRef100_Q8ES38 | Oceanobacillus iheyensis | YkoE |
| 4031 | Transcriptional activator of extracellular enzyme genes [Oceanobacillus iheyensis] | UniRef100_Q8ESZ0 | Oceanobacillus iheyensis | TenA |
| 4032 | Isocitrate lyase [Bacillus cereus] | UniRef100_Q73C38 | Bacillus cereus | YqiQ |
| 4033 | Malate synthase A [Bacillus cereus] | UniRef100_Q73C39 | Bacillus cereus | |
| 4034 | | | | |
| 4035 | Hypothetical protein yycA [Bacillus subtilis] | UniRef100_P37483 | Bacillus subtilis | YycA |
| 4036 | Bacitracin export permease protein bceB [Bacillus subtilis] | UniRef100_O34741 | Bacillus subtilis | YtsD |
| 4037 | Bacitracin export ATP-binding protein bceA [Bacillus subtilis] | UniRef100_O34697 | Bacillus subtilis | YtsC |
| 4038 | Sensor protein bceS [Bacillus subtilis] | UniRef100_O35044 | Bacillus subtilis | YtsB |
| 4039 | Sensory transduction protein bceR [Bacillus subtilis] | UniRef100_O34951 | Bacillus subtilis | YtsA |
| 4040 | Beta-glucosidase [Bacillus subtilis] | UniRef100_P40740 | Bacillus subtilis | BglH |
| 4041 | PTS system, beta-glucoside-specific IIABC component [Bacillus subtilis] | UniRef100_P40739 | Bacillus subtilis | BglP |
| 4042 | Hypothetical protein yxeG [Bacillus subtilis] | UniRef100_P54946 | Bacillus subtilis | YxeG |
| 4043 | Hypothetical protein yxeI [Bacillus subtilis] | UniRef100_P54948 | Bacillus subtilis | YxeI |
| 4044 | | | | |
| 4045 | | | | |
| 4046 | Hypothetical protein yxiA precursor [Bacillus subtilis] | UniRef100_P42293 | Bacillus subtilis | YxiA |
| 4047 | ATP-dependent RNA helicase dbpA [Bacillus subtilis] | UniRef100_P42305 | Bacillus subtilis | DeaD |
| 4048 | Hypothetical protein OB2811 [Oceanobacillus iheyensis] | UniRef100_Q8EMN1 | Oceanobacillus iheyensis | |
| 4049 | Hypothetical protein OB2810 [Oceanobacillus iheyensis] | UniRef100_Q8EMN2 | Oceanobacillus iheyensis | |
| 4050 | | | | YxiD |
| 4051 | | | | |
| 4052 | BH4015 protein [Bacillus halodurans] | UniRef100_Q9K5S3 | Bacillus halodurans | YxiB |
| 4053 | Pyrimidine-nucleoside phosphorylase [Bacillus subtilis] | UniRef100_P39142 | Bacillus subtilis | Pdp |
| 4054 | Pyrimidine nucleoside transport protein [Bacillus subtilis] | UniRef100_P39141 | Bacillus subtilis | NupC |

TABLE 1-continued

Predicted functions

| SEQ ID NO. | Description | UniRef Accession No. | Organism | Bacillus subtilis homolog (Gene Name) |
|---|---|---|---|---|
| 4055 | Deoxyribose-phosphate aldolase [Bacillus subtilis] | UniRef100_P39121 | Bacillus subtilis | Dra |
| 4056 | Deoxyribonucleoside regulator [Bacillus subtilis] | UniRef100_P39140 | Bacillus subtilis | DeoR |
| 4057 | Hypothetical protein [Bacillus anthracis] | UniRef100_Q81X49 | Bacillus anthracis | |
| 4058 | YdaJ protein [Bacillus subtilis] | UniRef100_P96584 | Bacillus subtilis | YdaJ |
| 4059 | YdaK protein [Bacillus subtilis] | UniRef100_P96585 | Bacillus subtilis | YdaK |
| 4060 | YdaL protein [Bacillus subtilis] | UniRef100_O31487 | Bacillus subtilis | YdaL |
| 4061 | YdaM protein [Bacillus subtilis] | UniRef100_P96587 | Bacillus subtilis | YdaM |
| 4062 | YdaN protein [Bacillus subtilis] | UniRef100_O31488 | Bacillus subtilis | YdaN |
| 4063 | Valine-pyruvate aminotransferase [Anabaena sp.] | UniRef100_Q8YTB2 | Anabaena sp. | AlaT |
| 4064 | Hypothetical protein [Leifsonia xyli] | UniRef100_Q6AEW0 | Leifsonia xyli | |
| 4065 | Hypothetical protein [Leifsonia xyli] | UniRef100_Q6AEW1 | Leifsonia xyli | YwfB |
| 4066 | Similarities with putative carboxylase [Photorhabdus luminescens] | UniRef100_Q7NA29 | Photorhabdus luminescens | YwfE |
| 4067 | Transporter, Drug/Metabolite Exporter family [Bacillus cereus ZK] | UniRef100_Q63AK7 | Bacillus cereus ZK | YoaV |
| 4068 | Probable fructose-bisphosphate aldolase 2 [Bacillus subtilis] | UniRef100_P42420 | Bacillus subtilis | FbaB |
| 4069 | IolI protein [Bacillus subtilis] | UniRef100_P42419 | Bacillus subtilis | IolI |
| 4070 | IolH protein [Bacillus subtilis] | UniRef100_P42418 | Bacillus subtilis | IolH |
| 4071 | Myo-inositol dehydrogenase [Bacillus subtilis] | UniRef100_Q6B6R7 | Bacillus subtilis | Idh |
| 4072 | Myo-inositol transport protein [Bacillus subtilis] | UniRef100_P42417 | Bacillus subtilis | IolF |
| 4073 | IolE protein [Bacillus subtilis] | UniRef100_P42416 | Bacillus subtilis | IolE |
| 4074 | Probable malonic semialdehyde oxidative decarboxylase [Bacillus subtilis] | UniRef100_P42415 | Bacillus subtilis | IolD |
| 4075 | Protein ioIC [Bacillus subtilis] | UniRef100_P42414 | Bacillus subtilis | IolC |
| 4076 | IolB protein [Bacillus subtilis] | UniRef100_P42413 | Bacillus subtilis | IolB |
| 4077 | Probable methylmalonate-semialdehyde dehydrogenase [acylating] [Bacillus subtilis] | UniRef100_P42412 | acylating | MmsA |
| 4078 | DNA-binding protein iolR [Bacillus subtilis] | UniRef100_P46337 | Bacillus subtilis | IolR |
| 4079 | IolS protein [Bacillus subtilis] | UniRef100_P46336 | Bacillus subtilis | IolS |
| 4080 | UPI00003CB380 UniRef100 entry | | UniRef100_UPI00003CB380 | GlpQ |
| 4081 | Putative glycerol-3-phosphate transporter [Staphylococcus aureus] | UniRef100_Q6GJY0 | Staphylococcus aureus | GlpT |
| 4082 | Chaperone protein htpG [Bacillus subtilis] | UniRef100_P46208 | Bacillus subtilis | HtpG |
| 4083 | | | | YfmM |
| 4084 | Hypothetical protein yxeH [Bacillus subtilis] | UniRef100_P54947 | Bacillus subtilis | YxeH |
| 4085 | Glycerol dehydrogenase [Clostridium acetobutylicum] | UniRef100_Q97IL4 | Clostridium acetobutylicum | AraM |
| 4086 | Phosphoserine phosphatase family protein [Clostridium acetobutylicum] | UniRef100_Q97IL5 | Clostridium acetobutylicum | YkrX |
| 4087 | BH0833 protein [Bacillus halodurans] | UniRef100_Q9KEL9 | Bacillus halodurans | |
| 4088 | | | | YxeB |
| 4089 | | | | |
| 4090 | BH3956 protein [Bacillus halodurans] | UniRef100_Q9K5Y0 | Bacillus halodurans | YraH |
| 4091 | | | | |
| 4092 | Ferrous iron transport protein B [Bacillus cereus ZK] | UniRef100_Q632N2 | Bacillus cereus ZK | |
| 4093 | Lmo2104 protein [Listeria monocytogenes] | UniRef100_Q929R6 | Listeria monocytogenes | |
| 4094 | YfiQ protein [Bacillus subtilis] | UniRef100_O31559 | Bacillus subtilis | YfiQ |
| 4095 | ABC transporter permease protein [Bacillus cereus] | UniRef100_Q81EI1 | Bacillus cereus | YxdM |
| 4096 | ABC transporter ATP-binding protein [Bacillus cereus] | UniRef100_Q81D39 | Bacillus cereus | YxdL |
| 4097 | Sensor histidine kinase [Bacillus cereus ZK] | UniRef100_Q63AY4 | Bacillus cereus ZK | YxdK |
| 4098 | UPI00003CBD9F UniRef100 entry | | UniRef100_UPI00003CBD9F | YxdJ |
| 4099 | Hypothetical protein [Bacillus cereus] | UniRef100_Q72X82 | Bacillus cereus | |
| 4100 | YoaH [Bacillus subtilis] | UniRef100_O34576 | Bacillus subtilis | YoaH |

TABLE 1-continued

Predicted functions

| SEQ ID NO. | Description | UniRef Accession No. | Organism | Bacillus subtilis homolog (Gene Name) |
|---|---|---|---|---|
| 4101 | Amino acid transporter [Bacillus halodurans] | UniRef100_Q9K609 | Bacillus halodurans | YflA |
| 4102 | Alanine dehydrogenase [Bacillus halodurans] | UniRef100_Q9KAF8 | Bacillus halodurans | Ald |
| 4103 | Hypothetical family 53 glycosyl hydrolase yvfO precursor [Bacillus subtilis] | UniRef100_O07013 | Bacillus subtilis | YvfO |
| 4104 | Hypothetical protein yvfN [Baciiius subtilis] | UniRef1000_O07012 | Baciiius subtilis | LacA |
| 4105 | Hypothetical protein yvfM [Bacillus subtilis] | UniRef100_O07011 | Bacillus subtilis | YvfM |
| 4106 | Maltose/maltodextrin transport system [Bacillus halodurans] | UniRef100_Q9KBA8 | Bacillus halodurans | YvfL |
| 4107 | Hypothetical protein yvfK [Bacillus subtilis] | UniRef100_O07009 | Bacillus subtilis | YvfK |
| 4108 | | | | LacR |
| 4109 | Galactokinase [Streptococcus gordonii] | UniRef100_Q840N8 | Streptococcus gordonii | Galk |
| 4110 | UDP-glucose 4-epimerase [Listeria innocua] | UniRef100_Q928B6 | Listeria innocua | GalE |
| 4111 | UPI00003CB9B6 UniRef100 entry | | UniRef100_UPI00003CB9B6 | GalT |
| 4112 | Transcriptional repressor of the xylose operon [Bacillus halodurans] | UniRef100_Q9KDW7 | Bacillus halodurans | XylR |
| 4113 | | | | GntR |
| 4114 | | | | GntK |
| 4115 | | | | GntP |
| 4116 | | | | GntZ |
| 4117 | Alcohol dehydrogenase [Bacillus cereus] | UniRef100_Q818A4 | Bacillus cereus | GbsB |
| 4118 | Alkyl hydroperoxide reductase subunit C [Bacillus subtilis] | UniRef100_P80239 | Bacillus subtilis | AhpC |
| 4119 | NADH dehydrogenase [Bacillus subtilis] | UniRef100_P42974 | Bacillus subtilis | AhpF |
| 4120 | | | | |
| 4121 | | | | |
| 4122 | | | | |
| 4123 | | | | YvfR |
| 4124 | Hypothetical protein yvfS [Bacillus subtilis] | UniRef100_O07017 | Bacillus subtilis | YvfS |
| 4125 | | | | YvfT |
| 4126 | Hypothetical protein yvfU [Bacillus subtilis] | UniRef100_O07019 | Bacillus subtilis | YvfU |
| 4127 | | | | |
| 4128 | | | | |
| 4129 | | | | YtrE |
| 4130 | | | | |
| 4131 | | | | |
| 4132 | | | | |
| 4133 | | | | |
| 4134 | Hypothetical protein [Desulfotalea psychrophila] | UniRef100_Q6ARQ4 | Desulfotalea psychrophila | |
| 4135 | Hypothetical protein [Desulfotalea psychrophila] | UniRef100_Q6ARQ5 | Desulfotalea psychrophila | |
| 4136 | | | | |
| 4137 | | | | |
| 4138 | Putative zinc metallopeptidase [Clostridium tetani] | UniRef100_Q894N2 | Clostridium tetani | |
| 4139 | Type I restriction-modification system restriction subunit [Bdellovibrio bacteriovorus] | UniRef100_Q6MH63 | Bdellovibrio bacteriovorus | |
| 4140 | Lin0523 protein [Listeria innocua] | UniRef100_Q92ED7 | Listeria innocua | |
| 4141 | | | | |
| 4142 | Hypothetical protein CAC1662 [Clostridium acetobutylicum] | UniRef100_Q97IH9 | Clostridium acetobutylicum | |
| 4143 | Type I restriction-modification system, M subunit [Desulfovibrio vulgaris] | UniRef100_Q72BC7 | Desulfovibrio vulgaris | |
| 4144 | | | | |
| 4145 | | | | |
| 4146 | | | | |
| 4147 | UPI00002C7192 UniRef100 entry | | UniRef100_UPI00002C7192 | |

TABLE 1-continued

Predicted functions

| SEQ ID NO. | Description | UniRef Accession No. | Organism | Bacillus subtilis homolog (Gene Name) |
|---|---|---|---|---|
| 4148 | Cassette chromosome recombinase B [*Staphylococcus aureus*] | UniRef100_Q8RPD2 | *Staphylococcus aureus* | SpoIVCA |
| 4149 | Hypothetical UPF0247 protein yyda [*Bacillus subtilis*] | UniRef100_Q45601 | *Bacillus subtilis* | YydA |
| 4150 | | | | |
| 4151 | | | | |
| 4152 | YycN protein [*Bacillus subtilis*] | UniRef100_O32293 | *Bacillus subtilis* | YycN |
| 4153 | | | | |
| 4154 | UPI00003CA59D UniRef100 entry | | UniRef100_UPI00003CA59D | |
| 4155 | Hypothetical serine protease yyxA [*Bacillus subtilis*] | UniRef100_P39668 | *Bacillus subtilis* | YyxA |
| 4156 | YycJ protein [*Bacillus subtilis*] | UniRef100_Q45611 | *Bacillus subtilis* | YycJ |
| 4157 | YycI protein [*Bacillus subtilis*] | UniRef100_Q45612 | *Bacillus subtilis* | YycI |
| 4158 | YycH protein [*Bacillus subtilis*] | UniRef100_Q45613 | *Bacillus subtilis* | YycH |
| 4159 | Sensor protein yycG [*Bacillus subtilis*] | UniRef100_Q45614 | *Bacillus subtilis* | YycG |
| 4160 | Transcriptional regulatory protein yycF [*Bacillus subtilis*] | UniRef100_P37478 | *Bacillus subtilis* | YycF |
| 4161 | Phosphohydrolase [*Bacillus cereus*] | UniRef100_Q81I03 | *Bacillus cereus* | |
| 4162 | Adenylosuccinate synthetase [*Bacillus subtilis*] | UniRef100_P29726 | *Bacillus subtilis* | PurA |
| 4163 | | | | |
| 4164 | Replicative DNA helicase [*Bacillus subtilis*] | UniRef100_P37469 | *Bacillus subtilis* | DnaC |
| 4165 | Hypothetical protein yycD [*Bacillus subtilis*] | UniRef100_P37480 | *Bacillus subtilis* | |
| 4166 | Hypothetical protein yyzB [*Bacillus subtilis*] | UniRef100_O32296 | *Bacillus subtilis* | |
| 4167 | Hypothetical transport protein yycB [*Bacillus subtilis*] | UniRef100_P37482 | *Bacillus subtilis* | YycB |
| 4168 | N-acetylglucosamine-6-phosphate deacetylase [*Bacillus halodurans*] | UniRef100_Q9KFQ7 | *Bacillus halodurans* | NagA |
| 4169 | | | | NagB |
| 4170 | Transcriptional regulator [*Bacillus halodurans*] | UniRef100_Q9KFQ9 | *Bacillus halodurans* | YvoA |
| 4171 | Hypothetical protein VP0543 [*Vibrio parahaemolyticus*] | UniRef100_Q87S81 | *Vibrio parahaemolyticus* | YbbI |
| 4172 | PTS system, n-acetylglucosamine-specific enzyme II, ABC component [*Bacillus halodurans*] | UniRef100_Q9KF24 | *Bacillus halodurans* | NagP |
| 4173 | 50S ribosomal protein L9 [*Bacillus subtilis*] | UniRef100_P37437 | *Bacillus subtilis* | RplI |
| 4174 | Hypothetical protein yybT [*Bacillus subtilis*] | UniRef100_P37484 | *Bacillus subtilis* | YybT |
| 4175 | Hypothetical protein yybS [*Bacillus subtilis*] | UniRef100_P37485 | *Bacillus subtilis* | YybS |
| 4176 | Spore coat protein F precursor [*Bacillus subtilis*] | UniRef100_P23261 | *Bacillus subtilis* | CotF |
| 4177 | Universal stress protein, Usp family [*Bacillus thuringiensis*] | UniRef100_Q6HIV0 | *Bacillus thuringiensis* | YxiE |
| 4178 | Sulfate permease [*Bacillus thuringiensis*] | UniRef100_Q6HIU9 | *Bacillus thuringiensis* | YbaR |
| 4179 | Hypothetical transport protein yybO [*Bacillus subtilis*] | UniRef100_P37489 | *Bacillus subtilis* | YybO |
| 4180 | 30S ribosomal protein S18 [*Bacillus subtilis*] | UniRef100_P21475 | *Bacillus subtilis* | |
| 4181 | Single-strand binding protein [*Bacillus subtilis*] | UniRef100_P37455 | *Bacillus subtilis* | Ssb |
| 4182 | 30S ribosomal protein S6 [*Bacillus subtilis*] | UniRef100_P21468 | *Bacillus subtilis* | |
| 4183 | GTP-dependent nucleic acid-binding protein engD [*Bacillus subtilis*] | UniRef100_P37518 | *Bacillus subtilis* | YyaF |
| 4184 | Lin2921 protein [*Listeria innocua*] | UniRef100_Q926W9 | *Listeria innocua* | |
| 4185 | Hypothetical protein yyaD [*Bacillus subtilis*] | UniRef100_P37520 | *Bacillus subtilis* | YyaD |
| 4186 | Hypothetical protein yyaC [*Bacillus subtilis*] | UniRef100_P37521 | *Bacillus subtilis* | YyaC |
| 4187 | Stage 0 sporulation protein J [*Bacillus subtilis*] | UniRef100_P26497 | *Bacillus subtilis* | Spo0J |
| 4188 | | | | Soj |

TABLE 1-continued

Predicted functions

| SEQ ID NO. | Description | UniRef Accession No. | Organism | Bacillus subtilis homolog (Gene Name) |
|---|---|---|---|---|
| 4189 | Hypothetical protein [*Burkholderia pseudomallei* K96243] | UniRef100_Q63L10 | *Burkholderia pseudomallei* K96243 | YdfG |
| 4190 | RNA polymerase sigma factor, ECF subfamily [*Bacillus cereus* ZK] | UniRef100_Q63BC0 | *Bacillus cereus* ZK | SigM |
| 4191 | YyaA protein [*Bacillus subtilis*] | UniRef100_P37524 | *Bacillus subtilis* | YyaA |
| 4192 | Methyltransferase gidB [*Bacillus subtilis*] | UniRef100_P25813 | *Bacillus subtilis* | GidB |
| 4193 | Glucose inhibited division protein A [*Bacillus subtilis*] | UniRef100_P25812 | *Bacillus subtilis* | GidA |
| 4194 | Probable tRNA modification GTPase trmE [*Bacillus subtilis*] | UniRef100_P25811 | *Bacillus subtilis* | ThdF |
| 4195 | Jag protein [*Bacillus subtilis*] | UniRef100_Q01620 | *Bacillus subtilis* | Jag |
| 4196 | | | | SpoIIIJ |
| 4197 | Ribonuclease P protein component [*Bacillus subtilis*] | UniRef100_P25814 | *Bacillus subtilis* | RnpA |

TABLE 2

Features of the *Bacillus licheniformis* genome and comparison with genomes of other *Bacillus* species.

| Feature | *B. licheniformis* | *B. subtilis*[a] | *B. halodurans*[b] | *Oceanobacillus iheyensis*[c] | *B. anthracis*[d] | *B. cereus*[e] |
|---|---|---|---|---|---|---|
| Chromosome Size (bp) | 4,222,336 | 4,214,630 | 4,202,352 | 3,630,528 | 5,227,293 | 5,426,909 |
| G + C content (mol %) | 46.2 | 43.5 | 43.7 | 35.7 | 35.4 | 35.4 |
| Protein coding sequences | 4197 | 4106 | 4066 | 3496 | 5508 | 5366 |
| Average length (bp) | 873 | 896 | 879 | 883 | 800 | 835 |
| Percent of coding region | 87 | 87 | 85 | 85 | 84 | 84 |
| Ribosomal RNA operons | 7 | 10 | 8 | 7 | 11 | 13 |
| Number of tRNAs | 81 | 86 | 78 | 69 | 95 | 108 |
| Phage-associated genes | 71 | 268 | 42 | 27 | 62 | 124 |
| Transposase genes of IS-elements | 10 | 0 | 93 | 14 | 18 | 10 |

[a]Kunst, F., Ogasawara, N, Mozser, I., Albertini, A. M., Alloni, G., Azebedo, V., Bertero, M. G., Bessieres, P., Bolotin, A., and Borchert, S. et al. (1997) Nature 390, 249-256.
[b]Takami, H., Nakasone, K., Takaki, Y., Maeno, G., Sasaki, R., Masui, N., Fuji, F., Hirama, C., Nakamura, Y., Ogasawara, N. et al. (2000) Nucleic Acids Res. 28, 4317-4331.
[c]Takami, H., Takaki, Y., and Uchiyama, I. (2002) Nucleic Acids Res. 30, 3927-3935.
[d]Read, T. D., Peterson, S. N., Tourasse, N., Baillie, L. W., Paulsen, I. T., Nelson, K. E., Tettelin, H., Fouts, D. E., Eisen, J. A., and Gill, S. R. et al. (2003) Nature 423, 81-86.
[e]Ivanova, N, Sorokin, A., Anderson, I, Galleron, N., Candelon, B., Kapatral, V., Bhattacharyya, A., Reznik, G., Mikhailova, N., and Lapidus, A. et al. (2003) Nature 423, 87-91.

TABLE 3

Extracellular proteins predicted in the *Bacillus licheniformis* genome

| SEQ ID NO. | Gene Name | Signal Peptide Location | Putative Product | Putative Function | *B. subtilis* Gene |
|---|---|---|---|---|---|
| 11 | dacA | [1-32] | D-alanyl-D-alanine carboxypeptidase (penicillin-binding protein 5) | "Molecular Function: serine carboxypeptidase activity (GO: 0004185), Biological Process: proteolysis and peptidolysis (GO: 0006508)" | DacA |
| 45 | yabE | [1-32] | conserved hypothetical containing domain DUF348 YabE | | YabE |
| 67 | divIC | [1-66] | cell-division initiation protein | "required for both vegetative and sporulation septum formation, Biological Process: cell cycle (GO: 0007049)" | DivIC |
| 157 | BL01016 | [1-28] | N-acetylmuramoyl-L-alanine amidase | "cell wall hydrolase, Molecular Function: N-acetylmuramoyl-L-alanine amidase activity (GO: 0008745), Biological Process: peptidoglycan catabolism (GO: 0009253)" | CwlD |

TABLE 3-continued

Extracellular proteins predicted in the *Bacillus licheniformis* genome

| SEQ ID NO. | Gene Name | Signal Peptide Location | Putative Product | Putative Function | B. subtilis Gene |
|---|---|---|---|---|---|
| 159 | gerD | [1-27] | GerD | "germination response to L-alanine and to the combination of glucose, fructose, L-asparagine, and KCl (early stage)," | GerD |
| 161 | ybaN | [1-42] | "Polysaccharide deacetylase, Carbohydrate Esterase Family 4" | "Biological Process: carbohydrate metabolism (GO: 0005975), Molecular Function: hydrolase activity, acting on carbon-nitrogen (but not peptide) bonds (GO: 0016810)" | YbaN |
| 162 | pbpX | [1-43] | penicillin-binding protein | | PbpX |
| 167 | ybbC | [1-23] | conserved hypothetical protein YbbC | | YbbC |
| 168 | ybbD | [1-27] | "Glycoside hydrolase, family 3" | "Molecular Function: hydrolase activity, hydrolyzing O-glycosyl compounds (GO: 0004553), Biological Process: carbohydrate metabolism (GO: 0005975)" | YbbD |
| 169 | ybbE | [1-22] | putative beta-lactamase YbbE | | YbbE |
| 227 | | [1-34] | putative ribose ABC transporter (ribose-binding protein) | "ribose transport," | RbsB |
| 228 | yomI | [1-32] | putative lytic transglycosylase YomI | | YomI |
| 247 | penP | [1-35] | beta-lactamase precursor | "Molecular Function: aspartic-type endopeptidase activity (GO: 0004190), Biological Process: proteolysis and peptidolysis (GO: 0006508)" | PenP |
| 249 | tatAD | [1-35] | component of the twin-arginine pre-protein translocation pathway | "Biological Process: protein transport (GO: 0015031), Cellular Component: integral to membrane (GO: 0016021)" | |
| 267 | | [1-26] | "putative Proteinase inhibititor I4, serpin" | Molecular Function: serine-type endopeptidase inhibitor activity (GO: 0004867) | |
| 268 | BL01663 | [1-22] | Pectin lyase-like | | YbdN |
| 287 | BL01793 | [1-31] | putative lipoprotein | | YcdA |
| 303 | yvbX | [1-33] | "conserved protein, Glycoside Hydrolase Family 18, YvbX" | "Molecular Function: catalytic activity (GO: 0003824), Biological Process: carbohydrate metabolism (GO: 0005975)" | YvbX |
| 304 | | [1-27] | "Chitinase precursor, Glycoside Hydrolase Family 18" | "Molecular Function: catalytic activity (GO: 0003824), Biological Process: carbohydrate metabolism (GO: 0005975)" | |
| 312 | yvcE | [1-31] | "putative peptidoglycan hydrolase, DL-endopeptidase II family" | | YvcE |
| 348 | yckB | [1-34] | putative extracellular solute-binding protein YckB | "Molecular Function: transporter activity (GO: 0005215), Biological Process: transport (GO: 0006810), Cellular Component: periplasmic space (sensu Gram-negative Bacteria) (GO: 0030288)" | YckB |
| 353 | nucA | [1-37] | nuclease NucA | | NucA |
| 359 | BL01722 | [1-34] | putative extracellular solute-binding protein | "Molecular Function: transporter activity (GO: 0005215), Biological Process: transport (GO: 0006810)" | YvfK |
| 373 | | [1-25] | hypothetical protein | | |
| 382 | BL01829 | [1-25] | "putative extracellular solute-binding protein, family 3" | "Molecular Function: transporter activity (GO: 0005215), Biological Process: transport (GO: 0006810), Cellular Component: periplasmic space (sensu Gram-negative Bacteria) (GO: 0030288)" | YckK |
| 403 | BL01746 | [1-28] | ribose ABC transporter (ribose-binding protein) | "ribose transport," | RbsB |
| 409 | phy | [1-30] | phytase | "hydrolysis of phytate into inorganic phosphate and myo-inositol," | Phy |
| 426 | yclQ | [1-25] | Periplasmic binding protein | "Molecular Function: iron ion transporter activity | YclQ |

TABLE 3-continued

Extracellular proteins predicted in the *Bacillus licheniformis* genome

| SEQ ID NO. | Gene Name | Signal Peptide Location | Putative Product | Putative Function | B. subtilis Gene |
|---|---|---|---|---|---|
| | | | | (GO: 0005381), Biological Process: high affinity iron ion transport (GO: 0006827)" | |
| 438 | | [1-26] | hypothetical protein | | |
| 472 | BL02821 | [1-34] | Cell envelope-related transcriptional attenuator | | YvhJ |
| 483 | | [1-42] | hypothetical protein | | |
| 513 | ydcC | [1-28] | conserved membrane protein YdcC | | YdcC |
| 552 | yrhM | [1-68] | YrhM | | YrhM |
| 558 | ywpE | [1-26] | conserved protein YwpE | "Biological Process: biosynthesis (GO: 0009058), Molecular Function: transferase activity (GO: 0016740)" | |
| 576 | | [1-34] | putative transporter | "Molecular Function: transporter activity, (GO: 0005215), Biological Process: transport (GO: 0006810), Cellular Component: membrane (GO: 0016020)" | |
| 605 | yjeAA | [1-37] | conserved hypothetical protein | | YjeA |
| 607 | amyL | [1-30] | "alpha amylase, Glycoside Hydrolase Family 13" | "Molecular Function: alpha-amylase activity (GO: 0004556), Biological Process: carbohydrate metabolism (GO: 0005975)" | TreA |
| 610 | yvdG | [1-28] | putative maltose/maltodextrin transport system substrate-binding protein | "Molecular Function: transporter activity (GO: 0005215), Biological Process: transport (GO: 0006810)" | YvdG |
| 619 | | [1-37] | hypothetical protein | | |
| 620 | | [1-28] | hypothetical protein | | |
| 621 | ydjM | [1-41] | YdjM | | YdjM |
| 622 | ydjN | [1-21] | YdjN | | YdjN |
| 660 | yerB | [1-28] | conserved protein YerB | | YerB |
| 665 | yerH | [1-26] | YerH | | YerH |
| 683 | BL05063 | [1-35] | mannan endo-1,4-beta-mannosidase | Degradation of mannan polysaccharides | |
| 733 | | [1-29] | putative carboxypeptidase | "Molecular Function: carboxypeptidase A activity (GO: 0004182), Biological Process: proteolysis and peptidolysis (GO: 0006508)" | |
| 773 | yfkD | [1-26] | conserved protein YfkD | | YfkD |
| 776 | BL03088 | [1-24] | "Polysaccharide deacetylase, Carbohydrate Esterase Family 4" | "Biological Process: carbohydrate metabolism (GO: 0005975), Molecular Function: hydrolase activity, acting on carbon-nitrogen (but not peptide) bonds (GO: 0016810)" | YfjS |
| 784 | yfjL | [1-33] | putative transporter YfjL | "Molecular Function: transporter activity (GO: 0005215), Biological Process: transport (GO: 0006810), Cellular Component: membrane (GO: 0016020)" | YfjL |
| 787 | BL03096 | [1-26] | hypothetical protein | | |
| 813 | BL03024 | [1-26] | "putative extracellular solute-binding protein, family 1" | "Molecular Function: transporter activity (GO: 0005215), Biological Process: transport (GO: 0006810)" | YtcQ |
| 841 | appAC | [1-30] | oligopeptide ABC transporter (binding protein) | "required for initiation of sporulation, competence development, and oligopeptide transport, Molecular Function: transporter activity (GO: 0005215), Biological Process: transport (GO: 0006810)" | OppA |
| 866 | ssuA | [1-24] | aliphatic sulfonate ABC transporter (binding lipoprotein) | | SsuA |
| 876 | | [1-23] | hypothetical protein | | |
| 886 | | [1-23] | hypothetical protein | | |
| 892 | | [1-28] | hypothetical protein | | YhcC |
| 900 | BL03178 | [1-27] | putative lipoprotein | | YhcJ |
| 902 | BL03161 | [1-31] | hypothetical protein | | YhcM |
| 904 | BL03176 | [1-29] | hypothetical protein | | YhcN |
| 905 | BL03175 | [1-30] | hypothetical protein | | YhcP |
| 934 | lytE | [1-26] | cell wall hydrolase phosphatase-associated protein | "cell wall lytic activity, Biological Process: cell wall catabolism | LytE |

TABLE 3-continued

Extracellular proteins predicted in the *Bacillus licheniformis* genome

| SEQ ID NO. | Gene Name | Signal Peptide Location | Putative Product | Putative Function | B. subtilis Gene |
|---|---|---|---|---|---|
| 937 | | [1-26] | putative glucose dehydrogenase | (GO: 0016998), Biological Process: cell wall catabolism (GO: 0016998)" | |
| 965 | BL02841 | [1-41] | "Polysaccharide deacetylase, Carbohydrate Esterase Family 4" | "Biological Process: carbohydrate metabolism (GO: 0005975), Molecular Function: hydrolase activity, acting on carbon-nitrogen (but not peptide) bonds (GO: 0016810)" | YheN |
| 996 | prsA | [1-30] | molecular chaperone PrsA | "essential for the stability of secreted proteins at stages following translocation across the membrane, Molecular Function: isomerase activity (GO: 0016853)" | PrsA |
| 1001 | BL02907 | [1-31] | hypothetical protein | | YhaH |
| 1032 | yhfQ | [1-32] | putative transferase | "Biological Process: metabolism (GO: 0008152), Molecular Function: transferase activity (GO: 0016740)" | YhfQ |
| 1044 | epr | [1-27] | extracellular serine protease | "Molecular Function: subtilase activity (GO: 0004289), Biological Process: proteolysis and peptidolysis (GO: 0006508), Molecular Function: subtilase activity (GO: 0004289), Biological Process: proteolysis and peptidolysis (GO: 0006508)" | Epr |
| 1061 | | [1-24] | hypothetical protein | | |
| 1063 | msmE | [1-29] | mutiple sugar-binding protein MsmE | "Molecular Function: transporter activity (GO: 0005215), Biological Process: transport (GO: 0006810)" | MsmE |
| 1073 | BL01323 | [1-28] | conserved hypothetical protein | | LytB |
| 1077 | yvgL | [1-29] | molybdate transport system substrate-binding protein | "Molecular Function: molybdate-transporting ATPase activity (GO: 0015412), Biological Process: molybdate ion transport (GO: 0015689)" | YvgL |
| 1113 | BL01309 | [1-24] | Short-chain dehydrogenase/reductase SDR | "Biological Process: metabolism (GO: 0008152), Molecular Function: oxidoreductase activity (GO: 0016491)" | YcdF |
| 1150 | appA | [1-32] | oligopeptide ABC transporter (oligopeptide-binding protein) | "oligopeptide transport, Molecular Function: transporter activity (GO: 0005215), Biological Process: transport (GO: 0006810)" | AppA |
| 1156 | oppA | [1-29] | oligopeptide ABC transporter (binding protein) | "required for initiation of sporulation, competence development, and oligopeptide transport, Molecular Function: transporter activity (GO: 0005215), Biological Process: transport (GO: 0006810)" | OppA |
| 1165 | BL03332 | [1-31] | conserved hypothetical protein | | YflP |
| 1216 | abnAA | [1-26] | Glycoside Hydrolase Family 43 | "degradation of plant cell wall polysaccharide, Molecular Function: hydrolase activity, hydrolyzing O-glycosyl compounds (GO: 0004553), Biological Process: carbohydrate metabolism (GO: 0005975)" | AbnA |
| 1219 | | [1-30] | hypothetical protein | | |
| 1226 | BL01957 | [1-23] | conserved hypothetical protein | | YoeB |
| 1227 | BL01953 | [1-26] | Peptidoglycan-binding protein | "Biological Process: cell wall catabolism | YocH |

TABLE 3-continued

Extracellular proteins predicted in the *Bacillus licheniformis* genome

| SEQ ID NO. | Gene Name | Signal Peptide Location | Putative Product | Putative Function | B. subtilis Gene |
|---|---|---|---|---|---|
| 1283 | yesO | [1-28] | putative transport system substrate-binding protein YesO | (GO: 0016998), Biological Process: cell wall catabolism (GO: 0016998)" "Molecular Function: transporter activity (GO: 0005215), Biological Process: transport (GO: 0006810)" | YesO |
| 1291 | yesW | [1-33] | putative polysaccharide lyase family 11 protein | | YesW |
| 1299 | lplA | [1-32] | lipoprotein | "Molecular Function: transporter activity (GO: 0005215), Biological Process: transport (GO: 0006810)" | LplA |
| 1311 | dppE | [1-27] | dipeptide ABC transporter (dipeptide-binding protein) | "Molecular Function: transporter activity (GO: 0005215), Biological Process: transport (GO: 0006810)" | DppE |
| 1319 | pelI | [1-25] | "pectate lyase family 1, PelI" | | Pel |
| 1332 | | [1-30] | hypothetical protein | | |
| 1341 | | [1-27] | hypothetical protein | | |
| 1345 | | [1-27] | hypothetical protein | | YonS |
| 1368 | | [1-28] | hypothetical protein | | |
| 1415 | pbpC | [1-30] | penicillin-binding protein 3 | Molecular Function: penicillin binding (GO: 0008658) | PbpC |
| 1448 | | [1-28] | hypothetical protein | | |
| 1475 | BL05139 | [1-27] | glycerophosphoryl diester phosphodiesterase | "hydrolysis of deacylated phospholipids, Biological Process: glycerol metabolism (GO: 0006071), Molecular Function: glycerophosphodiester phosphodiesterase activity (GO: 0008889)" | GlpQ |
| 1479 | | [1-27] | hypothetical protein | | |
| 1493 | | [1-27] | hypothetical protein | | |
| 1496 | BL03556 | [1-25] | putative Cell wall hydrolase | | YkvT |
| 1498 | ykvV | [1-28] | hypothetical protein | Contains thioredoxin domain 2 | YkvV |
| 1501 | | [1-25] | hypothetical protein | | |
| 1512 | ykwC | [1-24] | Hypothetical oxidoreductase | | YkwC |
| 1513 | BL03646 | [1-27] | Allergen V5/Tpx-1 related | Cellular Component: extracellular (GO: 0005576) | YkwD |
| 1527 | | [1-28] | hypothetical protein | | |
| 1553 | BL01601 | [1-32] | "putative secretion protein, protein transporter" | "Molecular Function: protein transporter activity (GO: 0008565), Biological Process: protein secretion (GO: 0009306), Cellular Component: membrane (GO: 0016020)" | YknX |
| 1565 | | [1-40] | hypothetical protein | | |
| 1576 | ykyA | [1-29] | Hypothetical protein ykyA | | YkyA |
| 1601 | BL02997 | [1-27] | hypothetical protein | | YlaJ |
| 1617 | ylbC | [1-34] | conserved hypothetical protein YlbC | Cellular Component: extracellular (GO: 0005576) | YlbC |
| 1625 | ylbL | [1-29] | YlbL | Molecular Function: protein binding (GO: 0005515) | YlbL |
| 1635 | ftsL | [1-59] | cell-division protein | "septum formation (early stage)," | FtsL |
| 1636 | pbpB | [1-42] | penicillin-binding protein 2B | "formation of the cell-division septum (late stage)," | PbpB |
| 1644 | divIB | [1-57] | cell-division initiation protein | "probably involved in stabilizing or promoting the assembly of the division complex (septum formation)," | DivIB |
| 1645 | BL02246 | [1-29] | conserved hypothetical protein | | YlxW |
| 1646 | BL02248 | [1-30] | hypothetical protein | | YlxX |
| 1650 | bprA | [1-28] | bacillopeptidase F | "Molecular Function: subtilase activity (GO: 0004289), Biological Process: proteolysis and peptidolysis (GO: 0006508)" | Bpr |
| 1651 | bprB | [1-31] | bacillopeptidase F | "Molecular Function: subtilase activity (GO: 0004289), Biological Process: proteolysis and peptidolysis (GO: 0006508)" | Bpr |

TABLE 3-continued

Extracellular proteins predicted in the *Bacillus licheniformis* genome

| SEQ ID NO. | Gene Name | Signal Peptide Location | Putative Product | Putative Function | *B. subtilis* Gene |
|---|---|---|---|---|---|
| 1752 | fliL | [1-32] | flagellar protein | "required for flagellar formation, Biological Process: ciliary/flagellar motility (GO: 0001539), Biological Process: chemotaxis (GO: 0006935), Cellular Component: flagellar basal body (sensu Bacteria) (GO: 0009425)" | FliL |
| 1781 | celA | [1-34] | Glycoside Hydrolase Family 9 | "Molecular Function: hydrolase activity, hydrolyzing O-glycosyl compounds (GO: 0004553), Biological Process: carbohydrate metabolism (GO: 0005975)" | |
| 1783 | celC | [1-34] | Glycoside Hydrolase Family 5 | "Molecular Function: hydrolase activity, hydrolyzing O-glycosyl compounds (GO: 0004553), Biological Process: carbohydrate metabolism (GO: 0005975)" | |
| 1784 | celD | [1-32] | Glycoside Hydrolase family 5 | "Molecular Function: hydrolase activity, hydrolyzing O-glycosyl compounds (GO: 0004553), Biological Process: carbohydrate metabolism (GO: 0005975)" | |
| 1820 | BL03655 | [1-31] | conserved hypothetical protein | | YmdA |
| 1839 | | [1-29] | hypothetical protein | | |
| 1904 | yoaO | [1-38] | YoaO | | YoaO |
| 1914 | yoaW | [1-26] | YoaW | | YoaW |
| 1926 | | [1-38] | phage-like protein | | |
| 1929 | nucB | [1-34] | nuclease | | NucB |
| 1931 | BL05188 | [1-29] | Peptidoglycan-binding protein | Biological Process: cell wall catabolism (GO: 0016998) | YneA |
| 1946 | yneN | [1-29] | putative thiol: disulfide interchange protein YneN | "Molecular Function: electron transporter activity (GO: 0005489), Biological Process: electron transport (GO: 0006118)" | YneN |
| 1983 | bglC | [1-50] | "endo-1,4-beta-glucanase, Glycoside hydrolase Family 5" | "Molecular Function: hydrolase activity, hydrolyzing O-glycosyl compounds (GO: 0004553), Biological Process: carbohydrate metabolism (GO: 0005975);" | BglC |
| 1990 | ywoF | [1-22] | "Polysaccharide Lyase Family 9, YwoF" | | YwoF |
| 1995 | BL00297 | [1-27] | conserved hypothetical protein | | YddR |
| 2011 | yjmF | [1-31] | Short-chain dehydrogenase/reductase SDR | "Biological Process: metabolism (GO: 0008152), Molecular Function: oxidoreductase activity (GO: 0016491)" | YjmF |
| 2016 | dctB | [1-29] | possible C4-dicarboxylate binding protein | ",Biological Process: transport (GO: 0006810), Cellular Component: periplasmic space (sensu Gram-negative Bacteria) (GO: 0030288)" | DctB |
| 2028 | dacC | [1-29] | penicillin-binding protein (D-alanyl-D-alanine carboxypeptidase) | "Molecular Function: serine carboxypeptidase activity (GO: 0004185), Biological Process: proteolysis and peptidolysis (GO: 0006508)" | DacC |
| 2060 | | [1-37] | hypothetical protein | | |
| 2072 | BL00899 | [1-28] | "Spore germination B3 GerAC like, C-terminal" | | YndF |
| 2105 | | [1-33] | conserved hypothetical protein | | |
| 2108 | BL01303 | [1-26] | Peptidoglycan-binding protein | "Biological Process: cell wall catabolism (GO: 0016998), Biological Process: cell wall catabolism (GO: 0016998)" | YocH |
| 2123 | | [1-36] | hypothetical protein | | |
| 2132 | BL01404 | [1-24] | hypothetical protein | | YoqH |
| 2152 | yvgO | [1-25] | conserved protein YvgO | | YvgO |
| 2160 | lytF | [1-27] | gamma-D-glutamate-meso-diaminopimelate muropeptidase (major autolysin) (CWBP49') | "cell wall lytic activity, Biological Process: cell wall catabolism (GO: 0016998)" | LytF |
| 2167 | yoaJ | [1-26] | YoaJ | | YoaJ |
| 2177 | ctpA | [1-37] | carboxy-terminal processing protease | ",Biological Process: proteolysis and peptidolysis (GO: 0006508), Molecular Function: serine-type | CtpA |

TABLE 3-continued

Extracellular proteins predicted in the *Bacillus licheniformis* genome

| SEQ ID NO. | Gene Name | Signal Peptide Location | Putative Product | Putative Function | B. subtilis Gene |
|---|---|---|---|---|---|
| | | | | peptidase activity (GO: 0008236)" | |
| 2180 | yodJ | [1-31] | putative carboxypeptidase | | YodJ |
| 2207 | ypmS | [1-34] | conserved protein YpmS | | YpmS |
| 2208 | ypmR | [1-24] | conserved protein YpmR | Molecular Function: catalytic activity (GO: 0003824) | YpmR |
| 2209 | ypmQ | [1-25] | conserved hypothetical YpmQ | Biological Process: electron transport (GO: 0006118) | YpmQ |
| 2218 | ypjP | [1-30] | conserved hypothetical protein YpjP | | YpjP |
| 2266 | ponA | [1-63] | "penicillin-binding proteins, Glycosyl Transferase Family 51" | "involved in division septum formation," | PonA |
| 2271 | aspB | [1-23] | aspartate aminotransferase | "Molecular Function: transaminase activity (GO: 0008483), Biological Process: biosynthesis (GO: 0009058)" | AspB |
| 2272 | ypmB | [1-25] | conserved protein YpmB | | YpmB |
| 2315 | BL02789 | [1-29] | hypothetical protein | | YphF |
| 2328 | sleB | [1-34] | spore cortex-lytic enzyme | | SleB |
| 2330 | ansZA | [1-18] | putative Asparaginase/glutaminase | "Biological Process: amino acid metabolism (GO: 0006520), Biological Process: amino acid metabolism (GO: 0006520)" | YccC |
| 2334 | BL02228 | [1-27] | putative hydrolase | Molecular Function: hydrolase activity (GO: 0016787) | YpbG |
| 2344 | yocH | [1-31] | putative peptidogycan hydrolase YocH | "Biological Process: cell wall catabolism (GO: 0016998), Biological Process: cell wall catabolism (GO: 0016998)" | |
| 2347 | BL00652 | [1-32] | hypothetical protein | | LytR |
| 2348 | yheN | [1-53] | "Carbohydrate Esterase Family 4, YheN" | "Biological Process: carbohydrate metabolism (GO: 0005975), Molecular Function: hydrolase activity, acting on carbon-nitrogen (but not peptide) bonds (GO: 0016810)" | YheN |
| 2349 | | [1-29] | hypothetical protein | | |
| 2360 | dacB | [1-28] | D-alanyl-D-alanine carboxypeptidase (penicillin-binding protein 5*) | "required for spore cortex synthesis, Molecular Function: serine carboxypeptidase activity (GO: 0004185), Biological Process: proteolysis and peptidolysis (GO: 0006508)" | DacB |
| 2371 | BL01892 | [1-44] | conserved hypothetical protein | | YpuD |
| 2376 | BL03279 | [1-24] | conserved hypothetical protein | | YpuA |
| 2392 | dacF | [1-33] | penicilin binding protein (putative D-alanyl-D-alanine carboxypeptidase) | "required for spore cortex synthesis, Molecular Function: serine carboxypeptidase activity (GO: 0004185), Biological Process: proteolysis and peptidolysis (GO: 0006508)" | DacF |
| 2400 | BL01161 | [1-28] | "Phosphotransferase system, lactose/cellobiose-specific IIB subunit" | "Molecular Function: sugar porter activity (GO: 0005351), Biological Process: phosphoenolpyruvate-dependent sugar phosphotransferase system (GO: 0009401)" | |
| 2418 | lip | [1-31] | lipase | Molecular Function: catalytic activity (GO: 0003824) | Lip |
| 2420 | appAA | [1-32] | oligopeptide ABC transporter (oligopeptide-binding protein) | "oligopeptide transport, Molecular Function: transporter activity (GO: 0005215), Biological Process: transport (GO: 0006810)" | AppA |
| 2435 | | [1-24] | hypothetical protein | | |
| 2436 | | [1-29] | hypothetical protein | | |
| 2438 | BL00808 | [1-38] | hypothetical protein | | YmaC |
| 2449 | | [1-35] | hypothetical protein | | |
| 2450 | | [1-31] | conserved hyopothetical protein | | SsuA |

TABLE 3-continued

Extracellular proteins predicted in the *Bacillus licheniformis* genome

| SEQ ID NO. | Gene Name | Signal Peptide Location | Putative Product | Putative Function | *B. subtilis* Gene |
|---|---|---|---|---|---|
| 2456 | BL01380 | [1-28] | "Phosphotransferase system, lactose/cellobiose-specific IIB subunit" | "Molecular Function: sugar porter activity (GO: 0005351), Biological Process: phosphoenolpyruvate-dependent sugar phosphotransferase system (GO: 0009401)" | |
| 2481 | BL01514 | [1-36] | Cell wall hydrolase/autolysin | "Molecular Function: N-acetylmuramoyl-L-alanine amidase activity (GO: 0008745), Biological Process: peptidoglycan catabolism (GO: 0009253)" | YqiI |
| 2482 | yqiH | [1-33] | YqiH | | YqiH |
| 2484 | | [1-26] | hypothetical protein | | |
| 2499 | spoIIIAH | [1-32] | SpoIIIAH | "mutants block sporulation after engulfment," | SpoIIIAH |
| 2505 | spoIIIAB | [1-23] | SpoIIIAB | "mutants block sporulation after engulfment," | SpoIIIAB |
| 2517 | yqhL | [1-24] | conserved protein YqhL | | YqhL |
| 2518 | opuAC | [1-31] | glycine betaine ABC transporter (glycine betaine-binding protein) | "glycine betaine transport, Molecular Function: transporter activity (GO: 0005215), Molecular Function: binding (GO: 0005488), Biological Process: transport (GO: 0006810)" | OpuAC |
| 2528 | tasA | [1-28] | translocation-dependent antimicrobial spore component | | TasA |
| 2530 | yqxM | [1-44] | YqxM | | YqxM |
| 2531 | yqzG | [1-24] | YqzG | | YqzG |
| 2533 | comGG | [1-38] | probably part of the DNA transport machinery ComGG | "required for exogenous DNA-binding," | ComGG |
| 2546 | yqgU | [1-28] | conserved protein YqgU | | YqgU |
| 2548 | fhuD | [1-32] | ferrichrome ABC transporter (ferrichrome-binding protein) | "Molecular Function: iron ion transporter activity (GO: 0005381), Biological Process: high affinity iron ion transport (GO: 0006827)" | FhuD |
| 2560 | yqzC | [1-33] | conserved protein YqzC | | YqzC |
| 2565 | pstS | [1-33] | phosphate ABC transporter (binding protein) | "involved in high-affinity phosphate uptake, Molecular Function: transporter activity (GO: 0005215), Biological Process: transport (GO: 0006810)" | PstS |
| 2566 | pbpA | [1-44] | penicillin-binding protein 2A | "involved in the synthesis of peptidoglycan associated with cell wall elongation in spore outgrowth, Molecular Function: penicillin binding (GO: 0008658)" | PbpA |
| 2571 | yqfZ | [1-40] | conserved protein YqfZ | | |
| 2616 | BL01411 | [1-37] | conserved hypothetical protein | | YqfA |
| 2632 | yqxA | [1-29] | YqxA | | YqxA |
| 2633 | spoIIP | [1-55] | SpoIIP | "required for dissolution of the septal cell wall," | SpoIIP |
| 2652 | BL02075 | [1-36] | putative lipoprotein | Molecular Function: catalytic activity (GO: 0003824) | YqeF |
| 2697 | appAB | [1-36] | oligopeptide ABC transporter (oligopeptide-binding protein) | "oligopeptide transport, Molecular Function: transporter activity (GO: 0005215), Biological Process: transport (GO: 0006810)" | AppA |
| 2706 | | [1-32] | putative phosphoesterase | | |
| 2707 | BL02428 | [1-27] | carboxylesterase family | Molecular Function: catalytic activity (GO: 0003824) | PnbA |
| 2710 | BL03118 | [1-28] | hypothetical protein | | YndA |
| 2712 | sacC | [1-24] | Glycoside Hydrolase Family 32 | "Molecular Function: hydrolase activity, hydrolyzing O-glycosyl compounds (GO: 0004553), Biological Process: carbohydrate metabolism (GO: 0005975)" | SacC |
| 2729 | BL00468 | [1-33] | Periplasmic iron-binding protein | "Molecular Function: iron ion transporter activity | YxeB |

TABLE 3-continued

Extracellular proteins predicted in the *Bacillus licheniformis* genome

| SEQ ID NO. | Gene Name | Signal Peptide Location | Putative Product | Putative Function | B. subtilis Gene |
|---|---|---|---|---|---|
| | | | | (GO: 0005381), Biological Process: high affinity iron ion transport (GO: 0006827)" | |
| 2745 | yrrS | [1-50] | conserved protein YrrS | | YrrS |
| 2752 | yrrL | [1-44] | conserved protein YrrL | | YrrL |
| 2771 | yrvJ | [1-29] | N-acetylmuramoyl-L-alanine amidase YrvJ | | YrvJ |
| 2793 | ymaC | [1-24] | phage-related protein YmaC | | YmaC |
| 2797 | coxA | [1-27] | spore cortex protein | | CoxA |
| 2801 | nadB | [1-37] | L-aspartate oxidase | "required for NAD biosynthesis," | NadB |
| 2818 | mreC | [1-33] | cell-shape determining protein | ",Biological Process: regulation of cell shape (GO: 0008360)" | MreC |
| 2866 | | [1-28] | hypothetical protein | | |
| 2872 | gerM | [1-34] | spore germination protein GerM | "germination (cortex hydrolysis) and sporulation (stage II, multiple polar septa)," | GerM |
| 2898 | | [1-33] | hypothetical protein | | |
| 2911 | araN | [1-32] | sugar-binding protein | "L-arabinose transport, Molecular Function: transporter activity (GO: 0005215), Biological Process: transport (GO: 0006810)" | AraN |
| 2916 | abnAB | [1-28] | Glycoside Hydrolase Family 43 | "degradation of plant cell wall polysaccharide, Molecular Function: hydrolase activity, hydrolyzing O-glycosyl compounds (GO: 0004553), Biological Process: carbohydrate metabolism (GO: 0005975)" | AbnA |
| 2939 | pelB | [1-31] | "pectate lyase, Polysaccharide Lyase Family 1" | | PelB |
| 3005 | ytxE | [1-51] | YtxE | Cellular Component: outer membrane (sensu Gram-negative Bacteria) (GO: 0009279) | YtxE |
| 3049 | ytcQ | [1-30] | putative multiple sugar transport system substrate-binding protein YtcQ | "Molecular Function: transporter activity (GO: 0005215), Biological Process: transport (GO: 0006810)" | YtcQ |
| 3059 | BL00013 | [1-30] | putative lipoprotein | | YusA |
| 3081 | ytlA | [1-33] | putative sulfonate transport system substrate-binding protein YtlA | | YtlA |
| 3088 | ytkA | [1-29] | conserved protein YtkA | | YtkA |
| 3093 | BL05310 | [1-29] | Periplasmic solute binding protein | "Molecular Function: binding (GO: 0005488), Cellular Component: periplasmic space (sensu Gram-negative Bacteria) (GO: 0030288)" | YcdH |
| 3217 | | [1-22] | hypothetical protein | Molecular Function: catalytic activity (GO: 0003824) | |
| 3235 | yuiC | [1-34] | conserved protein YuiC | | YuiC |
| 3264 | yutC | [1-24] | conserved protein YutC | | YutC |
| 3266 | BL02121 | [1-22] | putative metallopeptidase | "Molecular Function: metalloendopeptidase activity (GO: 0004222), Biological Process: proteolysis and peptidolysis (GO: 0006508)" | YunA |
| 3267 | | [1-32] | hypothetical protein | | |
| 3269 | yunB | [1-41] | conserved protein YunB | | YunB |
| 3284 | yurYA | [1-40] | extracellular ribonuclease | Molecular Function: nuclease activity (GO: 0004518) | YurI |
| 3298 | yusA | [1-28] | putative ABC transport system substrate-binding protein YusA | | YusA |
| 3318 | yfiY | [1-29] | ABC transport system substrate-binding protein | "Molecular Function: iron ion transporter activity (GO: 0005381), Biological Process: high affinity iron ion transport (GO: 0006827)" | YfiY |
| 3319 | yusW | [1-28] | YusW | | YusW |
| 3333 | gerAC | [1-25] | spore germination protein A3 precursor | "germination response to L-alanine and related amino acids (earliest stage)," | GerAC |
| 3338 | yvqG | [1-39] | conserved protein YvqG | "Biological Process: metabolism (GO: 0008152), Molecular Function: oxidoreductase activity (GO: 0016491)" | YvqG |

TABLE 3-continued

Extracellular proteins predicted in the *Bacillus licheniformis* genome

| SEQ ID NO. | Gene Name | Signal Peptide Location | Putative Product | Putative Function | *B. subtilis* Gene |
|---|---|---|---|---|---|
| 3349 | yvrC | [1-37] | putative iron transport system substrate-binding protein YvrC | "Molecular Function: iron ion transporter activity (GO: 0005381), Biological Process: high affinity iron ion transport (GO: 0006827)" | YvrC |
| 3380 | BL02684 | [1-27] | putative Extracellular solute-binding protein | Molecular Function: transporter activity (GO: 0005215) | YvfK |
| 3384 | BL02680 | [1-31] | putative Glycoside Hydrolase Family 3 | | YbbD |
| 3387 | mntA | [1-28] | manganese transport system substrate-binding protein | "Molecular Function: binding (GO: 0005488), Cellular Component: periplasmic space (sensu Gram-negative Bacteria) (GO: 0030288)" | YcdH |
| 3429 | | [1-33] | hypothetical protein | | |
| 3465 | | [1-32] | hypothetical protein | | |
| 3492 | opuCC | [1-32] | glycine betaine/carnitine/choline ABC transporter (osmoprotectant-binding protein) | "high affinity transport of glycine betaine, carnitine, and choline, Molecular Function: transporter activity (GO: 0005215), Molecular Function: binding (GO: 0005488), Biological Process: transport (GO: 0006810)" | OpuCC |
| 3499 | BL03470 | [1-29] | "Periplasmic binding protein, putative iron transporter" | "Molecular Function: iron ion transporter activity (GO: 0005381), Biological Process: high affinity iron ion transport (GO: 0006827)" | YfiY |
| 3510 | | [1-26] | hypothetical protein | | |
| 3547 | sacB | [1-30] | "levansucrase, Glycoside Hydrolase Family 68" | "Molecular Function: hydrolase activity, hydrolyzing O-glycosyl compounds (GO: 0004553), Biological Process: sugar utilization (GO: 0007587)" | SacB |
| 3548 | levB | [1-33] | "endolevanase, Glycoside Hydrolase Family 32" | | YveB |
| 3559 | | [1-29] | putative ribonuclease | "Molecular Function: RNA binding (GO: 0003723), Molecular Function: endoribonuclease activity (GO: 0004521)" | |
| 3578 | yvpB | [1-39] | putative cysteine protease YvpB | "Molecular Function: cysteine-type endopeptidase activity (GO: 0004197), Biological Process: proteolysis and peptidolysis (GO: 0006508)" | YvpB |
| 3579 | yvpA | [1-29] | Polysaccharide Lyase Family 3 | | YvpA |
| 3587 | yvnB | [1-29] | YvnB | | YvnB |
| 3600 | ctpB | [1-37] | "Peptidase S41A, C-terminal protease" | "Biological Process: proteolysis and peptidolysis (GO: 0006508), Molecular Function: serine-type peptidase activity (GO: 0008236)" | YvjB |
| 3602 | BL03388 | [1-291] | "Spectrin repeat, Rudiment single hybrid motif" | ";" | YvcE |
| 3643 | lytC | [1-14] | N-acetylmuramoyl-L-alanine amidase (major autolysin) (CWBP49) | "involved in cell separation, cell wall turnover, antibiotic-induced lysis, motility and general cell lysis induced by sodium azide, Molecular Function: N-acetylmuramoyl-L-alanine amidase activity (GO: 0008745), Biological Process: peptidoglycan catabolism | LytC |
| 3644 | lytB | [1-26] | modifier protein of major autolysin LytC (CWBP76) | | LytB |
| 3645 | BL03297 | [1-25] | membrane bound lipoprotein | involved in the secretion of major autolysin | LytA |
| 3646 | lytR | [1-32] | membrane-bound protein | "attenuator role for lytABC and lytR expression," | LytR |
| 3656 | lytD | [1-29] | "N-acetylglucosaminidase (major autolysin), Glycoside Hydrolase Family 73" | "involved in cell separation, cell wall turnover, antibiotic-induced lysis and motility, Molecular Function: amidase activity (GO: 0004040), Biological Process: peptidoglycan catabolism (GO: 0009253)" | LytD |

TABLE 3-continued

Extracellular proteins predicted in the *Bacillus licheniformis* genome

| SEQ ID NO. | Gene Name | Signal Peptide Location | Putative Product | Putative Function | B. subtilis Gene |
|---|---|---|---|---|---|
| 3670 | pgdS | [1-34] | gamma-DL-glutamyl hydrolase | "gamma-DL-glutamyl hydrolase cleaving the gamma-glutamyl bond only between D- and L-glutamic acids of PGA, DL-endopeptidase II family" | YwtD |
| 3671 | ywtC | [1-25] | YwtC | | |
| 3672 | pgsAA | [1-47] | poly-gamma-glutamate synthesis protein | | YwtB |
| 3680 | rbsB | [1-28] | ribose ABC transporter (ribose-binding protein) | "ribose transport," | RbsB |
| 3738 | feuA | [1-28] | iron-binding protein | "component of iron-uptake system, Molecular Function: iron ion transporter activity (GO: 0005381), Biological Process: high affinity iron ion transport (GO: 0006827)" | FeuA |
| 3751 | ywmD | [1-25] | YwmD | | YwmD |
| 3752 | ywmC | [1-24] | YwmC | | YwmC |
| 3753 | spoIID | [1-33] | SpoIID | "required for complete dissolution of the asymmetric septum," | SpoIID |
| 3755 | ywmB | [1-30] | conserved protein YwmB | | YwmB |
| 3773 | spoIIR | [1-29] | SpoIIR | required for processing of pro-sigma-E | SpoIIR |
| 3801 | ywjE | [1-28] | putative Phospholipase | "Molecular Function: catalytic activity (GO: 0003824), Biological Process: metabolism (GO: 0008152)" | YwjE |
| 3808 | BL03962 | [1-41] | "Penicillin-binding protein, Glycosyl Transferase Family 51" | "Molecular Function: penicillin binding (GO: 0008658), Biological Process: cell wall biosynthesis (sensu Bacteria) (GO: 0009273)" | YwhE |
| 3812 | | [1-25] | hypothetical protein | | |
| 3829 | BL03904 | [1-32] | hypothetical protein | | YuaB |
| 3849 | vpr | [1-29] | extracellular serine protease | "Molecular Function: subtilase activity (GO: 0004289), Biological Process: proteolysis and peptidolysis (GO: 0006508)" | Vpr |
| 3906 | ywaD | [1-31] | Putative aminopeptidase | "Biological Process: proteolysis and peptidolysis (GO: 0006508), Molecular Function: peptidase activity (GO: 0008233)" | YwaD |
| 3914 | dltD | [1-27] | precusor DltD | D-alanine esterification of lipoteichoic acid and wall teichoic acid (D-alanine transfer from undecaprenol-P to the poly(glycerophosphate) chain of LTA) | DltD |
| 3920 | licB | [1-24] | phosphotransferase system (PTS) lichenan-specific enzyme IIB component | "Molecular Function: sugar porter activity (GO: 0005351), Biological Process: phosphoenolpyruvate-dependent sugar phosphotransferase system (GO: 0009401)" | |
| 3933 | BL05372 | [1-31] | hypothetical protein | | YweA |
| 3954 | lanP | [1-25] | serine protease | "subtilase activity (GO: 0004289), proteolysis and peptidolysis (GO: 0006508), lantibiotic leader peptide processing" | IspA |
| 3970 | ansA | [1-29] | L-asparaginase | "Molecular Function: asparaginase activity (GO: 0004067), Biological Process: amino acid metabolism (GO: 0006520)" | AnsA |
| 3977 | BL02958 | [1-25] | conserved hypothetical protein | | YxeA |
| 3978 | yxkH | [1-28] | "Polysaccharide deacetylase, Carbohydrate Esterase Family 4" | "Biological Process: carbohydrate metabolism (GO: 0005975), Molecular Function: hydrolase activity, acting on carbon-nitrogen (but not peptide) bonds (GO: 0016810)" | YxkH |
| 3982 | BL02963 | [1-30] | Glycerophosphoryl diester phosphodiesterase | "Biological Process: glycerol metabolism (GO: 0006071), | YhdW |

TABLE 3-continued

Extracellular proteins predicted in the *Bacillus licheniformis* genome

| SEQ ID NO. | Gene Name | Signal Peptide Location | Putative Product | Putative Function | *B. subtilis* Gene |
|---|---|---|---|---|---|
| | | | | Molecular Function: glycerophosphodiester phosphodiesterase activity (GO: 0008889)" | |
| 3983 | BL05379 | [1-28] | hypothetical protein | | |
| 3996 | | [1-73] | hypothetical protein | | |
| 4011 | BL05383 | [1-34] | hypothetical protein | | YjeA |
| 4016 | | [1-31] | hypothetical protein | Biological Process: electron transport (GO: 0006118) | |
| 4046 | yxiA | [1-27] | "Glycoside hydrolase, family 43" | "Molecular Function: hydrolase activity, hydrolyzing O-glycosyl compounds (GO: 0004553), Biological Process: carbohydrate metabolism (GO: 0005975)" | YxiA |
| 4058 | ydaJ | [1-29] | putative Glycoside transferase | | YdaJ |
| 4080 | glpQ | [1-29] | glycerophosphoryl diester phosphodiesterase | "hydrolysis of deacylated phospholipids, Biological Process: glycerol metabolism (GO: 0006071), Molecular Function: glycerophosphodiester phosphodiesterase activity (GO: 0008889)" | GlpQ |
| 4099 | yxeA | [1-34] | conserved hypothetical protein | | |
| 4103 | yvfO | [1-28] | Glyccosyl Hydrolase Family 53 | | YvfO |
| 4107 | cycB | [1-32] | "putative extracellular solute-binding protein, family 1 CycB" | "Molecular Function: transporter activity (GO: 0005215), Biological Process: transport (GO: 0006810)" | YvfK |
| 4121 | | [1-28] | hypothetical protein | | |
| 4128 | | [1-34] | hypothetical protein | | |
| 4130 | | [1-42] | hypothetical protein | | |
| 4158 | yycH | [1-36] | conserved hypothetical YycH | | YycH |

TABLE 4

Codon Usage Table for Chromosome

| # Codon | Amino acid | Fract | /1000 | Number |
|---|---|---|---|---|
| GCA | A | 0.230 | 18.394 | 22495 |
| GCC | A | 0.272 | 21.724 | 26567 |
| GCG | A | 0.301 | 24.082 | 29451 |
| GCT | A | 0.197 | 15.766 | 19281 |
| TGC | C | 0.662 | 5.113 | 6253 |
| TGT | C | 0.338 | 2.613 | 3195 |
| GAC | D | 0.432 | 22.129 | 27063 |
| GAT | D | 0.568 | 29.114 | 35605 |
| GAA | E | 0.704 | 51.721 | 63253 |
| GAG | E | 0.296 | 21.797 | 26657 |
| TTC | F | 0.354 | 16.034 | 19609 |
| TTT | F | 0.646 | 29.223 | 35738 |
| GGA | G | 0.316 | 22.644 | 27693 |
| GGC | G | 0.374 | 26.825 | 32806 |
| GGG | G | 0.171 | 12.287 | 15026 |
| GGT | G | 0.139 | 9.957 | 12177 |
| CAC | H | 0.386 | 8.412 | 10288 |
| CAT | H | 0.614 | 13.369 | 16350 |
| ATA | I | 0.101 | 7.217 | 8826 |
| ATC | I | 0.487 | 34.741 | 42487 |
| ATT | I | 0.412 | 29.376 | 35926 |
| AAA | K | 0.693 | 49.125 | 60078 |
| AAG | K | 0.307 | 21.739 | 26586 |
| CTA | L | 0.032 | 3.106 | 3798 |
| CTC | L | 0.152 | 14.848 | 18158 |
| CTG | L | 0.263 | 25.592 | 31298 |
| CTT | L | 0.229 | 22.330 | 27309 |
| TTA | L | 0.143 | 13.920 | 17023 |
| TTG | L | 0.181 | 17.639 | 21572 |

TABLE 4-continued

Codon Usage Table for Chromosome

| # Codon | Amino acid | Fract | /1000 | Number |
|---|---|---|---|---|
| ATG | M | 1.000 | 26.541 | 32458 |
| AAC | N | 0.505 | 19.159 | 23431 |
| AAT | N | 0.495 | 18.780 | 22967 |
| CCA | P | 0.112 | 4.189 | |
| CCC | P | 0.120 | 4.477 | 5475 |
| CCG | P | 0.520 | 19.405 | 23731 |
| CCT | P | 0.248 | 9.236 | 11295 |
| CAA | Q | 0.465 | 16.656 | 20369 |
| CAG | Q | 0.535 | 19.179 | 23455 |
| AGA | R | 0.218 | 9.611 | 11754 |
| AGG | R | 0.146 | 6.448 | 7886 |
| CGA | R | 0.074 | 3.275 | 4005 |
| CGC | R | 0.253 | 11.173 | 13664 |
| CGG | R | 0.194 | 8.538 | 10441 |
| CGT | R | 0.114 | 5.044 | 6168 |
| AGC | S | 0.263 | 15.893 | 19436 |
| AGT | S | 0.063 | 3.820 | 4672 |
| TCA | S | 0.202 | 12.173 | 14887 |
| TCC | S | 0.154 | 9.287 | 11357 |
| TCG | S | 0.171 | 10.289 | 12583 |
| TCT | S | 0.147 | 8.865 | 10841 |
| ACA | T | 0.327 | 16.969 | 20752 |
| ACC | T | 0.188 | 9.765 | 11942 |
| ACG | T | 0.373 | 19.404 | 23730 |
| ACT | T | 0.112 | 5.833 | 7134 |
| GTA | V | 0.144 | 9.710 | 11875 |
| GTC | V | 0.361 | 24.342 | 29769 |
| GTG | V | 0.238 | 16.042 | 19619 |
| GTT | V | 0.257 | 17.354 | 21223 |

TABLE 4-continued

Codon Usage Table for Chromosome

| # Codon | Amino acid | Fract | /1000 | Number |
|---|---|---|---|---|
| TGG | W | 1.000 | 10.303 | 12600 |
| TAC | Y | 0.398 | 13.468 | 16471 |
| TAT | Y | 0.602 | 20.348 | 24885 |
| TAA | * | 0.551 | 1.962 | 2400 |
| TAG | * | 0.157 | 0.558 | 682 |
| TGA | * | 0.292 | 1.041 | 1273 |

TABLE 5

Signal Peptide Codon Usage Table

| Codon | Amino acid | Fract | /1000 | Number |
|---|---|---|---|---|
| GCA | A | 0.294 | 42.315 | 106 |
| GCC | A | 0.219 | 31.537 | 79 |
| GCG | A | 0.242 | 34.731 | 87 |
| GCT | A | 0.244 | 35.13 | 88 |
| TGC | C | 0.543 | 9.98 | 25 |
| TGT | C | 0.457 | 8.383 | 21 |
| GAC | D | 0.231 | 2.395 | 6 |
| GAT | D | 0.769 | 7.984 | 20 |
| GAA | E | 0.784 | 15.968 | 40 |
| GAG | E | 0.216 | 4.391 | 11 |
| TTC | F | 0.335 | 21.956 | 55 |
| TTT | F | 0.665 | 43.513 | 109 |
| GGA | G | 0.341 | 22.355 | 56 |
| GGC | G | 0.262 | 17.166 | 43 |
| GGG | G | 0.183 | 11.976 | 30 |
| GGT | G | 0.213 | 13.972 | 35 |
| CAC | H | 0.316 | 2.395 | 6 |
| CAT | H | 0.684 | 5.19 | 13 |
| ATA | I | 0.142 | 9.98 | 25 |
| ATC | I | 0.466 | 32.735 | 82 |
| ATT | I | 0.392 | 27.545 | 69 |
| AAA | K | 0.767 | 61.876 | 155 |
| AAG | K | 0.233 | 18.762 | 47 |
| CTA | L | 0.05 | 7.186 | 18 |
| CTC | L | 0.098 | 13.972 | 35 |
| CTG | L | 0.235 | 33.533 | 84 |
| CTT | L | 0.16 | 22.754 | 57 |
| TTA | L | 0.221 | 31.537 | 79 |
| TTG | L | 0.235 | 33.533 | 84 |
| ATG | M | 1 | 51.497 | 129 |
| AAC | N | 0.482 | 10.778 | 27 |
| AAT | N | 0.518 | 11.577 | 29 |
| CCA | P | 0.164 | 4.79 | 12 |
| CCC | P | 0.192 | 5.589 | 14 |
| CCG | P | 0.452 | 13.174 | 33 |
| CCT | P | 0.192 | 5.589 | 14 |
| CAA | Q | 0.475 | 11.577 | 29 |
| CAG | Q | 0.525 | 12.774 | 32 |
| AGA | R | 0.333 | 9.98 | 25 |
| AGG | R | 0.08 | 2.395 | 6 |
| CGA | R | 0.107 | 3.194 | 8 |
| CGC | R | 0.16 | 4.79 | 12 |
| CGG | R | 0.173 | 5.19 | 13 |
| CGT | R | 0.147 | 4.391 | 11 |
| AGC | S | 0.171 | 14.77 | 37 |
| AGT | S | 0.093 | 7.984 | 20 |
| TCA | S | 0.241 | 20.758 | 52 |
| TCC | S | 0.148 | 12.774 | 32 |
| TCG | S | 0.134 | 11.577 | 29 |
| TCT | S | 0.213 | 18.363 | 46 |
| ACA | T | 0.262 | 11.178 | 28 |
| ACC | T | 0.234 | 9.98 | 25 |
| ACG | T | 0.327 | 13.972 | 35 |
| ACT | T | 0.178 | 7.585 | 19 |
| GTA | V | 0.216 | 14.371 | 36 |
| GTC | V | 0.186 | 12.375 | 31 |
| GTG | V | 0.335 | 22.355 | 56 |
| GTT | V | 0.263 | 17.565 | 44 |
| TGG | W | 1 | 7.585 | 19 |

TABLE 5-continued

Signal Peptide Codon Usage Table

| Codon | Amino acid | Fract | /1000 | Number |
|---|---|---|---|---|
| TAC | Y | 0.405 | 5.988 | 15 |
| TAT | Y | 0.595 | 8.782 | 22 |
| TAA | * | 0 | 0 | 0 |
| TAG | * | 0 | 0 | 0 |
| TGA | * | 0 | 0 | 0 |

Example 6

Identification of Genes Induced by Glucose Limitation Using DNA Microarrays

*Bacillus licheniformis* ATCC 14580 was grown in duplicate shake flasks containing 100 ml of Spizizen I medium (Anagnostopoulos and Spizizen, 1961, *Journal of Bacteriology* 81: 741-746). The inocula for the shake flasks were obtained from 10 ml of mid-log cells (approximately 80-90 Klett units) and a 0 hour total RNA sample was extracted from 30 ml of the mid-log cells, as described below. Total cellular RNA was also purified from 10 ml of the Spizizen I shake flasks that were sampled at 2, 4, 6 and 8 hours post inoculum. All of the cell samples were mixed with two volumes of RNAProtect RNA stabilizing reagent (QIAGEN, Inc., Valencia, Calif.) for 5 minutes. The cells were subsequently pelleted at 2800×g, 4° C. for 10 minutes, the supernatant was discarded, the cell pellets were frozen at −80° C., and cellular RNA was purified using a FastRNA Pro Blue kit (QBiogene, Carlsbad, Calif.) using the protocol supplied by the manufacturer. The frozen cell pellets from each sample were resuspended in 2 ml of RNAPro solution provided in the FastRNA Pro Blue kit and RNA was obtained from two lysis matrix B vials.

Sixteen replicate cDNA targets for the 0 time point and two technical replicate cDNA targets for each of the rest of the time points were prepared and hybridized to *Bacillus licheniformis* DNA microarrays prepared as described by Berka et al., 2002, *Molecular Microbiology* 43: 1331-1345. Dye swap hybridizations using the zero time point as reference were prepared as described in Hu et al. [In G. Parmigiani, E. S. Garrett, R. A Irizarry, and S. L Zeger (eds.) The Analysis of Gene Expression Data, pp. 318-319, Springer-Verlag, New York (2003)].

The arrays were scanned with an Axon 4000B scanner and formatted for analysis with GenePix Pro version 5.0 (Axon Instruments, Inc. Redwood City, Calif.). The fluorescence intensity data from GenePix was imported directly into S-Plus ArrayAnalyzer version 2 software (Insightful Corporation, Seattle, Wash.) for statistical analysis. The raw intensity data were normalized using the lowess (locally weighted regression) function provided in S-Plus ArrayAnalyzer software, and the genes that were differentially expressed at each time point relative to the time zero reference were identified by employing a multiple comparison t-test with Bonferroni correction as outlined in the user's guide to S-Plus ArrayAnalyzer software (Insightful Corp., Seattle, Wash.). The family-wise error rate (FWER) was set at 0.1. The list of genes at each time point that passed these statistical criteria were used to query a pathway-genome database established using Pathway Tools Suite software (Karp et al., 2002, *Bioinformatics* 18 suppl. 1: S225-S232), and the gene expression profiles were painted onto a schematic of metabolic pathways. In doing so, those pathways that were significantly altered at each time point were identified.

As a result of this analysis the following observations were made: (1) Early in the cultures, genes encoding enzymes of the glycolytic pathway were slightly induced reflecting the change from partially depleted glucose levels in the inoculum culture to ample glucose in the shake flask medium; (2) As glucose was progressively depleted in the shake flask culture (times 6 and 8 hours), genes encoding glycolytic pathway enzymes were down-regulated; (3) genes that encode enzymes for phenylalanine, tryptophan, histidine, and arginine biosynthetic pathways were up-regulated during stationary phase suggesting that cells had exhausted critical amino acids, and they were turning on the genes for pathways to synthesize more of these essential nutrients; (4) as cells entered stationary phase, cell division, DNA replication, and ribosome production all decreased to a low level. This was reflected in the shut-down of purine and pyrimidine biosynthetic pathways and down-regulation of genes encoding many ribosomal proteins.

SEQUENCE LISTINGS

Incorporated herein by reference are 2 copies of the Sequence Listing on compact disk. Copy 1 is done on a Intel x86 machine format, in Windows XP operating system compatibility, there is one file saved as 10588.200, and is 19,455 kb, and created on Nov. 4, 2004. Copy 2 is identical to Copy 1. The content of the attached compact disks are the same and includes no new matter.

The invention described and claimed herein is not to be limited in scope by the specific aspects herein disclosed, since these aspects are intended as illustrations of several aspects of the invention. Any equivalent aspects are intended to be within the scope of this invention. Indeed, various modifications of the invention in addition to those shown and described herein will become apparent to those skilled in the art from the foregoing description. Such modifications are also intended to fall within the scope of the appended claims. In the case of conflict, the present disclosure including definitions will control.

Various references are cited herein, the disclosures of which are incorporated by reference in their entireties.

SEQUENCE LISTINGS

This application contains 2 copies of the Sequence Listing on compact disk, which are incorporated herein by reference. Copy 1 is done on an Intel x86 machine format, in Windows XP operating system compatibility, there is one file saved as 10588200 SQ, and is 19,445 kb bytes, and created on May 3, 2005. Copy 2 is identical to Copy 1.

SEQUENCE LISTING (8395 sequences)

SEQ ID NO: 1 - DNA, 4222334 bp, Bacillus licheniformis (residues 1-2,111,167 of 4,222,334)
cgaaagcctaatttcatttttcctcaattttagcttaaaagatttttttggaagcgggaaaacgggatggacgaagcgaaaaaaagccaatgtggatatctttctcctcgttttttctatccacaatcattatcgacaacattttcacaaaactaaccgttgtggacaatatttcttcaacagtttgtatagtatgtggataagttcctcgcaaccattgcaaccactcgcttattctgatattatatttgtgttttaactcttgataacaaattggctgccaatccattatccacaaactgtggataagttgtggagagttttttcacagggtgtgcagtattttgtccacatcttgtgaaaaatgtcgaaaagacgtttttctactatattatatgttttcaacatttcattaacgaatggactcatccatttgctctttttttgtgttctataacaggttggacaagcaaatattgctggtaaaggagggacgaaccgccattatgaaaaacatatcggatctttggaatcaagctttggggcagatcgaaaaaaaattgagcaagcccagctttgaaacatggatgaaatcgacaaaggcccattcattgcagggcgatacgctgatcatcaccgcaccgaacgagttcgccagagactggcttgaatcaagatacctgcacctgatcgccgatacgatctatgatctgacaggagaagaattgagcattaaatttgtcattcctcagaatcaaaatgaagaagattttatgccaaagtctccaatcaaaaaaatgtcgaaagaagaaccggctgattttccgcaaaacatgctgaatcccaaatatacatttgatacgttcgttatcggttcaggaaaccgattcgcccacgcagcgtctttggcagtggctgaagccccggcgaaagcttacaatccgctgtttatttacgggggagtcggacttggaaagactcacttaatgcatgcgatcgggcactatgtcatcgatcacaatccatctgcaaaagtggtttatttgtcatctgagaaatttacaaatgagttcattaactcgatccgtgacaataaagctgtcgattttcgcaatcgctatcgaaatgttgacgttcttttaatagacgatattcaatttttagccggaaaagaacagacgcaagaggaatttttccatacgtttaatacgctgcatgaagaaacaaagcagattgtcatttccagcgaccggcctccaaaagagatcccaacgcttgaagaccgtttgcgctcccgttttgaatggggattgatcactgacatcacgcctcctgatctggaaacaagaattgcgattttaagaaagaaagcaaaagcagaaggacttgatatcccgaatgaagtcatgctttatattgccaatcagatcgacagcaatatcagggagctggaaggggcattaatcagggttgtcgcatattcttccttgatcaataaagacattaacgccgatctggctgctgaagctttgaaagatatcattccttcttcaaagccgaaagtcattacgatcaaagacatccaaagaatcgtcggccagcagtttaatatcaagctggaggatttcaaggcgaagaaacggacaaaatcggtggcttttccgcggcagatcgctatgtatctatcaagagaaatgacagattcttctcttccgaagatcggcgaagaatttggcggacgcgaccacacgacggtcatccatgcccatgagaaaatatcaaaactgctgagcgatgatgaacagcttcagcagcagattaaagaaattaaagagcagctgagataagtgatgagcgggaaagtgtgaataacttgaacatggccttacacagtctgtccacatgtggataggctgtgtttccgttcttttttacacttatccacaaatccacagcccctactagtacttctgctatttttataaaacataataattaatagattcccgcaaggaggatgattatgaagtttacaattcaaaaagaccgcctggtcgaaagtgtccaagatgtgttaaaagccgtttcttcaagaacgacgattccgatcttaaccggtattaaaatcgtggcctctgatgaaggggtctctctgacaggcagcgattccgatatttcgattgaatcgtttatcccgaaagaagacggcgatttagagatcgtgacaattgaacagcccggcagcattgtgcttcaagcccgttttttcagtgaaattgtcaaaaagctgccgatgtcaacagtggaaatcgaggttcaaaatcaatacttaacgatcatccgctccggcaaagcagagtttaacttaaacggtttggatgcaagcgaatatccgcttttgccgcaaattgaagagcatcacgcttttcaaattccgaccgatctgctgaaaaacctgatccgccaaaccgtttttgcagtgtccacctcagaaacacgcccaatcttgacaggtgtaaactggaatgtcactggcggtgaattaatatgcactgcaacggatagtcatcgtcttgcgctaaggaaagctaagctcgacattaacgaagacagttcatacaatgtcgtcatcccaggaaaaagcttaaccgagctcagcaaaatccttgatgaccatcaggagcttgttgatattgtgattaccgaaacacaagtgctgtttaaaacaaaaaacgttctgtttttctccaggcttcttgacggaaactatccggatacgaaccgcctgattcctcaggaaagcaaaacgaacttgattgtcaatactaaggaatttctccaggcgatcgacagggcttcgcttttggcgagagaaggacgaaacaacgtggtgaaactttccgcagccgccaatgagtcgatcgaaatttcttcaaactctccggaaatcggaaaggttgttgaaacggtgaatgccgagcagatcgaaggggaagacttaaagatatcctttagtccgaaatatatgctggatgcccttaaagttcttgaaggagaggacattcatgtaagcttcacaggcgctatgaggccttttctgatccgtacgccgaatgacgattcgatcgtccaattaattcttcctgtccggacgtattaatttgttggaatagaaagttgccggctggtccggcagcttctcttattttttctggagaaaagcgctctcgccctgccttgattgctcataccgcaagtttcccctttccttctttccctgttttttagtacaattagatattagtgatattgaaagaggtcgatataatgacaaagacggtggctattgatacagagatgattaccctcggccagtttttgaaattggcggatgtcattcagtccggaggaatggcaaaatggtttttatcggaatatgaagtactcgtcaatgacgagccggataaccgccgcggacgaaactgtatgtcggagatgtggtgacgattgaaggattcggttcatttcaagtcgtcggctaaaagcaggtggtattgattgtatatccaaaatcttacattatcgtcttaccgtaattatgagcgccttgaccttcaatttgagaacaaagtgaacgtgattatcggagagaacgctcaaggaaaaacaaatttgatggaagcgatctatgtgcttgcgatggcgaaatcccatcggacgtcaaatgataaagaactcatacgatgggatgaagactatgctaaaatagaaggcagggtcattaaaaaaaacggttctgttcccattcagcttgtgatttccaaaaaaggaaaaaaaggtaaagtgaatcatattgaacagcagaagctgagccagtatgtcggggctgtcaacacgattatgttcgcgccggaggatttaaatctcgtaaaaggaagtcctcaggtcagaagaaggtttctcgacatggaaatcggccaagtatcacctgtctatcttcatgacctttctctttaccaaaaaatcctttcacaacggaatcatttcttgaagcagcttcaaacgagaaagcaaaccgatcaaacgatgcttgacgtgctgacggaacagcttacggaattcgcggcaaaggttgtgatgaaacggcttcagtttgtcgatcagcttgaaaaatgggctcagcccattcattccggaatttcaagaggtctggaagagctgacgttaaagtatcatacgtctcttcacgtatcagattcgcccgatttgtcgaaaatgatcaatagttatcaagaaacgttttctaaattaagagataaagaaatagaacggggggtatctctttcaggtccccacagggatgatgttcttttctatgtcaatggccgtgatgtgcagacttacggatcgcagggccagcagcgcacgactgcattgtcgcttaaattggctgaaatcgacttgattcaggaagagataggagaatacccgattctgcttttggatgatgttttatcagagctggacgactatcggcagtctcacttgctccacaccattcaaggccgcgttcaaacattcgtaacaacgacaagcgttgatggaattgatcataaaaccttaaacgaagcggaaatctttcgtgttgaaaatggcacgctatcggactgaaaaaatggggtgagggattgtatatccacttaggtgacgattttgtcgtctcaacgcgtgaaattgtggctatttttgattacaaggcaaagacatcgccgattgttgaggagtttttaagcaagcaaaaacagcggattgtctcttctaacagcacgccgaagtcaattgttgtcacattacaatcgatttatttttctcctttagcctcaggcacgttgaaaaaacgggcgcaatccaagccggaaatcgattcataaagaatcttaactataaatttattatgtttgaagaaaagtgtaggtgaatgtgcgtggcaatggaacagcaaaataattacgatgaaaatcagatacaggttctagagggattggaagccgttcggaaaagacccggaatgtacatcgggtcgacaagcggcaaaggtctgcaccatttagtatgggaaattgtcgataacagcatcgatgaagcattggccggttactgcactgaaatcaatgtcgcaattgaaaaagacaacagcatcacagtaaaagacaacggacggggtatcccggtcggtattcatgagaagatgggtcgtcccgctgtggaagtcatcatgactgtcctgcacgccggaggaaagtttgacggaagcggatataaagtttcgggcggtttgcacggcgtcggtgcttctgttgttaacgccctttcaaccgagctggatgtaacggtttacagagatggaaaaatccattatcaggaatttgaacgtggcgttccgaaagctgatttgaaagtcattggagatacggaagtgacgggaacgaccacacacttcaagcctgatccggaaatattcacggaaacgactgaatacgactatgatacgctcgccactcgtgtccgcgaactcgctttcttgacaaaaggcgtcaaaatcacgatcgaagacaagcgagaaggaaaagaacgcaagaatgaatactgctatgaaggcggtattaaaagctatgttgaacacttgaaccgttcgcgggaagttattcatgaagagccggtctatattgaaggatccaaagacggcattacagtcgaggtggctcttcaatacaatgacagctatacaagcaacatttattcatttgctaacaacattcatacgtatgaaggcggaacccatgaagccggctttaagaccggtttgacgagggtcatcaatgattacgcgagaagaaacggcgtattcaaagaaagcgatccgaacttaagcggagaagacgtccgggaaggtttgacagcgattatttcaatcaagcacccggatcctcaatttgaagggcagacgaaaacaaagctcggcaactcagaagcgcgtacgataacagatgcgctattttcagaagcgcttgaaaagtttctgctagaaaacccggattcagcgaaaaaaatcgttgaaaaaggggttatggccgccagagcacggatggctgcaaagaaagcacgcgaattgacgcgcagaaaaagcgcccttgaagtgtccaatctgccggggaaacttgctgactgttcttctaaagacccgacgatttccgaactttacatcgttgagggtgactctgcgggcggatcggcaaaacagggccgcgaccgtcatttccaagcaattttgcctttgagagggaaaattttgaacgtcgaaaaagcccgcctggacaaaatattgtccaacaatgaggttcgttctatgatcaccgcccttggcaccggaatcggggaagatttcaaccttgaaaaagcccgctaccacaaagtcgtgattatgacggatgccgacgtcgatggtgcacacatcagaacattgctgctgacctttttctaccgctacatgagacagattatcgaacaaggatatgtctacatcgctcagccgcctctttacaaagtacagcaggggaaacgcgttgagtatgcgtacaatgaccagcagctcgaagaaattttaaaagagcttccgcaaaatcctaagccaggcctgcagcgctacaaaggtttgggcgagatgaatgcgacacagctttgggaaacgacgatggatccagaaacgcggacattgcttcaagtaacgctcaaagatgcgattgatgcggatgaaacctttgaaatgctgatgggcgacaaggttgaaccgcgccgcaacttcatcgaagagaatgcccgatatgtaaagaatttggatatttaatgattgtaagaccttattttcgcttaattgaaataaggtcttttctagaatgagcctttggcgctctagtcatttgatgtgtataaaatcaagattattgatataatggagaatagcctaattcgttgaagagtataaatacaaatctactcccacacaactcatgtagattctccagggaggttttttaatgagtgaacaacataagccccaagttcaggaagtcaatatcagtcaggaaatgcgcacatcttttttagattacgcaatgagtgttattgtttcccgcgctcttccggacgtaagagacggtctgaagccggtgcacagaagaatattgtatgcgatgaacgaccttgggatgacaagtgataagccgtataaaaaatccgcgcgtattgtcggcgaagttatcggtaagtaccaccctcacggtgattctgctgtttacgaagccatggtcagaatggcgcaggattttaactatcggtacatgctcgttcaaggccatggaaacttcggttctgttgacggcgactcggctgcggccatgcgttacacagaagcgagaatgtctaaaatatcaatggaaattctgcgcgacatcaataaagacacaatcgattaccaggacaactatgacggttcggaaaaagagccggttgttatgcctgcgagatttccgaacttgcttgtcaacggagcggccggtattgctgtaggtatggccacaaacatcccgccgcatcagctcggtgaagtcattgacggtgttttggcggtcagcaaaaaccctgatatcacgcttccggaattgatggagatcattcctggacccgacttccctacagcagggctgatcttgggaagaagcggtatccgaaaggcctatgaaacaggccggggatcaattacgcttcgagccaaagctcaaatcgaagaaacatcttccggcaaaccggtaatcattattacggaaataccgtaccaagtgaataaagcaaggctgatcgaaaaaatcgccgatctagtgcgcgataagaaaatcgacggcattacggatctccgcgatgaatcagaccgaaacggaatgcgcatcgtcattgaactgagaagggatgcaaatgccaatgtactgttaaataacttgtacaagcagaccgctcttcaaacatcattcggcattaatcttttggcgcttgttgacggccagccgaaagtattgagcttgaagcagtgtctggagcattatctcgaccatcaaaaagtcgtgatcagaaggcgtactgcattcgagcttcgcaaagcggaagcgcgggcccatattcttgagggcttgagagtggcgcttgatcaccttgatgaagttatttccctaattagaaattcgcaaacggctgaaatcgcaaaaaacggattgattgagaagttttctttgactgaaaaacaggcccaggcgattttggacatgcgtctccagcgtttaacagggctggaacgcgaaaaaatcgaagaggaatatcaaagccttgttgagctgattgcagagctaaaagcaatcttagcagacgaagagaaagttcttgaaatcattcgggaagagctcacagaagttaaagagcgctttaatgatgagcgccgtactgaaatcgtgacatcgggccttgagacgattgaggatgaagatctcatcacgcgcgagaatatcgttgtgactttaactcataacggatatatcaaacgtctgccttcttccacttaccgcagccaaaaacggggcgggaaaggcattcagggcatgggtacaaatgaagacgacttcgttgaacacctgatttcaacatccacccatgacaccattctcttcttctcgaataaagggaaggtgtaccgtgcgaaaggatatgagatccctgaattcggacggacagcgaagggaattccgattattaacctgcttgaagtggaaaaaggagaatggatcaacgcgattattccggtaggcgaatttgatgacgagtcttatttgttcttcacgacaaaacacggaatatcaaaacgcacaccgctttctcaattcgcgaatatccgcaataatggattgatcgccttaagcctccgcgatgaggatgaattgatcgctgtccgcctgacggatggaaataaacaaattattatcggcacgaagaacggtctgctcatccgtttccctgaaacagatgtaaggcaaatgggaagaacagcagccggcgttaagggcatcaatctgacagatgacgatgttgttgtcggcatggagattttggaagaggattcacacgtgctaatcgtaactgaaaagggctacggaaaactgacgcccgcttcagaatacagggtgcaaagccgcggaggaaaagggctgaaaacctgcaaaatcacagaaaataacggatctcttgtgacagtgaaagcaacgacaggagaagaagatttaatgatcatcacagcaagcggcgtgatcattcggatggatattaaagatatctccacgaccggacgcgtcactcaaggtgtgcgacttatccgcttaggtgaacaagagcatgtcgcgactgtcgctttagttgaaaaagatgaagagaacgattcagaagaacaggaagcggatgaatcataaaaacatgcagccaaatggctgcatgtttttctattcaatctttcaaatataatcttttcatcaggaacataatgtgctataatttctcttggtcgcttataaaagcaacaacaaaaactttttttaaaaaagtattgaccgcttgtcttataaatgttatatttaagtggtcgctttgagagcggcagcgaagttctttgaaaactaaacaagacaaaacgtacctgttaattcattataaatcgcacatgtaagtgtgcgtagtcaggggcctgcacgatgcaggtcatgcagatgttgtcacaggatgtgacgaacttaatctgcgctccattatttcatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttcaatcataaaaggtggcttttagctaccacttgcagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctggcaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaaggatattatacggaatataagaccttgcggtcttatagacaggtgcgtttggatcttgtttagttttgaaggaacttccttcatatgaatcaaaagatgggcctgtagctcagctggttagagcgcacgcctgataagcgtgaggtcggtggttcgagtccactcaggcccaccatctttatacacggggccttagctcagctgggagagcgcctgctttgcacgcatgaggtcagcggttcgatcccgctaggctccaccaacgtgttctttgaaaactagataacgaaagtagacattcacaagaattttctgtagtgattctttttaacggtttaagttataaagggcgcacggtggatgccttggcactaggagccgatgaaggacgggacgaacaccgatatgcttcggggagctgtaagcaagctttgatccggagatttccgaatggggaaacccactgctcgtaatggagcagtatccatatctgaattcataggatatgagaaggcagacccggggaactgaaacatctaagtacccggaggaagagaaagcaaatgcgattccctgagtagcggcgagcgaaacgggaacagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagtttgaaaagacggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaaagacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttgcgaacagtggtaggagagcgttctaagggctgtgaagcgagaccggaaggactcgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggcaagcgcggtattggatatccgcgtccaagcagttaggctgggaaataggcaaatccgtttcccgtaaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgcaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcggggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgctgcccttatcgggcagggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattcctataaggaagtaagatccctgaaagatgatcaggttgataggtctgaggtggaagtgtggcgacacatggagctgacagatactaatcgatcgaggacttaacctaaatatttgtgaatcgtctgtccgttatctagttttgagagaatgctctcagaaagccaaaggcaaggaaactcggctaaaggccctcacatcctgtgaggaacgcccagtaccttcgtcctgaaggcatagtttggtggcgatagcgaagaggtcacacccgttcccatgccgaacacggaagttaagctcttcagcgccgatggtagttgggggcttccccctgtgagagtaggacgccgccaagcgctaagaggaccagcttatataagctggtcttttttgttgttttctttttttcgaataagcaattcagcgatataataagggaactttgactcgactatatgtaaaaactgttggatgatgacataatcatcgctggcactttgaagaagaaggtcataccaccattgtgtttcatacctggcaatcatgcttacattgtaagcaaccaagtaatgcaccaatatttccgggagctttaaaaagcgatcccgttcagccggaaaataatatgcgccatgttccaaatcataaagcaaggtagtcgaagtgctgggacggcattctttttgagcggcggaaaaaatgatcccctctttttcttcacggcagaaagaccagtttaaatggtattcgacatgttcgatgaaacgctttgacgacatattgtaagcatcgggcgtctcgcttggcagccaaatgagccggtcttcgacggctgcttttactattggattcggttttctttgaaatgccagtactttattgatctccggaattctcgccaaaagctgcttcatattgaatcgttcatcttccaatccggataattggaaaagggacctgatgacgtgcatacataggccgttcctttggatttttacttcatcttcataaaagcggtaattttgtttttttcgttttctagtggtcacgccatgggcgagcactgaagtatggcttggataggaaggatctgtcattaacaggcaggctttcaatagctgtgccatgccgtaaaataataaaatcggtttgatttccaacgtagcgattttggcttgcttgtaaaaggcttccgcatgtttaagaaaaaaaataaaccgctctccgtttttataggaattttttttggcatcttccattccttgatttttatataccatttcaagaaaatgctgggctgtttcgaccgaataaaatagctttaaatccttccatcctttatcttgcatggactccacttcccttatggttattttctaaaaattacaactgtttctcgctttcttgacagtgggtattcaagttgataatctacatataatattttgccgaaaagagggggatttactaatgtgggaaagcaaattttcaaaagaaggcttaacatttgatgatgtattgctcgttccggctaaatcggaggtacttccgcgcgacgtcgatttatcggtagagcttacaccgtctctcaagctgaatgttccaattattagtgcaggcatggatacagttacagaagctcaaatggccatcgcgatggcaaggcagggcggactgggtattatccacaaaaacatgtcaattgaacagcaggctgagcaggttgacaaagtcaaacgttcagagcgcggcgtcattacaaatccgtttttcctgacaccagagcaccaagtttttgatgcagagcatttgatgggcaaatacagaatttccggtgttccgattgttgacaatgaagaggatcagaagctggttggaatcattacaaaccgtgatctgcgatttatttctgattactccatgaaaatcagcgatgttatgacaaaagaagagcttgttacggctcctgttggtacaaccctggatgaagcagaaaaaattcttcaaaaatacaagatcgaaaaactccctcttttagatgatcaaggtgttttaaaagggctaattacgattaaagacattgaaaaagtaatcgaattcccgaattcagcgaaagatgttcacggccgcctattggttggagcagcggttggtgtaacaggcgacacaatgacacgcgtcagaaagcttgtggaagccaatgtcgatgtgatcgtcgttgataccgcgcacggccattcacaaggagtattggataccgttaagaaaatccgcgacacttatcctgaattaaatatcattgccggtaacgtcgcaactgccgaaggaacaaaagcgcttatcgaagctggagcaaatgtagttaaagtcggtatcggaccggggtcaatttgtacaacccgcgtagtagccggtgtcggtgttccgcaagtgacagcgatttacgattgtgcgactgaagcaagaaaacacggcgctgcgattattgcagacggcggcatcaagtattccggagatattgtcaaagccttggctgccggcggtcatgccgtcatgctaggaagccttcttgccggaacatctgaaagcccgggcgagactgaaatctatcaaggcagacgctttaaagtttatcgcggcatgggttctgtagctgcgatggaaaaaggaagcaaagaccgctacttccaagaggaaaacaaaaaattcgttcctgaaggcattgaaggccgtacgccttataaaggccctgttgctgataccgtttatcagcttgtcggcggcttgaaatccggcatgggctactgcggaacgaaagatttgcacgcattgagggaagatgcgcagttcatccgcatgacaggagcaggcctgcgggaaagccatcctcacgatgtgcaaattaccaaagaatcgcctaactataccatttcctaatcaaatatgacaaaaattaaaccgtagacagagtgatactctgtctatttttttttgcttcattatgataaaatttataatgttgtgtttgaaaaatgtcttaaaaggctttgatatagattattagtctgatgaaaagcggaggtatcacgatttgaaaagcaagagattaaagcagctgatcatgttaatcgttgcttttgccgtgactgtaggtgcattttctcctatgtcaactgcaaaagctgcaaatgatccaatcaatgtagacgcgaaagcagcaatcctggtggaagcttcatcggggaaaattttgtacagtaaaaatgccgaccagcgtcttcctgttgccagcatggcaaaaatgatgacggagtatcttctgttggaagcgattcacgaaggcaaagtgaaatgggatcagaagtacacgcctgacgattatgtatacgagatttcccaagatcgttcactatccaatgttcctcttcgtaaagacggatcatacactgtaaaagagctttatcaggcgactgcaatttactctgcaaacgcggcggctattgcactttctgaaattgttgccggttctgaatcgaagtttgtagagttaatgaacaaaaaagccaaagagcttggaatgaaagatttcaaatttgtgaatgccacaggtttggaaaacaaggatcttcacggcaaacatccgagcggaacaaatgccaatgaagaaaatgaagtgtctgcgagagacatggcgctccttgccgatcatttagtgagcgattatccagagatcctcgatacggcgagcattgccaaaacgaagttcagaaaaggcacagacgatgaaatggatatgccgaactggaactttatgctgaaaggccttgttcagcaatatgaaggtgtggacgggctgaaaaccgggtcaaccgactcagccggatcatgctttacggctactgctgaaagaaacggcatgagagtgatttccgtcgttctgaatgcgaaaggcgaccttcatacggcgcgatttaaagaaacgaaaaaaatgctcgattatgcatttgaaaacttcactatgaaagagttttacgcaaaaggcgcacaagtgaaaggcaacgaaacagtcacagtcgacaaagggaaagaaactgaagtcggcatcgtcacagaaaaagccttttcaatgcctgtgaagaacggtgaagaaaagaattacaaagcgaaagtgacgctgaacaaagacgagctgaccgcacctgttaaaaaaggtgagaaagtcggtaccttgacggcctcctataagggagaagaaaaggactacggatttctcggcagcgatgtatcaggtgtaaacctggtgacaaaagaagatgatgagaaagcaaactggtttattttaacgatgagaagcatcggcggcttttttgccggtatatggaacagcattgttgaaatggtaaccggctggttttaaaaaataaagagctctatttgatagggctctttattgtcatattcagatagaattaccatttacaatcctaacgatttgttattaaaatagaaataatcttcgtgtttttcatatgattttgtggaattataggatacaataggattaaatctgacaattcaatctttgattagggggatccttgaaatggctcaaacaggtactgatcgcgtaaaacgcggtatggcagaaatgcagaagggcggcgtcattatggacgttgtcaatgctgaacaagcaaaaatcgcagaagaagcaggagccgtcgcagtcatggcgctggagcgcgttccggctgatatccgtgcggcaggcggagttgcccgcatggcagatccgactattgtcgaagaagtgatgaacgctgtttcaatcccggttatggcaaaagcacgcatcgggcatatcgttgaagcgcgtgttcttgaagcgcttggcgttgactatattgatgaaagtgaagttttgactcctgcagatgaagaatttcatttaaataaaaacgaatttaccgttccatttgtatgcggatgccgcgacctaggagaagcgacgcgccggatcgctgaaggagcttcaatgcttcgtacaaaaggcgaacctggtacgggcaatattgtggaagctgtccgccatatgagaaaggtgaatgctcaagtgcgcaaagtagtcggcatgagcgatgacgaactgatgacagaagcgaaaaacctcggcgctccttatgagctgctgaaggaaattaaagccgaaggacgccttccggttgtcaactttgctgccggcggtgtagcaacacctgctgatgctgctctaatgatgcagcttggcgctgacggcgtattcgtagggtccggtattttcaaatccgacaaccctgcaaaattcgcgaaagcaatcgtagaagcgacgacgcatttcacggattacaagctgattgccgagctttcaaaagagcttggaactgcgatgaaagggattgaaatctcaaatctgctgccagaacagcgtatgcaagagcgcggctggtaaacacgaaggagacggattgacatgctgacaattggtgtacttggacttcagggagcagtaagagaacacattcgctcaattgaagcatgcggagcggccggaaaagtcatcaagtggccggaagagttaaaggaaatcgacggtttgattttgccaggaggcgaaagcacgacgatgaggcgcctcatcgatacgtatcagtttatgaagcctcttcaggaatttgccgcatccggaaagccggtatttggaacttgtgctgggctgattatcctggcgaagaacattgccggaactaacgatgcccatctcggggttctggatgtaacggtagagcggaattcctttggaagacaggtggacagctttgaagcagacttaaccgttaaaggacttgagggaccgtttacaggcgtatttatccgcgctccgcacattttggaagcgggcgcagatgtagaagtgctttcggaacacaacggaagaatcgtcgctgccaaacaaggaaatcttctcggctgttctttccaccctgagctgacggatgatcacagaatgacgaaattatttgtcgagatggtggaaaagcataaacgggaagccgtcgtataaaacggttgaaagctgttaaaacttgtagtacatttataagacaatatagatcgaaaagcgttgataggaagcagtagggagcctctctttccaagagagccgatggttggtgcgaatcggcgaaagatgctgtccgaatccatccttgagcgaattgctgaacagtcaaagtaggcatttacgggagaaccgttatcaaaataagcggaaagcaggaggtagacgcctgttttcaatcagggtggcaacgcgagagctctcgtcccttttatttaggggacaagggctctttttttcggtcaaatcagtataaaaggagcgaggcagatgcttgatgtcaaactgctgcgggcaaattttgaagaaatcaaacaaaagcttgcccacaggggagaagatttatcagattttgatcaatttgaggaattggatacaaagagaagagaattgatcgtcaaagtggaagagctgaaagggaagcgcaatgaggtatctcagcaggttgccgctttaaagcgcgagaaaaaagatgctgaccacctcattaaagaaatgcgcgaagtcggtgaagacattaaaaaacttgatgaagagctgagaacggtcgagtcttcgcttgataaaatcatgttgtctatcccgaacatcccccacgagtctgttccggtcggtgagactgaagacgacaacgtggaagttcgcaaatggggcgaactccctgagttttcgtttgagccgaagcctcattgggatattgccgatcaattggatattctcgattttgaacgggccggcaaggtaacgggaagccgtttcgttttctataaagggctcggcgccagacttgaacgcgcattgtataactttatgcttgatctccacgtagacgagtacggctatacggaagtcatcccgccgtacatggtgaaccgcgcaagcatgacaggcaccggacagctgccgaagtttgaggaagatgcttttaagatcagggaagaagattatttcttaattccgacggcggaagtgccgattacgaacctgcatcgcgatgaaattttgtcagctgacgagctgccgatcaattatgcggcgttcagtgcgtgcttccgttcagaagcaggctctgccggacgtgatacgcgcggtttgattcgccagcaccaatttaacaaggttgaactggtgaaatttgtgaagcctgaggattcatatgaagagcttgaaaaactgacaaatcaagcggagaaggttcttcagctgcttgagcttccttatcgggtgatgagcatgtgtacgggcgatctggggtttaccgctgcgaaaaaatacgatattgaagtatggattccaagccaaaacacatatcgcgaaatttcatcatgcagcaactttgaagctttccaggccagacgggcgaatatcagattcagaagggaagcaaaaggcaagccagagcatgtccatacgctaaacggatccggcttggcagtcggcagaacggttgccgcattattggaaaattatcagcaggaggacggaagcgtcatcatccctaaagcgcttcgtccatacatggggaacagagacgttattcaaccataaaaaagtgcgcgccaataggcgcgctttttttattcgagtgaccagacggcggctacatttcgcgcacagcgcgtaagatttgaacttccatcggcaagagcgttctccaaggagctgatgccgggcacgatcgaaaagagagcggaaatgccgatatcataaacaagctcgcagccttcaccgagcgatccggcaaatgcaataaccggaatattttcgctgcaggcgcgttttgcgacgccggccggcgtttttccgctgaccgtttggccgtctatttttccctcgcctgtaattacaagatcggcccctttaatgcgttcagaaaaagacaaagtatctaaaacaatgtcaacaccgctttttaattccgcttttaaaaaggcgcacaggccagctcccaatcctccggccgctccggctcccgggagtgaatcgatttcgcatcccagctctgctttgacagctgcagcataatgttttaagttttgatccaagtgggccgtcatttcactgttcgctcctttttgcggcccaaatacagcggaggcaccgcgaggacctgtaagaggattatcaacatcacaggcggcttcgaattggatatgctttaattttggatcaaggccgctcacatcgattttggcaatctcagctagtgcaccgcccccattttcaatctcttctccagcgcggtttagaaacttcacgccaagtgctgaagccattcccgcgccgccgtcatttgtcgcgcttccgccgagtccgatgatgatctgggacactcctttttccgcagcatccagaatcagctctccggttcctctcgttgtcgttaacaggggattccgctgttcaggtggaacgaggtgaaggcctgacgcttcagccatttcgatgacagccgtttttccgtcaccaagcaggccgtaagctgcctttacgggcttcccgagagggccagtgaccgtttgatatacaatatctcctccggtagcgtcaaccagagcctgaacggttccttcgcctccgtcggcaaccggaatattgacgtattcggcgtcaggcagaatctctttaaagcctttttcaatgcttctagccgcctcaagcgatgtcatgctttctttaaatgaatcaggtgcgattacgattttcatggtacctgctcctttttaaataaagaattgaaaaattccaaaaatcaaagtcgagataatcgttaggattaagccgatgaccgactcatatggaatcagctttaatcgttctttcatggccatgaatacgctgcctcccgtcgtatgaaaaaagcttccgtgaggcagatggtcgagcaccgttgctccggcgtgaatcatcgccgcacctgcgaggccggcgacgccaagatcaagcaatgtcgggccgaatacactgctggcgacagcggtgccggcggttgtcgaggcggttgccattgacatcagcatgcccgagattggagctaagagaaacgacggcagacccaagccgacaagggtgtcggtgattaaagaattgagtttggagttggcgatgatgcctgcaagggttccagttccgagcagcatcacggcaacgcctgacatctttgacagtcctgaagcggcaaaatccctcagtttgcctgcttgccccgatgcgatcgcagtgacgaggcctccagccggcagagcgataatcggatcaatcgtaattcctgccgcaggccttaaggcgagcaacaggatagagaccacagggccgctgaccgccgcccaaaatgccggcagttgttgtgccgtttgggtctcaatctcatttgcagctacttttgttcctttatttgaaaggcgttttgccagcaagtaagtggcgcccaatccgaaaatagcggggatgatcccggcggccatcacggatgtcaaagggacgtgaaaggcatctgaagcggcaatggcattagggtttggcgacatgatattgcccgcttttcccccgccgatcatcgccaacagaatggccgctttgctgataaaggtccgcctcgcgatcgccagagcgatcggagcgactgtgatgacggcgacatcaacgaatacgccgaccgttgttaagatggctgttgccaatgttaaggcaagaagcgcccttttttctccgatctgattgacaatggtttccgcaatcaccgctgcggagccggattgaatcagaacgccggcgagcacgcctgccgccaagatgcggagcaccgcgggaatcatgtttttagcacctgctatcatgagatccgtcgtctctattaaatctgcgccgccgattaagcctccggccaatgcgccgatcatcatgccgtaagccggcgggacttttttcagaatgagaaagattgatatgactaatgcgcataaggcgcctattgcattgatttgaatatccatgtgcataccctcccttacgtccaattgtaaacgctttctgtataagggagaattggtcaggtatacggatttcgtccttttatcctatattaaaattgttcatttgcacaaaagggtgaaaaaagagtaatggctgtatacagtttgaataggtcgtcaaaccgttttggattacaccccgttgccaattcaatctttctgagccggtagtttaaggtgttgcggtgaataaagagtcttgatgaagtttccccgatttcgccgttttcttctatgtagcagaggagggtatgagttaattcgcctttttgatctgcttgggaaaggcgatcccagatgttttgaaagtgaatctcctgatccggatgctctatttttgataataaaacaggaatcgcaaactctcgataatcgtataaactacaattgttttcagcaatcttgagcgtttgttttgcactttgataggaaaatggcagctgctgaagctggtcagcctgctcgccaagcgcgcctctgactgttttccattggctgagccagccgttccaagctgaaaagagatcagacctgcttttagtgggggcgcctgccagaataactgcgacctcttttaaagaaatattggcgtacaaatctttcgcggttaaatgcttttcaagttttttaataaacgccggcttcatatcagccgatgggagctcaaacacaagacaagtacgctggccgtcaagcggtatgtttaatcgctctgcacgttcaaagaagtcaagggatgctagatcagtcccctgaatcatttggatgaccgtttcttcgcggagcctttgatcccatgtcagctgttttgttaaaaatgcctgttcgactgttagctccgctgccattttgacaagttctccgtaacggctgacttcagaaggcggccccgtgattccaatgacgccgattatttcatcatgaaatacgatgggaaggtttacgccgggcttcgttcccgttaaagccgagcattcttcgggcgtgatgctgataaccttttcagctgcaagtgcgtccttcgctcctgcgtgttcatcaccgattctcgaacggtctcctgaagcgatgataaccccgttttcatccatcatattaatgttgtgccgaataatcgacatggttctttcgacaatttcctccgccaattcttttgataggtaattcatttcatcatgctcctgcctaagatcgttttttaaatggtgattgttccgtcgatccagccttttatgaatgattttaaagaaggtgcgacccatattcggctgtcgtctatatgattccaaacataaatatcatttttccgtatggagccgtttaaaatagaataagcaaataaatcgccattgcccgcacctgctataaagagcaaacaatcaaacggcttaaaacagtcggtacatctcatgtctagattctcttctattattctgtccgcaggccaaatgagatgatccccgaaagtatcattaatgccgtttgtcatttttaaaaggctgaccagttcatcaggaaaagagacgccgaggagttcttctgctttctgaagctttcctgtttcaataggtctgttcagcgtgtaatcttgaggcaaacggcttataaaatgtttccacaatgccatcaccctttgcgtttattattatttttgcatataatgagaagcgtgaacaataaaataaattttttataaaaaaatcccttgacttaaaaagataggacatgttatattaattcttgtcgatacggaggaatacccaagtctggctgaagggatcggtcttgaaaaccgacaggggtgtcaaagcccgcgggggttcgaatccctcttcctccgccattattgatttgcattttagtgattgaaaagcataaattggagattgtgttgccgctgcctggatagggcagcggtttttttatatgcagcaaaaagagcggctcttcaagggaatccgctctttttgcttgtttatctttgaatggcttcactgattttttcaatgattggatcgagagaggctgagttgttgaacaggtcgtattcatcaatattgactctgacaaccggacaggcgttaaatccgctgatccagttttcatacctagtgtacatttcttcccaatacgatctgtcggttaacagttccatttcccgtccgcgtttttggatgcggtcgagaatcgtttccaaatcgccctctaaatagactaaaacgtcggggcgggggaagtaaggcgtcatgaccatcgcttcaaacaggctcgtatacgtcttatagtcgacttttgacattgtgcctttatcggcgtgcattttggcgaaaatgcctgtatcttcataaattgaacggtcctgaacaaatccgccgcccgattcgtaaatgtatttttgttctttgaagcgctctgccaagaagaaaatctgcaggtgaaagctccagcgttcaaagtcttggtaaaaagcctccaaataagggttattcacgacctcttcaagagaggttttaaatccgagcctttttgcaagctcttttgtcaatgtggatttccccactcctaccgttcctgcaacagtaatgatagcatctttcggaatatcatatacactcattctatatactcctttacttgatcggcaattcgattgaaaacggcttctgagattacgaagtcttcctgatctccgttaatttcaatgacgggtattggcggatcggattctttaaattgcttaatggccgcctcataatcattgataagctgttccaggtattgcttgtccatttcttgttcaaacggccgtccgcgttttttgatccgttccaataaagttggaagactcgctcttatgtaaatgatgacgtttggtttcggcagatcttctgtaagcagctgataaatttttctgtatttctcaagttttttgccttccagcgtccgttcggcaaaaatgaggtttttataaatatgatagtccgaaacaacgggcatgtgatgatgcaaatactttttctcggtatcttcaagctgcttatagcgattgcagaggaaaaacatctcaagctgaaagctccattcatctttttcatcataaaatttatcaagaaaagggttttcttcgacgatttctttgaccaaagagagtgagagcttttcggagagcatgctggccaaggttgtttttcccgcgccgatggggccttcgacagcaatgaaaggggctgtattcataggtgtcctcctactaaagaaattcatttgtgaaccatacatattgtatcacatcatcatccgctgccatgaaaaaaaacgttcctttaacttgggaacgtctctttaacaacattaaattgatcggctatcaagagccagttttgcgggaaggacaggccgagcttccaatagctgattccccttaaattcaattccctaatcagatcaaactttgcctgaatcgagcgggcgtcttcaaaccatacttcatgctgtttgccggcattgtccgtatagcggaagtttggagcctgagctgtttcatcgtactgtatcgccgcattgttctcgctcgcgatctcaatcgcccgctgggggctgattgctctggccagcggtccgcctggcgtataggggagcgtccagtcatagccgtacaagttctgtcccatgacgattttgctggcgggcatttccgtgagtgcgtattcgatcacgtcccggacgggcccgatcggcgataccgccatcgggggccctccgctgtagccccactcatatgtcatcagcacgacgaaatcgacaatttcgccgtgggcccggtaatcatgggcttcataccattgtccgggctgatccgctctcgttttcggagcaagcgcggttgagatgagccagccttcctgcctgaagcgggcccgggcatcccgtaaaaactgattataggcttctctatcttcgggccttaagtattcgaagtcaaaatggatgtctttaaaaccgtatcttctggccgctgcaacgatgttatcgagcaatctgttttttacattctggtccgtcagaatgatcctgccgagttcgtcgctgaaagcttcattttcgagattggtgacaatcatcatcatcgtagtccgatgtctgtcggcaatttcttttaagttgttcagcggcggttcttcgagtgtgccgtcccgcttcgcctggaagctgaaagcgcccagataggtcaagtatggcgaagcctctcttgccgcctgctgcaaagcggggcttacgctttctccccgaggttcgatataggcgtttgtttcaatgttccgtcttggccgaggggggatgtaaagcagcagtccgaccggtaaaacggcgctaacctgaatgcggttgatcctcgccagttcagccggagaaatattaaagcgtgctccgattgatgctaatgtatctccctgtctgacctcataaaactcgccggcgatcgggatcacgatggtttgtccgacaacaagccgattcgggttcggaatttcattcgtcgcgacaatttcattaactgttgttcggtaacgattcgcgatttggtaaagggtatcgcctcttttcacgacataaatctgaatgggaaacgcctcctttctcattgctaccactatatgatgaaaggaagtgtttcatgctctaagtttcggaggtaatcgccttagccgtcgtgatattggcgaacagaacattttccatcatcgtcaaggcgtatttgttgtctttttcattgtttgaggcgatgcaatcgcgcggaatcgtaatctcgtactcccgcatataagcatcgtttgccgtaaataatacgcagatattgcctgcgatcccagtgatgatcaaatgatcgacatgaagttcatgcagcaatgtttcaagagcagtgccgtaaaaggctgagtgctttggtttgattaaaaaataatcgctgtcattcggtgcaagccggtcgatgatatattcgctcctgccgtttttgcatttcttgataatggcagcaatatccgcttgccaaattccaaaatggtcattaatgtatatgataggccatttcattttggctgcgtgttcttttaatgccagaagatgctcggtgatatttctggtctttttggaaagaacgttacccatatcgaattgaaaatcattaatgatgtcgactataatgagagctgaattggacaatgcgattgtctcctttcagattttatattcctttaactataagttagcctattcagtttggcgaaaaacattgaaagagtgcatgcggatgacacaagacgagttttatatgaaagaagcggtcaatgaagcgagaaaagccgaagaaaaaggcgaagtgccgattggtgctgtactcgttctggatggggaaattatcgcccgcgcccataatctgagggaaaccgagcaaaggtcggttgcccacgcggagatgctcgtcattgaagaggcatgccggaagctggggacctggcggctggagagagctgttctttacgttacccttgagccatgtccgatgtgtgccggagcggccgttctttccagaatcgacaaaaaggtgttcggagcgtctgatccgaaaggcggctgtgcagggactttgatgaatctcctgcaggaggagagattcaatcatcaggctgaagtcgtgagcggcgtaatggaagaagaatgcggcaggatgctgagcgattttttcagaaagctccgcgcgaaaaagaaagcagaaaagcaaagcgagctgtgatgacggaaatttgcaatttaggatgaaacaagttatactaatgagtgcgtcacatcaagacgcagcttaaataatttgatatttattttgccgtgctaagcggggaggtagcggtgccctgtactcgcaatccgctcgagcgaggccgaatccctttctcgaggttcgtttactttaaggtctgccttaagcaagtggtgttgacgcttgggtcctgcgcaatgggaatccatgaaccatgtcaggtccggaaggaagcagcattaagtggaaccttccatgtgccgcagggttgcctgggctgagctaactgcttaagtaacgcttagggtagcgaatcgacagaaggtgcacggtaaatcaatcatcaaattaagaactcatctatttgaatatagatgagtttttttcttaagaagagcttttggatttgaaagccgcatcatgtataatggaaatgatgaaaacaagaggagggcgtgtttgtgagttaccaggctttatatagagtgttcaggccgcagttgtttgaagatgtagtcggtcaggagcacatcacgaaaacgttgcaaaatgcccttttacaaaagaaattttcgcacgcttatctgttttccggaccgaggggaacgggaaaaacaagcgccgcaaaaactgtttgccaaagctgtcaactgtgagcgcgctccggtcagtgaaccgtgtaacgaatgctccgcgtgcaaaggcattacaaacggttcgatttcagatgtgatcgaaattgacgccgcttctaacaacggtgtagatgaaatacgcgacatccgcgacaaggtgaaatttgccccgtctgccgtcacgtataaagtatatatcatagatgaagtacatatgctttctatcggcgcattcaacgcccttctaaaaacgcttgaagagccgccggagcattgtatctttattctcgcaacaacagagcctcataaaattcctttaacgattatttctagatgtcagcgatttgattttaagaggattacctcgcaggcaattgtcggacgaatgaaaaaaatcgtcgaagctgaacagttaaaggtgcaggacggagccttagacatcatcgccagtgccgcggacggcggcatgagggatgcgctgagcctgctcgatcaggccgtatcattcagcggagaagagctgacggtggatgatgcgctgctgataacaggcgccgtgtcacagcactatattggaaagctcgcctcaacccttcacgaaaaaaatgtttccggtgctttggaaacattgaacgaactccttcagcaggggaaagatccggcaaaattaatcgaggatatgattttctacttcagggatatgcttctttatcaaacggcgcccgatttagaaggcgttcttgaaaaggtgaaggtggacgaagagttccaaaccctatcccggcaaattcccgcatcagacctttacgaaatgatcgatatattaaataaaagccatcaggaaatgaaatggacgaatcatccgcgtatcttctttgaagttgcggttgtgaagctctgcctgggaccaaaagcaggggcatccgcggccgcccagccggaagtggacaatctcgtcaacaaggttcggcagcttgaacaggagattgagaggcttaaaacacaaggtgtgcaggtctcttctgctcccgcccaggctaaagaagcgtcccgtccgcaaaaaagcataaaaagcgcgtataaagcgcctgtcggccgcattcatgaaatattaaaggatgccacaagaccggatctcgaaaaattaaagggctgctggggacaattgcttgcccagctgaaacagcagaataaagtatcacatgcggcccttttaaatgacagcgaaccggtggctgcatcttcaaaagcatttgtcctcgcattcaaatacgaaattcactgtaaaatggtagctgaagacaacaacggagtcaggacgaatctggaacaaattttggacggaatgctcggcggaaggatagatatagttggcgttcccgaagcccaatggggtaaaataagagaagaatttttgcaggatcaccagccggaagattctgaagcaaacgaaccgaaagaagaagatccgctcgtagcagaagctaaaaaactgttcggagcggaactgattgaaattaaagaataaaaacatgaaagagagtggatttgagtatgcgcggtggaatgggtaacatgcagaaaatgatgaagcaaatgcaaaaaatgcaaaaggatatgcaaaaggcacaggaggagctggctgaaaaagtactcgaaggtactgcaggcggtggaatggtgaccgttaaggtgaacggccaaaaagaagtcatcgacgtcatcatcaaagaggaagtcgtagaccctgaagatgttgaaatgcttcaagatcttgttcttgcagcgacaaacgatgctttgaaaaaagttgacgaagtaacaaatgaaacgatgggtaagtttacaaaaggaatgaacatgccgggtttattctaggaggaaaataagaatgcagtatcctgaaccaatatcaaagctgattgacagctttatgaaattgccaggaatcggacccaagacggcggtccgtctggctttttttgttcttagtatgaaagaagacgtcgtgttagattttgcaaaagcattggtaaacgcaaagcgcaatttgacatattgctcggtctgcggacatataacagatcaagatccttgctatatttgtgaagatacgagaagagacaaatcggtcatatgtgttgttcaggatcccaaagatgtcattgctatggagaaaatgaaggagtacaacggactgtaccatgttttgcatggagcgatttctccgatggacggcatcggtccggaagatattaaaatacccgaattgctgaagcggttgcaggatgatcaggtgactgaagtcattctcgcgacaaacccgaatatagaaggagaagcaacggccatgtacatttcaaggcttttaaagccgtctggtatcaagctgtcacgaattgcccatggacttccggtcggaggcgatttggagtatgcagatgaagtcactctttctaaagcgcttgaaggcagacgtgaaatgtagagggaggagattgcgttaccatgggttttcttcggaaaaagaagcttagaaaagaatttgataacaagctggttgaacagctgatccatcaaaaggaagaatggaacaggcaaaagcggctgattgaaaacagcctagagccttccccagaagttctttacgaattaaaggttgccgaggcaaagtactttttttatttgcgggaagcaaaaaaaagaaatttaaggatcggcagctggaagtagcaggtctatttgcatgattcccatcatatgcttgtacaagaacgagcgaggagtgagggaattcatgggatctgttatctttatcggggcaattgtagctttggttgccctgttgtttttttcaaaagcatcatttaagcctttgcgattaatcggaagaatagcggttagatttgtagtcggcgctttgtttttgttctgtgtgaatctgtttggcgagagcgtgggcattcacgtgccgattaatattgtaacaaccggagtgagcggattattgggggttcccggtgtagcagctcttattgtcattaaacaatttatcgcaatataattttttgttgacaaatatatttaaaggtgttaaattaatatttgtcgctaatgacgaataatttttttgaaaaaaagttgttgacgacatcacgattaaatgttaagatattatagttgctttgagagcggcaacgaagttctttgaaaactaaacaagacaaaacgtaccctgttaattcattttttataaatcgcacatttgagtgtgcgtagacaggggcctgcacgatgcaggtcatgcagatgttgtcacaggatgtgacgaacttaatctgcgctccattatttcatggagagtttgatcctggctcaggacgaacgctggcggcgtgcctaatacatgcaagtcgagcggaccgatgggagcttgctcccttaggtcagcggcggacgggtgagtaacacgtgggtaacctgcctgtaagactgggataactccgggaaaccggggctaataccggatgcttgattgaaccgcatggttcaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctggcaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaaggatattatacggaatataagaccttgcggtcttatagacaggtgcgtttggatcttgtttagttttgaaggaacttccttcatatgaatcaaaagatgggcctgtagctcagctggttagagcgcacgcctgataagcgtgaggtcggtggttcgagtccactcaggcccaccatctttatacacggggccttagctcagctgggagagcgcctgctttgcacgcaggaggtcagcggttcgatcccgctaggctccaccaacgtgttctttgaaaactagataacgaaagtagacattcacaagaattttctgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccactgctcgtaatggagcagtatccatatctgaattcataggatatgagaaggcagacccggggaactgaaacatctaagtacccggaggaagagaaagcaaatgcgattccctgagtagcggcgagcgaaacgggaacagcccaaaccaagaggcttgcctcttggggttgtaggacactctgtacggagttacaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagtttgaaaagacggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaaagacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttgcgaacagtggtaggagagcgttctaagggctgtgaagcgagaccggaaggactcgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggcaagcgcggtattggatatccgcgtccaagcagttaggctgggaaataggcaaatccgtttcccgtaaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgctgcccttatcgggcagggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattcctataaggaagtaagatccctgaaagatgatcaggttgataggtctgaggtggaagtgtggcgacacatggagctgacagatactaatcgatcgaggacttaacctaaatatttgtgaatcgtctgtccgttatctagttttgagagaacacctctcagaaagccaaaggcaaggaaactcggctaaaggccctcacatcctgtgaggaacgcccagtaccttcgtcctgaaggcatagtttggtggcgatagcgaagaggtcacacccgttcccatgccgaacacggaagttaagctcttcagcgccgatggtagttgggggcttccccctgtgagagtaggacgccgccaagcgctaagaggaccagcttatataagctggtcttttttatttggaacctcattgatacaaacacctaacacttcccggctacatatactaatctaaccttcaaaaactttcttaattttgtatacaaatattgttctttgggaatactgaaacccatggaggtggaatggatgagtaagtctaatcatggggaaacgtgtatcatttgcgaggaaaataaaaccgaaggaattcatctttatacgaaatttttatgttcggattgtgagaaaaagattgtatctacatcaacatcagaccccgaatactctgattatgtcaaaaaattaaagagtctccgtacgccgccattatattcttagaccgtttcaggtcttttttttaagcctttaagtcggtattgaggaaggttataataaaagtggtgaagacacggttaaagtgtcttttttgctatacaccatgaactgaaactttgcttagccgatatccgtattagagagtagtataatgaaacgaccgatttatcataaaaaattaggagtagtggtgtaatgaaaccgattcttcattttatgattcgtgcaactgctgcaagtgcattgtccgtgctcctttggtttacaagcttcttcgcgtttaaccagacttttctgctgtcctccgcttacgcagccggagcctggattgccgtttatcttggcgggaaatggtacggaacctatttatttttaaaagaaaaccagcttacaaggcgggaatatgcctatataaaacagaatctgcgggaagctaagctgaaaattgcccggttaagaaaagccttatttgcagttaaaaacattcaaactattaaacagaatctagaaattcttcggatcgtcagaaaaatttacagcatcacaaagaacgaaccaaagcgtttttatcaggttgaacgcttttattatcaaagccttgattcaattgttgaactgacggaaaagcatgcgtttttggcgtcacagccaaagcgcaatgcgaatcttgaagtttctttaagcgaaacgcgtatgatgatcgataagctcgccaagcaattggaagacgacctttatgacttgctgaaaacagacattgaccacttggagtttgaactggacgtcgcgaagcattcaatgaaaaaaagctgatggaggaaagctgaaatgagcgaatataaaccatcgttacacaaaactggcgcacagcttgaatttgatgatttgctttccgatccttttggacaaggagaagcgcctgtttccggcgtggaggaaaaactccgcgggcagcaagtgaatctggttgatacgttatctgaagaaaaacgccggcaggcatttcaactggccgaacagattgacccgaaaaaccataacagcattactctgtatggaacgcaagctcaatccaaactcttgaacttctcacatgagatgctcgagcacgtccaaaagaaagatgtcggtgaaattgggcaggttttaagcgacctcatgaaaaagcttgaacaggtcagccccgatgaattgaaaactgaaaaaaggaacttcttttcccgtttgtttggaagagtatcccattctgttcaagaagtgttatcaaggtatcaaaaaaccggcgctcaaatagatagaatcagcgtaaaacttgagcattccaaaagcgcgctgatcaatgataataagatgctcgaacgcctttatgaaaaaaataaagaatattatgaggcactgaatgtctatattgcagccggtcagctgaagcttgaagaattaaatcataaaaccattcccgaattaaaagagaaatcgaaaactgaacatcaccatatggcggttcaggaagtaaacgatatgattcagtttgccgaccggctggaaaagcgggtttacgatttaacgttgagcaggcaaattacgctgcagagcgccccgcaaatccgtttgattcagcacacaaatcaagtgctggcggaaaagattcaatcttcgattatgacagcaatccctctttggaaaaaccaggttgctattgcgctcaccctgttgaggcagcgccgagcagtagaggctcaaaaacaggtgtcggccacaacaaacgaactgctcttgaaaaatgccgagatgctgaaggccaatacgatcgaaacggcaaaggaaaatgaacgaggctttattgatattgaaacattgaaacaagtgcaggacaatctgatcggtacacttgaggagacgcttaaaattcaagaggaaggccgttcaaagcggctgcaggcagaagaagaaataagggcaatggaagatggtctcaaggctaagctgctggacatgaaagaaaaccaaaaccgtagatcataagcaagattaacatttaccaaatggtccgccctttatgttatccgccttgaagggtataataaatgcagaatgtcatatcggcatccggcagcgcctggatgccgaagaaaatagagaagatgactaaaggatcggtttatatgaagacacctttatatacagcattggtgaaccatgctgaaggacatcattattcttttcacgttccgggacatcacaatggagatgtcttttttgatgaagcaaaaactttttttgaaacgattctcaaagtggatctaactgaactgacaggactggatgatttacatgagccatctggcgtcatcaaggaagcacaggatttagtttcgcggctttacggagcggaagaaagcttttttctcgtcaatggttcgaccgttgggaatctggctatgatcctggctgtttgtcagccgggtgatacgatactcgttcagcgtaactgccataagtctgtatttcatgcgattgaactttcaggcgcccatccggtttttttgacaccggaaattgatgaggcgatggctgttcccacacatatactgtacgaaacagttgaagatgcaatttcacaatatccgcacgcaaaagggatcgtgttgacatatccaaattactacggccatgcagttgatctgaagccgatcatagaaaaggcccaccaacacgatatttccgttttagtcgacgaggctcacggcgcccattttgtgctgggccatccatttccccagtcgtcgttgaaagcgggcgctgatgccgtcgtccagtccgcgcataaaacgctcccggcgatgacgatggggtcctatctgcatcttaacagcggcaggatcaacagggacagactggcatactatctgtccgtgcttcaaagcagcagtccttcctacccaattatggcatctttggatatagctagggcatacgccgaagatatcttgaaaacaaatcgaacagccgatattgagaaagagctcatcaatatgagagaagtcttttctcaaataaacggagctgatattgtcgagccggctgatgcccgtatccggcaagatccgcttaagctgtgtatcagatcagcgtacggccactccggttttgaactgaaatccatatttgaagcaaacggcatccatcctgaattggcagatgaaaggcaagtcctgttgatcctgccgcttgaaggaaaaaatatgcccgcgccggaactgatcagcacaatcagtaaagacatgaaagatacagcagttcgaaatgatcttcctgccggaatcggaatcccttctgaaaaagtcacggctttgccttaccggaaaagcaagttgtctgccttcaaaaaagaatcggtgccttttaccgaagcagcgggcagaataagcgccgaatcggtcacaccttatcctccgggcattccgttgatcatggcgggtgagagaataacaaaagagacgatcagccggctgacgcggctcgtcgatctgaatgtacacattcagggcagcaatcagctcaaacaaaagcaattaactgtatatatagaagaggagaaatcatgaacggtttatttattacttttgaagggcctgaaggtgcggggaaaacgacaatccttcaggctgcggcagaccaattgacgaaaaacggccattctgttcttgcgacaagggagccgggcggcattgaaatatcagaacgaattcgcgaggttattttaaatccaagccatacagcaatggatcccaaaacagaggccttgttgtatgcggccgcaagaaggcagcacctagtcgaaaaagtaaaaccggcgcttgaagaagggaaaatcgtcttatgcgaccggttcatcgacagctcgcttgcttatcaggggtatgccaggggactcggcattgatgaagtattttctgttaatcaattcgcgatcggcagcctgatgccgaatgtgacgatttatttcgacattgacccggaagagggaatcaaacgaatcgatttaaatgatgcaagagagaaaaaccggcttgatttggaaaaactccactttcatcagcttgttcaaaaaggctacgaagaagttatgaaccggttccccggacgatttcggattgtggatgccagccaaagtgttgaacttgtgttaaaaagggtaaataacatcattgaggaagcattaaaagaaaatcagttgtgaccagtttaccattcattgttataatggtaacaagagtatccttaaagtgtttccatccaaaagggggcttttcatatgaagttaattatcgctgttgttcaagaccaagacagcaaccggcttttaaaggctttgaccgatcacaattttcgcgtgaccaaactggcgtcgaccggcggctttctgaaatcgggaaacacaaccttcatgttgggtgtagatgatattcgagtagacaaagctttaagcttgataaaagaaaacggaagcaagcgggatcagctgattgcccctgtttctccaatgggcggaaatgctgattcatatgttccttatcctgttgaggttgaagtgggcggagcaaccgtttttgtactgccgatcgagcaattccatcaattttaagggttgaggatatgaaaataagtcaagaactgcgtacaatgatagagaaacagcagactccgcctgcaagaggagaaaatgtttctgcttcatttaaagagaagatgaatatacaaagcggcaagcttcgagttgaacagctgacaatgcttttaacagatattgaagcgttcggaaaacgcctctcaaaatcgagaaacttcaaagatttggccaggttcaaaggcttgatcaaacgatttgtaaaagagaccgatgaaaacgtctggacggtggagattcaagaagcttcgatctgtacggaaacagccggacattaagcattgtgaaagaactggacgaaaagcttgtgcaattaactgaggatcttatggatcaagaaaaatcctctatcgaacttttggaacgcattggcgaaataaagggtttactgataaacctttacacatagagagtgatggtatggctacaacctggacagaaatgcagaagcttcagccacgggttatgaagcttttgcaaaatagtatagaaagaaatcggcttgcccacgcctatttatttgaagggcgcaaagggacgggcaaattagacgcggcaacccttctggcaaaaagctttttttgccttgaagatggagcagagccatgtgagtcatgcaggaactgccagcggattgaatctggaaaccatccggacgtacacgtcgtccatccggacggcctttccattaaaaagggacaaatccaggcgcttcaggaagagttttctaagaccggtttggaatcgcataaaaagctgtatattatttcccatgcggatcaaatgacggtcaatgcggcgaacagccttctaaagtttttagaggaaccgagcagcgatacaatcgctgttcttttaacggaacagccgcaaaaattgctcgatacgatcatatcgagatgccaggttttatcctttcagtcgctgcagcccgaatcgattgaaaaggaactggtcaaacaagaggtctcaccgaatattgcagcccttttgtcgaatatgaccaacaatttatcggaagcgctcgaattgagtcgaaatgatcagtttgcagagtcgcgagcgaaagtgataaaattgtatgaagtcttacaccagcgaaaaggacatgcttttttctatattcaagatcagtggatgccctttttcaaggagaaagaccaccaagaaatgggtcttgatatgcttttatttatatatcgcgacgtgttgtccattcagttgggacatgaagataaaatactatttcaggacttattccaatcattaaaacagcatgcgctgcaaacaacacaacaaagagtgacaaaccagatacttgctgttttagaagcaaaaaaacggctttattccaatgtgaatgctcaaggattaatggagcacttggttttaatgctgcaggagggataagcttgtacaacgttattggtgtccgctttaaaaaagcgggcaaaatatattatttcgatccgaacggatttcagatagataaagacagctgtgtgatcgtcgaaacggttcgcggtgttgaatacgggcaggttgtcattgccaacaagaaagtagacgagaacgatgtcgtgctgcctttaagaaaagtgatcagagttgcggatgaacgcgaccgcctgatcgttgaggagaatcaagaagctgcgctgtccgcctttgatgtctgccagaaaaaggttaacgagcacggccttgagatgaaactggtcgatgtggaattcacttttgaccgcaacaaagtcattttttattttacggctgatggaagagtcgattttagagaactcgtcaaagatttggcatcgatctttaaaacgagaatcgagctgagacaaatcggcgtcagagatgaagcgaagatgctcggcggtatcggaccgtgtggaagaatgctttgctgttccacgtttttaggtgattttgagcccgtttctattaaaatggcaaaggatcaaaatctgtcgctgaatccgacgaagatttccggactatgcggacggctgatgtgctgtctaaagtatgaaaacgatgaatacgaaacagccaaagaacagcttccggatatcggggaagtgatcgccacgtccagcggcccggcaaaagtcgtcgggttgaatattctcgaacgcattctccaggttgaactgacagactgcgacaaagttgttgaatatacgtgggatgagctgttgcaagaaggtgtcgtatctgcacaaaccacagattaacgaggtgtgaaaccttggataaaaaagaattgtttgatacagtgataagtttagaagaacaaatcgggtccctttaccgccagcttggagatctcaagcagcatatcggggaaatgattgaagaaaacaatcatttacagcttgaaaacgagcatttgcgcaagaggctggaagagacggatcaaaggctaaaaagcgtaaaatccgatgaaaaagagataaaagcagaaaagacagggcatgctgatattggagagggccatgataatttggctcgcctgtatcaggagggcttccatatttgcaacatccattacggaagtgttcgcaaagaaggagactgtctgttctgcctctcgtttttaaataaaaaataagaaaggcttccggcggaacggaagcctttttaacggtacaatgtgtttaggaaagggaaaagacatgattcaattaaaagatgatgaacgactggattatttactggcggaagatatgaaaatcgtgcaaagcccgacagtttttgcattttccttagatgctgttctgctgtcgaaatttgcttacgttccgatacaaaaaggaaacatcattgatttgtgcacagggaacgggattgttccgctgcttctcagcacccgcacaaaagccgccatcaccggggtggaaattcaggaaaggctgtatgacatggccctccgcagcgtggaatacaacaacctgcaaaaacagattcatcttatcagggacgacctgaaaaatatgccgcaggtgctcggatacaataaggccgatgtcgtcacatgcaatcctccttatttcaagacgccgcaaaaaacggagcaaaacctaaatgaacatttggccattgccagacatgaaatctactgcacgcttgaagatgttattcgcgtcagcagcaagctattaaagcagggcggcaaactcgctctcgttcaccggccggggaggctgctcgaaatctttgaattgatgaaggcctttcaaatcgagccgaagcgggtccaatttgtttacccgaaaaaaagcaaagaagccaacaccattttagtagaaggaataaaagacggccgacctgacctgaaaattttgcctcctttgtttgtgtatgatgaacaagatcaatatacacatgaaataaggaagattttatatggagacgaatagccattacttttacgtgctttcgtgccgggacggcagcttgtacgcaggctatacaaacaatatcgaaaagcgcctgaaaacgcataatgacgggaagggcgccaagtatacgagggcaaggctgccggttaaactccattatgcagagtgcttttcaacgaaacgagaagcgatgcaggccgagtactatttcaaaaaattatcgagaaaaaacaaagaacgttatatagaagaaaaaagacgggagggtgttgattatcaaccggcaaaagagttttgaccaaaaatcagacatgggtatgttatatctcgtaccgactcccatcggcaatttagaggatatgacatttcgggcggtttctgtgttaaaagaggcggacattatcgcggcggaggatacgaggcagacgaagaaattgtgccatgtgtatgaaattgagacacagcttgtcagctaccatgaacacaataaagaaagcagcggacataaaattttggaatggctgaaagaaggaaaaaacgtcgcattggtcagtgacgccggaatgccgacaatatctgaccccggggctgaaatcgtccgcgattttatcgaaatgggcggctatgtcgtacccctgcccggtgcaaatgcggctttgaccgcactgattgcctcaggcattgcgccgcagccgtttttctttttcggctttttggaccgcagcaaacgggaaaggaaaaaacagctcgaggctttgaagaacagacaggaaacgatgattttttacgagtcgccgcatcggctgaaagaaaccttggcggccatcagagaggtattcggcaatcggcaaatcgcattgacaagggaactcacgaaaaaattcgaagaatttatcagaggttcgatcgaagaagcactcacatggtctgaacaggaacaggtgcgcggagagttttgccttgtgatcgaaggaagccgtgaagaaacgattgaagaggcggtctggtgggagcatctttcagaaaaagaacatgtcgagcattatatcagcgaaggatatccttcaaaagaagccattaaaaaaaccgcggttgaccgcggcgttccgaaacggaaaatttatgacgcttaccatattcaaaactaaaaaaccgcccttgcttcggcaagagcggtttttgtataatcaaaataattatttttgagattgaagttgtgcttgaatttcgttaatgatttgctcagcgccttcagggctaagaaccaatttaccgcctgcaagtttaaggttgtcatcagaaacctcacctgtaacttggcaagtcatgtttggtttatattttttcaagatgattttttcgtcatctacatagatttcaagagcgtctttttctgcgattccaagcgtacggcgaagttcgattggaatcaccacgcgtcctagttcatcaactttacgtacaatacctgtagatttcatattcattctcctcccgaaagattgttatttttataggtgtttattatcttcgtcattattcgacaaaatccttacagtcctagcataacaaggtttccaataaacgtcaatcattttcttttctattgtttgtaaaaattagatcatatagtcaaaagaccttggaagaactgatgtaacaagggaattgaagatgataaaacagtatgatcaatcaaaaaaaagcccttaaatcaagactttcgaactaaggtttttcctcatatcgattatatacgacattattcgacaatgaaagcatttttttgtcgaagtatagtatttctttctgttaagaaatttgtaatcgaccgtattcatgatggatcgacaatgtatattttcttgaacttgaaggctaagatggtatcatataaagagggattatatattgagtatatactgaatgaatacacatgccgctctcgtcctttgggcgggagttttttgacattttaattgggaggttccatcatgccgcaagaaaaaaatacgttttacatcactacacccatttattacccaagtgggaagctacatattggacatgcctacacgaccgttgcaggtgatgcgatggctcgttataaaagactgagaggctttgatgtcagatacttaactggtacagatgagcacggacaaaaaattcagcaaacggcggagaaggaaaacatcactccgcaggaattggtcgatcgtgcggcagaagacattcagcagctttggaaaaagctcgacatatccaatgacgacttcattcggacgacagaggaacgtcataaaaaagtgatcgaaaaggtatttcagaagctgcttgacaatggtgacatatatcttgatgaatatgagggctggtacagcatccctgacgaaacgttttacaccgaaacccagctcgttgatgtcgagcgaaacgagaaaggcgaagttatcggagggaaaagtcctgacagcggccaccccgttgagctaatcaaagaggaatcttacttcttccgcatgggaaaatacgcggatcggcttctcgctttctatgaagaaaatcctgaattcatccagcctgaatcccggaaaaatgaaatgatcaacaactttatcaaaccgggtcttgaagatttggctgtttcccggacgacgttcgactgggggataaaagtgcccggcaatccgaagcatgtcatctatgtttggatagatgcgctgtttaattacattacggcacttggctttaatacggaaaacgatgaaaattatcaaaaatattggccggcagacgttcatcttgtcggtaaggagatcgtccgcttccataccatttactggccgattatgctgatggcattggaccttccgctgccgaaaaaggtttttgcccacgggtggctgctgatgaaagatggaaaaatgtctaaatcaaaaggcaatgtggttgacccggtcacattaatcgacagatacggactagatgcattgcgttattatcttctccgcgaagtgccgttcggttctgacggcgtatttacaccggaaggatttgtcgagcggattaactatgatttagcgaatgatttaggcaacctgctgaacagaacggtcgccatggtcaacaaatactttgacggccggattcagtcgtatgaaggcccggttaccgcttttgacgaaccgttgtcatcattctcgcaaaagacaattgaagcgtacgagcaggcgatcgaaaatatggagttttccgttgcgctttcatcattgtggcagtttgtcagcagaacgaataaatacatcgacgagacagccccttgggtactggcaaaagataaggataaagaaaaagagcttcaatcggtcatgtaccatttggcggagtcattgcgcatcactgctgtattgctgcagccgttcttaacgcagacgcctgaaaagattttcgcacagcttggcgttacggatgcgtcactgaaaacctgggacagcattcaaagcttcggccagctgaaatctgtgacagttcaaaaaggagaaccattgttcccgcgtcttgaggcggaagacgaagtcgcttatatcaaatcaaaaatgcagggaacggctccaaaagaagaaccaaagcaagaggaaaaagcacatgaacggcttccggaaatcacgatagacgattttatgagcacagagctcagagtggctgaagtcattcatgctgaacccgtcaaaaaagcggatcgtctgttaaaactccagcttgatttaggctttgaaaaacgccaagtcgtttcaggaattgccaagcactacaaacctgaagagcttgtcggccggaaagtcatttgtgtaacaaatttaaaaccggtcaaactaagaggagaactttctcaaggcatgatattggctggagaggacaacggcgttctctcgcttgcggcggtagacagttcattagcaaacggaacgcgaatcaaataaatgcaggcaaagggtgttccacgtgtaacatttcgtcgaacaccttttgttttttcgacaatttcttaaaaaggtggcattttcatgttatttgatacacatgctcatttaaacgccgagcaatttaacgaggatttggaagaagtcattgctcgggcaaaggaagaaaaagtggagcacattgtcgtggtaggattcgatcgtccgacgatcaagcgtgcgatggaattgattgaagaatacgattttatttatgcagccatcgggtggcatccggttgacgcaattgatatgaccgatgaagatttggcttggatcaaagacctgtccgcccatgagaaagttgtggcgatcggagaaatgggacttgattatcattgggataagtcgccgaaggacgttcaaaaagaggtgttcagaaaacagatcgctttggcaaaagaagtcggcttgccaatcgtgattcacaaccgtgatgcaacggaggatgtcgtttctattttgcgggaagaaggggccgaggaagtcggcgggatcatgcactgttatacaggaagcgctgaaattgcacaagagtgcatcgatatgaatttctacctatctttcggcggacccgtcacatttaaaaacgccaaaaaaccgaaggaagtggtcaaacaaataccaaatgaccggcttttaattgagacggactgcccgtatttaacgccgcatccatacagaggaaagcggaatgaacctagctatgtcaaacttgtcgccgaacagattgccgaattaaaaggaatgacttatgaagaaatagcggccgtcaccacagaaaatgcaaaaaaacttttcggcatcagctgacacgatttgatatcgagccttgttcaagcttgtctcttcgggggatggttctaaaaagttctacatgtctgtttacgctcataggatatctttgtcgacaagtctttctttcttttatgaggtggttttcccataataaaagagatggcgggcttgcggagaaaatagagaggagggttgacaggcttgtagatactctatataatctccccgaggagaaggaggcgtttttcatcatacaaaaaatgaaaaagctgttttccgtaaagcttagcaaaagcagatggattctgattgctgctggactgcttgtcgcagggagcggaactgcttacggagcacatgagctcgctaaacagcaagtcaccatttcgataaacgggaaaaagcaggatgttcgcacgaatgctaaaaccgtaggtgaactgctgaaaagcttagacatcgagacgaggaaagaagatcacatctctcccgctgaagatacaaaattaacggcgaacatgaatgttgaatatgttgccgcaaaacctgttcatttcacggtcgacggacaggaaaaggaaatctggacaacagcgggtacagtcggcaaacttctgaaagacttaaatttagagttggcggaacacgatcaaattgacccctcagttgataaagaaataacgaaagatatgaagctgactttgcaaagggcttttaaagtaaccgtaaaggatgccggtaaagataaagacctatggacgacttcgactacggtcgctgactttttaaaacatcataagatcagcataaaaggcgatgatgaagttaagcctgcgcttgataaaaagctgacgaaagatcaggcgattcacattactcgtatcaaaaaagtcaccgatgtagtggaagagaacatcccttttgaagtccggaaaaaagaggacgattcacttgaaaaggggaaagaaaaagttgtacaggacggtaaacatggcaagcttaaaaagcactatgccgttgttatgaaaaacggcaaggaagtttccagagaactgattaaagaggaaacggcagccgaaagcaaagccaaaatcatcgctgtcggtacaaagcaagccgcagtggctaaagtcagcgcgaatgtatcgcgcggaaatcaatcctcaggaaaggaattttatgtatcctctacagcttatacagcaagctgcaacggatgctcaggccacactgcgaccggcgttaatttgaaaaataatcccggcgctaaagtgatcgctgtcgatccgagcgttattccgctgggttccaaagtacatgtagaaggatatggctatgcggttgcggccgatacaggctcagccatcaaaggccgaaaaatcgatgtattctttccgaataagtctacagcttaccgctggggaaacaaaagagttaaaatcaaggtgttgaactaaatatcatttattatgctttttatataagcagagggattttgcgccctctgtttttttggttataatagatccatcttgttttctaataaattagacggttttattacaaaaaggtttcaatcattttaaaaatgtaataaaaggtttttcaacatacggaggaagaaatgaagattaaagaaatcatcgttgtcgaaggccgtgatgacaccgctaaaatcaaatcggctgttgatgcagatacgatcgaaacgaacggatctgccataggggaagacgtcatcaaacggattcggctcgcccaggaaacgcgcggggttattattttaaccgatcccgatttcccgggggaaaaaatcagaaaaacgattgcagaaaaggtccccggctgcaagcatgcatttttgcccaagcatttggcaaagcctaaaaataaacgcggaatcggtgtcgaacacgcttcgcttgaagcgatccgcgaatgcttaatgaccgttcaggaggaaatggaagcgacggaacctgagattgaggcccgggatttaatcgaagccggcctgatcggaggcccgctggcaaaacaaaggcgggagcggctcggcgaaatattgaatatcggctatacaaatgggaaacagcttcaaaagcggctgcaaatgtttcagatcaaaaagagtgattatttaagcgcactggatgctgtgctgcgggaggaagaacatgaataaagatatcgccaccccaattaggactaaggaaattctcaataaatacggattttcattcaaaaaaagcctggggcagaacttcttgattgacacgaacatattggacagaattgtcgaccatgccggtgtgacggagcgtacaggcgtgattgaaatcggtccggggatcggggcattgaccgagcagctggcaaagcgtgcgaagaaagtaacggcctttgagatcgaccaacggcttctgccgattttagaagatacgctttctccgtatgataatgtgactgtcattcaccaggatgtcctgaaggccgatgtccgagcggtaatggacgaacagtttcaagactgcgatgaggtgatggttgtcgccaacctcccgtattacgtcacgactccgatcatcatgaagcttttagaagaaaatctgccgctgaaaggaatcgtcgtcatgcttcaaaaagaggtggcggaccgaatggctgcaaaaccttcttcaaaggaatacgggtccctttccatcgcggtgcagttttatacggaggccaaaacggtcatgaatgtaccaaagaccgtatttgtccctcagcctaacgtagattccgcggtcatcaggctgacgctgaggaaagagccggctgtggccgttcaagatgctgcctttttctttcaagtcgtaaaagcaagctttgcacagcgtcgaaaaacgcttttcaacaacctcgtcaacaatctgccgaatggcaaagagaataaatcaaaaattgaaagagcgcttcaggattcacatatcgacggaaaacgacgcggagagtcgcttagcattgaagagttcgccgtcttatctgaccgcttgagagaagtccttctttaatggagggctttttttattgatgccgggctttaagcctgatcaggcttgtcatccgttcaccacttgaagggcaggcacataggctaaagaagcacctttactttttcgttgcttgatgttcatcaggatggggcttagtctatgtgtggagtgaaaagcatgcaatttaaaataggcgatatggtcgtcagaaaatcttatcgaagagatattttatttcgaattataagaattgatcaatcggcaaatggagaacctgtagccgttttgcacggagatgaggtcagattaatcgctgacgcgcatttgggggatcttgagattgtccgcgaggctgagtggcagatgagaaagcgggaagaagaaacgagaatgaaggaatccctcgatcttctccgccaggattacaaactccttcacgataaacatgagtaccgcgccacaaaccaatataacaatcaacagcagtactttcatatgcccggaagagtccttcatttagacggggattcggcttatttgaaaaagtgtctggcgctctacgaaaagatcggggttcctgtatacggcattcattgctatgaaaagaaaatgtcatcagtcatcgaggaactgatcgatgaataccgcccggatcttctcgtcattaccggacacgatgcctattctaagcagaagggcgatattaacaatctggatgcctacaggcattcaaaagattttatcgaaaccgttcaaaaagcgagaagaaaaattccccatcttgatcagctcgtcatttttgccggcgcatgccagtcccattttgaatcactgatcagagccggtgcaaatttcgcaagctctccgtccagagtcaacatccatgcgcttgatccggtctatatagtcgcaaaaatcagcttcactccgtttatggaccgcattaacgtctgggaagtgctcagaaataccttgacgagagaaaaggggctcggaggtattgagacgcggggcgtattgcgtattggaatgccatataaaacaaaagcaaacgattaaacgagcccgccggatggcgggtttttgctatgcacacgaaatgtttttaccttttttttaaaaacatacataatgaaacgaaaaatgaggaaaataagggaaagtcggcgtataatttgtcacaaatattttattgacagaggcttatgaacgttgatataatttaaattttatttgacaaaaatgggcttctggtgtatactgaatatagtgaggtggatgcaatggcgaaaacgttgtccgatattaaaagatcgcttgatggacatttgggaaaaaggctgacgttaaaagcaaacggtggccgccgaaaaacgattgagcgttcgggcattttagctgagacgtacccttctgtttttgtgatacaactagaccaagacgagaattcgtttgaaagagtttcatacagttatgcggatattcttactgagacggttgaattgaggttttccgatgataaaaccagctcagtagccctttaataagcagtggactttatgtttgctgctttttgttttgcctttttttatccaaaatttttcggggaagttctgcacaaatcgagcaaagctaatacatgtcacttgttttatgatgagtcagacggatggtatgatacttgaaaggggctgtttcgcatgggcagacgtcgaagcatcatgtcagaggaattcaaaaatgaattggctaaagatcttggattttacgatacggtaaagaccgagggctggggcggaattcgggccagagacgccggcaacatggtgaaaagggccatcgaattagccgaacagcatatggctcaaaatcagcaaaatcattaaaacagtgacatacgggggacgcttctgtcctccgtttttttcattgatccgttttcagtgttcagccgctgtaagcgacctgggaatcatggcgaggggcgcattcgcaatctgaaggaatgaccgcatgccaaaggcgaggcatcctgcgcaggcgcatgcatttgtacttgcgaggaatgaccgcatgctaagagcgaggcgtcctgcctcaggcgcatgcatttgtacgtcctgtacttcaaaatatgttacaatgtggatacttatgtttagatggagaagtaggtgaatggattgcgtattttagagaaggcgccggctaaaattaatttgtcgctcgacgttcgccacaaacgtccagatgggtatcatgaagtagagatggtcatgacgacgattgatttggcggatcgggtcgaattaacagagctggcagaagataaagtaacggtttcttcgcataaccgctttgttcccgacgatcagcgaaaccttgcttatcaggctgcaatgctcatgaaagaacgctacggcattaaaaaaggggtttccatttttattacgaaagtgattcccgttgctgcgggccttgcaggaggaagcagcgatgcggctgccgtcttcagaggattgaaccggctgtgggatttgaagctttcgatgaatgaactggctgagcttggcgctgagatcggatctgatgtctccttttgcgtacatggaggaacggctcttgcaacgggaaggggagagaaaatccgtcatatcgagactccgccgcactgctgggtagtgctggcaaagccgacgatcggcgtatcaactgcagaagtgtacaagcagctgaaagtcgacgagattgaacatccggatgttcaaggtatgattgctgcgattgaagagaagaattttcaaaaaatgtgtgacaagctcggcaatgtactcgaatctgttacattgaacatgcaccccgaagtcgcgatgatcaaaaatcaaatgaagcggttcggcgccgatgctgtgctgatgagcgggagcggccccactgtgttcggacttgttcaatacgaatcaaaagtgcaaagaatctataacggattaagagggttttgcgatcaggtttatgcggtgcggatgatcggagaacaaaatgaacttgattaaatccgtatgttaagttatattgtttttaaaaatattcggattttggaggtaagtgcatgaagtttcgtcgaagcggcagattggtggatctgacaaattatttgttgacccatccgcatgtcttagtgccattaaccttcttttcagaacggtatcaatctgctaaatcatccattagtgaagatttaaccatcattaagcagaccttcgagcagcagggaatcggaacgcttcagaccgtgccgggagcagccggcggcgttaaatacattccaaaggtaaaacgcgatgaagcggaggaatttgtaaagtcgctcggtgagtcattgatcgattcggaacggatattgcccggcggatatttgtatttaaccgatatccttggaaagccctctgtattaacgaaggccggcaaaatttttgcttccgctttttcagacagggagatcgatgtcgtgatgacggtggcgacaaaaggcattcctttggcatatgcggtagccagctaccttgatgtgccgacagtggtcgtcagaaaagacaataaggtaactgaagggtcaacggtcagcatcaactatgtgtccggatcatccaaccgcattcagacgatgtctcttgcaaaacgaagcttgcagacgggctcgcacgttttgatcatagacgactttatgaaagcgggaggaacgatcaacggcatgatcaatcttctcgatgaattcaatgcccatgtagcgggcatcggtgttcttgtggaagctcagggagtcaaggagcggctggtcgatgagtatatgtcccttttgactctttctgaaatcgatatgaaggaaaaaaaggtggaaatacaaaacggaaattttcagcgtttttttgcagaaaatgaataggaaatggggagtttgagatgacaaaggttgttcagacaaaagaagcaccggcggcgatcggaccgtattcacaaggaattgttgtcaacaatatgttttacagttcggggcaaattccgctgaccccgtcgggtgaaatggtgactggagacatcacagaacagacgcaccaggttttccgcaatttaaaagccgtgctgaaagaagcgggcgcctctctggagactgtcgtcaaagcaaccgtgtttctggcggatatgaatcaattcacagaggtgaatgaagtttacggacagtacttcgatacccacaaaccggcgagatcatgcgttgaggtggcgaggctgccgaaagacgcgcttgttgaaatagaagtcatcgcattagtgaaatagaaagaactcttaaaagatggttttggtctcaaaatcatcttttttgtttggaaaatttgtcaattcagtgtttttttatcccaatattacaaaaatatttttaattatgcaggaaaacaaaaaaagccgttgaatagttacactaatgtttttatattgggaaaaggtggtgaactactgtggaagttaccgacgtaagattacgccgcgtgaataccgatggtcgcatgagagcgattgcatccatcacgctggatcacgaatttgtagtgcatgatattcgtgtaattgatggaaacaatggtcttttcgttgcgatgccaagtaagcgtacacctgatggagaatttcgtgatatcgctcatccaatcaactcaagcacccgcggaaaaattcaggacgcggtgttaaatgaatatcatcgtttgggtgacgttgaggaaatagaatatgaagaaattggagcttcttaaaaaagaagggcttatggataagccctttttgttttgaaaaaaaatgatcttatcataataaaatgacaatatatggtttgtgtctgcgtataacagtagcaggaaggtaaagcatgcgaactcggataacaaagcgcatgcagaaggaatcaatccgtctccctgatcagttaatcctaaatatgctctaaacatccaaaatatgctgtcttgatttcccgatttctcattttggcttgcttgaaatcaactcatatttaggatatatttttctatggataatagggataatggaggccaatacatggataagcggtttgcagttgtgttagcagctggtcaaggaacaagaatgaaatcaaagctatataaagttcttcatcctgtttgcggaaaacctatggtcgagcatgttgtcgatgaagctcgcaagctatcattagaaaaacttgtcacaatagttggacatggtgcggaagatgtcaaaaaacagctcggggaaaaaagcgaatatgccctgcaggctgaacagctcggcacggcccatgccgtcaagcaggccaagtcgattcttggaagcgaaaaaggaacaacaatcgtcatctgcggagataccccgcttttaactgccgaaacgatggaagccatgctcacggagcatcagaaaaaagcagcaaaggtgacgattttaaccgctgtagcggaagatccgacaggctacggacgcattattcgcaatgaaaacggcgatgttgcaaagattgtcgaacacaaagatgcaacagaagaggaaaggcttgtcaaagaaatcaacacaggcacctactgttttgacaacgaagctctttttcaaacgatcgagcaggtttccaatgacaacgtacagggggaatattatcttccggatgtcattgagatcttgaaaaatcaaggtgaaactgtagccgcttatcagactgtcaacttccaggaaacgctcggagtcaatgacagagtcgccctatcacaagcggaaatctatatgaagcagcggatcaataaacgccacatgcagaacggcgtcagcttaatcgatcccgacaacacatacatttcaccggaagccgtgatcggcagggataccgtgatttatcccggcaccgtcattaaagggcgggttgttatcggtgaagacgcggtcatcggacagaacagcgaactggaaaacagtacggtcggcagcagaacggtcattaagcagtccgttatcgtggacagtgaagtcggcgacgatgttacaatcggaccgtttgctcatatcaggcccgactcaaagatcggcaatgaggtaaggatcgggaatttcgtcgaagtgaaaaaatcggaatttggtgatcgcagcaaagcatctcatttaagctacataggggacgcggaaatcggaacggatgtcaatctcggctgcgggtcgattaccgtaaattatgatgggaaacataagtttaaaacgaaaattgaaaatggggcatttatcggctgcaactccaatttggtcgctccggtgacaatcggcgaaggcgcatacgtagctgcgggttcaacgattaccgacgatgtgccaggccgggctttgtctattgccagagcaagacaagtcaataaggaagactacgctgagaacatacacaaaaaataatcctaaatcggaggtttaccatgtctaaatatgaagacgacaatttgaagattttttctttaaactcaaatccgggtcttgcgaaggaaatcgcggatatcgtcggagttgagctgggaaagagttctgttaaacgctttagcgacggtgaagtccaaattaacattgaagaaagcatccgcggctgcgactgctatgtcatccaatcgactagcgcgccggtgaacgagcatatcatggagcttttgatcatggtggatgcgctgaaacgcgcgtcggcgaaaacgattaatatcgtgatgccttactacggctatgcccgtcaggaccgtaaagcgcgttcccgcgagccgatcacagccaaactcgtggcaaatctgctggaaaccgccggagctacccgtgtgattgcacttgaccttcacgcgccgcaaatccaaggtttctttgatataccgatcgatcatttaatgggtgttccgattttaggaaattattttgaagagaaaaatttcaaggatatcgtgattgtgtcccctgaccacggcggtgtgacccgtgcccgcaaattggcggaccgcttgaaagcgccgattgcgattatcgacaaacgccgacctaagccgaatgtagccgaggttatgaatatcatcgggcatatcgaaggaaaaacagccattttaattgatgatattattgatactgcaggaacgattacgctggcggccaatgcgctcgttgaaagcggcgcagaggaagtgtatgcatgctgtacacatccggttctttccggtccggcgatcgaaagaatcgacaattccaaaattaaagagctcgttgtgaccaacagcattgagcttcctgaagaaaagaaaatcgcgaaattcaagcagctttctgtcgcaccgcttctggcagaagcaattattcgtgtgcatgagaaacaatctgtcagcttcctgttcgattaatttgctgattctggtttaaagttttgtcgttatgggaatggttttagaaagaccaatctaacgataggatggtgctgaaaatggcaattttaaaagcggaagaaagaacggattccagacggtcttctttaagaagaattcggcaatccgggtatgtgccgggtgtcatttacggaagaaatctggagaacaaatccgttgcgttagacagtatcgagcttttaaaaatcttgcgcgctgagggcaaaaatacgattatcaacttggatataaacggtgaccaacactctgttatggtgactgagctgcagacggatccgttaaaagattcaatcgtacatgccgattttaaagtggttgatatggaagcggaaatggaggcgacggttcctgtaaaccttacgggtgaagcagagggcatcaaacagggcggtgttcttcagcagccgctttacgagctgtctgtcacagcaaagccgaagaacattccgcagacgatcgaggttgatatttccagtctcgaagtcaatgatgttctaaccgtcggcgatattccgaccaaaggcgattattcatacaaccatgagcctgatgaagttgttgcatccattcttcctcctcaaaagcaggaagaaacagaagccgaatcagctgctcaagacgttgaggaaccagaaaaaggcactgaagaggaaaaagaagaataaatacgtaagacgtaatccgcccgcggttacgtcttttgtgctagaatgaggggaaattaggatgctccccctcagtatgctgaggcagggttttgcttaagggaggatatagaataatgcttgtgtttgcaggattgggcaatccgggtaaaacatatgaaaatacgagacacaatgtaggttttatgacgattgacgagctctcgaaagagtggaacattccgcttgataaaacaaagttcaacggacaatacggaatcgggtttgtttccggcaaaaaggttctacttgttaagccgcttacatatatgaatttatcgggagaatgtttgaggccgcttttggactattacgagatccctgttgacaatttgaaagtgatttacgatgatttggatcttccgaccggaagaatccgtctgaggacgaaaggaagcgcaggaggccataacggcatcaaatcgacgattcagcatctgggaacaagtgagtttaaccggatcagaatcggaataggccgtccggtaaacggcatgaaagtcgtcgattatgtgcttggcgcttttacagatgaagaagagccggcgataaaagaggccgtcagacaatcggccaaggcctgtgaagcttctttggaaaaaccttttttagaagtcatgaatgaatttaacgcaaaggtataaggcaaaagggaacggaacatactagtcttaaaaagactcggtatggaggttcctttatggctttacattattattgccggcattgcggcgttaaagtcggaagtcttgaccattcttatgtaaacagtgaacagttaggctttaaccacttaacaaatgatgaaagaaacgatatgatttcttatatggataatggggatttacacgtgaagacgatatgtgaagattgtcaagaagcgcttgagcgaaacccggattatcaccaatatcattcatttattcaatagatagctttggtgtagagactagaccaaagcatttttctatttgaggaagagaggaggggctcatttgaacaatattcaatcctatataacaaaaagcgatgattttaaatccatcgtcaacggcttgaacgaagggctgaaggaacagctgcttgcggggctctccggatctgcccggtcgttatttacagccgctcttacaaaagaaacgagacggccggtatttttaattacgcataacctttatcaggctcaaaaaattacagatgatttaacagggctgataaaagatcagcctgtccttttatatcctgtcaacgaattgatttcttctgaaatagcggtggcaagccctgagctgcgctcgcaaaggcttgatgtcttaaataggcttgcaagcggtgaaacgcctatcgttgttgctccggcagcagccgtcagaagaatgctgcctcctgtcgaagtatggcaaaacagtcagattcacattgagacggggcgcgacattgacacggaacagctgctccagaagctcgttcaaatggggtatgagcgtacagatatggtggcggcgccaggcgaattcagcatacgcgggggcattatcgatgtctactctttgactgaagaaaatcctgtccggattgaattgtttgatacagaagttgactcgattcgtatattcaatacggatgatcagcgctcactggaaacgcgcgatgaagtaacgatcggccctgcgaaggaactgatcgtgcgggatgaagacaggcaaagggcgcttgaacaaatcgatcaaggccttgccaacagccttaaaaagctgaagctcgataaacaaaaggaaattctcgaccaaaatatcgcggaagacaaagagcggctcaaggaagggcatatcggccaggaaatggtcaaatacctttcttatttctatgagaagcctgctagtttactagattatttcccgaaaaataccttgcttatactagatgaaatcagccgtattcatgaaatggaagaccagctgcaaaaggaagaggcagaatggattacgagcctgcttgaagaagggaaaatccttcatgatacatcgatgtcatttccttttcacagcctcatttcaaaacagtcccgcccgattttgtattactcgctgtttttaaggcatgtgcagcacaccagtccgcaaaacatcgtcaatgtttcaagcaagcaaatgcagagctttcacggacaaatgaatgtgctcaaaaatgagatcgaacggtttaaaaaatcgaaatatacgacggtttttctcggagacagcaaagagcgcgtcgaaaaactagcatctgtactgtccgactatgacatcgaagccgcacaggccgaccaggatgcagcgctcgcccaaggccagatttacattatggaaggcggtcttcaatccggttttgagcttccgatgatcaagctggccgttatcacggaggaagagctgtttaaaaagcgtgtcaaaaagcaggcgcgcaaacaaaaactgaccaatgccgaacggattaaaagctactcggagcttcagatcggcgattatgtcgttcatgtaaaccacggtatcggaaagtatttagggattgaaacgttggagatcaacggcattcataaggactacctgaatattcactaccagggaagcgacaagctttacgtaccggttgaccaaattgatcaggtgcaaaaatacgtcggttccgaaggtaaagagccgaagctttataaactcgggggaagcgaatggaaacgggttaagaaaaaggttgaaagctctgttcaggatatcgccgatgacttgatcaagctctatgccgaaagagaagcaagcaaaggctacgcgttttcacccgaccatgaaatgcagcgtgaatttgaagccgcatttccttatcaggagacagaggatcagctgagatcgatccatgagattaaaagagacatggaaaaagaaagaccgatggaccggctcctttgcggcgatgtgggctacggcaaaaccgaagtggcgatccgcgccgcttttaaggcgattgcagacggaaaacaggtcgcgatccttgtgccgactacgatcctagcacagcagcactatgaaacgatattggagcgctttcaggactacccgattaatatcggtttgctcagccggttccggacgagaaaagaagcaaatgaaacgatcaagggcttgaaaaacggaacggtagacatcgtgatcggcactcacaggctgttgtccaaggatgtcgtatacaaagatcttggtctgcttatcatcgatgaagaacaaaggttcggtgtcacacataaggaaaaaattaaacgcattaaagcgaatgtcgacgttttgacgttaacggcaactccgatacctcgaacccttcatatgtccatgcttggtgtcagagatttgtcagtcattgaaacgcctccggaaaaccgcttcccggtacagacgtacgttgtcgaatacaacggggccttggtcagggaagcgatagaacgcgagctggccagaggcggtcaggtttacttcctgtacaaccgggtggaggatattgaaagaaaagcagaagaaatctcgatgcttgtacctgacgccaaggtgacgtacgcccatggaaagatgacagaaaacgaactcgaatcggtcatgctgaacttcttagagggagaatcggatgtactagtcagcacgacgattattgagacgggcgttgatattccaaacgtcaatactttgatcgtatttgacgcagacaagatggggctttcccagctgtaccagctgaggggccgcgtcggccgctcaaaccgtgtagcttacgcttattttacgtaccggaaggacaaagtcctaacggaagtggctgaaaaaaggcttcaggcgattaaagaatttacagaactcgggtcaggatttaaaatcgcgatgcgcgatttgacgatccgcggcgccggaaaccttttaggtgcgcagcagcacgggttcatcgattctgtcggtttcgatttatattcgcaaatgctcaaggaagcaatagaggcgcgcaagggagatgcaccgcaagctgaaaagtttgagccggaaatcgatttggagcttgacgcatatattccgcagacgtatgtgacagacggcaagcaaaaaatagatatgtataaacggtttagagcgatttcaaccattgaagaaaagagcgagcttcaagacgagatgatcgaccgcttcggcgaatatccgaaagaagtagaatatttattcgccatcgctgaggcgaaggtatatgccatcaaggaacgcgtcgagctgatcaaacaggataaagacgccgtcagactgacaattgacgaaaaagctagtgccgaaattgacggtcaaaaactgtttgaactcggcagcaagtacggcagacagatcggccttggaatggaagggaagaaattgaaaatctcgattcaagtgaaaaaccgaaaaccggaggaatggctggaaacgcttctcgacatattgaagggccttcaaaacgttaaaaagcaaacgatcgcttcatcataaaaatttgttgtttctcgcgtatattacatttgatgtgaaggatactaaaaccaatcaagagtggagagtgttacataagtacacagctctgtttatatccaccagatatatcatcaaatgaaagagaggcagcagagatgaaagcaactggtatcgtacgtcgaattgatgatttaggccgggtcgtgatcccgaaggaaatccgcagaactttgcgcattcgtgaaggagaccctttggaaatatttgtggaccgggatggggaggttattttaaaaaagtattctccgatcagcgagctcggcgactttgcaaaagagtatgcagatgcgctttatgacagcatgggccattccgtgctgatttgcgaccgggatgtgtatatcgcagtatccggggggtctaaaaaagactatttaaacaaatcgatcagcgacatggtcgaaaaggcgatggatcagcgcacttctgttttggacggagacgcgaagacgattcagcttattgatggtattgacgaagaggttgcttcttataccgtcggcccgattgttgcaaacggcgacccgatcggagcggttgtcattttttcaaaagaccagtcaatcggcgaagtggaacataaagcggttgaaactgccgccggctttttggcccggcaaatggaacaataggtctcattccttttattttgacattcctgctcaaacgagccggaatgccgaaagtgttttttctcagcttgaatcagcatcagcattggaacagcaccttttgggctgttcttttttaattcacacttgcaggaggagtgcaagccctgaatatggtataataagctcgtttcgtgcgctttttagaaagcgcattggaaggagcttaaaggaatggggtttttaaagggccaaagacaattgctttggcaaggcgcctttgtactttcattggcggggatattatcaaagatattaagcgctgtatatagagtgccttttcaaaatatagttggagatgtcggtttttatatttttcagcaggtgtacccgatgatcggaatatctgtcatgcttgccacctccgggttcccggtcatcatttcaaagttgctgaatgattacgggtccgcaaaccgggcaaagattctccgcgtgtctatgctttttttatcggcagtcggccttggcttttttcttctcttgtttgccggagccggagccatcgcagggtttatgggcgatcccgaccttgccggggtgatccgcgccgtgtcgttttcttatttgctgctaccgttcgtatctttgttgagaggctattttcaaggaagcgaacggatgctgccgaccgcactttctcaaattggagaacagacactccgggtcggggcgattcttgttttgacatggtggctcgtcaaaagcggcttttccttatatgacgccggtgcaggggcggcctttggctcccttgtcggcggccttgcggcgtttttcattctcgccgtgttttgggccaagcgtgaaaagaaagccactgccgcccggatggaggccggtacgggtgatattttgaaacagctgtgtctgtattcggttacgatttgtaccgccggcctcatgctgattctcatccagctcgtcgacgcattgcacttgtattcattgctggccggacaaggaatgggcgaacttcaggcgaaacatacaaaaggagtgtatgacagggggcagccgcttttgcagctgggaaccgtttttgctgcgagcattgcgacggctcttgtcccgtcccttacgaaagcgaagaaaaagggagaaactgcagtgctggaggaaaagatccggtattcgctaaaaatgagctttgtcatcggcactggagcagccgccggtctgatttgtattttggagccggtcaatgtcatgctgtttaaaaacagcgatggaacggctgcgctccaaattttcagcgcgtcgattctctttgcatcgctggcgatgacgatgaccgctgttttgcaaggactcggcaatacatgtcttccggctgtttccgtctgctgcggctttttggtgaaagccgtattgaacgagctcctgatccccggtttcggcatttccggcgccgcttttgcgactatgatgtcattcgccgctgttgcggggctcaatttttttcagctgaaaagaaaaggctggattaagctgtcggaatacaggatagcgggtgttttgttgtcggctgtgatcatgtcggccgctctggcggtgtggctttttgcatttgaagcggccataccacataaaagcagatggatctcagcggcggaaagtcttagcgccgttttcgtcggcggcgttgtctttttgtccggtatcttcacattgcgcgtgttttcagaaaaagaacttgagcttgtgccttttggcagcaagctcctgacattaaaacgagaaaggggcggcaggcatggccggtaaaatcacggtagtcggccttggggcaggcgatatgaatcaattaaccctcggtgtatataaacggctcacacaagcggaggttctttatgtcaggacgaaagaccatccattaatagaagacctgaaaaaagaaatagcggagattcatttttttgatgaggtctatgaaaagcatgatcaattcgaagatgtttacgaggagatcgtagagcggctttttgaggaggcgaagcagggggatgtgctctatgccgttccaggccatccgttcgtcgctgaaaaaacggtccagcttttgcttgagaggcgtggggctcatcaggccgatgtcgtcgtcgagggaggccacagctttattgatgcgacgttaaatgctttgcagatcgatccgattgacgggtttcagtttgtcgatgccgtccggttttcagccgacgaagtcgagctccgtcatcatttgattatttgccaggtatatgatcaaatgacggcttcagaggtcaaactgacgttaatggaaaagcttcctgatgactatgaagtcgtcattgtaacagcggccggaagcagcatgcaagacattcggacagtgcctctttacgaattggacagaagcgtgggcatcaataatttaacgagcgtctatgtgccgcctgtcaaagacgaagagattctccaccaggaattttcgatgttccgcagtgtcatcagaaagctgcgcggaccggacggttgcccttgggaccgaaaacaaacccatgagtcgctcaaaaagtacttaatcgaggaatgctatgaggtgctagaggcgattgatgaagaagatcccgaccacttagtagaggagcttggcgatgtgatgctccaagttcttctgcatgcgcagatcggcgaggatgacggcctttttacaattgacgatgtgattcgcggcatcaccgcaaaaatgatcagaaggcatccgcacgtcttcggagaggtctctgttcgtgatgaggccgacgtcatggtaaactgggaagagatcaagaagcaggagaaacaagcggacgataaatccctcctcgacgatattccaaagccgcttcctgctttgtcaaaagcgaacaagcttcagaaaaaggcggcaaagaccgggttcgactggtcgaatgtccaggatatttgggataaagtccaggaggaaatgaaagaattttcttcagaaatttccgaagccgaacagcacagcaaaaaaatgaaagaagagttcggcgaccttttattcgcgctcgtcaatatcggccggttttataaaattgaaccggaagaagccctcgcgatgacaaacgccaagttttacagaaggttcacatatattgaacaatctgcaaagcgcatgggcaaggatctggaaagtatgacgcttgaagaaatggacgaactgtggaatgaagcgaaaggcattgaaaggagctgacaagcgatgagactcgacaaatttctcaaagtatcaaggctgattaaaagacggacgcttgcaaaagaagtggctgaccagggaagaatttcgatcaatggccagcaggccaaagcaagctctgttgtcaaagcgggggacgagcttgcggtgcgtttcggccaaaaacttgtaaccgtcaaagtcaatgaattgaaggatacgacaaaaaaagaagaagccgctgatatgtataccgttctcaaagaggagaagctgggaggagaataggcttgttctaaaaaaatcccccgtctcatacaatgcagtatcgaatctttagtatgaggatatgggggatgaatcgatgaatgtatattatgatcagcacaacccttccggcggggcatctggtcctgaacataatgtgacgatgaagggccgcaagcttctggatatatccggtgtcaagcaggtcgagagctttgacaacgaggaatttttacttgagacggtaatgggcatgcttgcagtcagaggcgaaaacctgcagatgaagaatctcgatgtggaaaaaggcgttgtctccatcaagggaagagtgcttgatctcgtctatttggatgagcagcagggggagaaagctaaaggattttttagcaagttgtttaaatgacgctgaccacacagttctatacgatgctggccatggccggaatgggggcatggcttggcgcttcccttgacacctatacccgttttgtcgttcgctcgaaaacagcaaggtggctgttgtttctccatgactttttgttttgggtagtacaaggcctcctttttttctatgttttgctgagcgtgaatgaaggggaattccgaatttatatctttctggcggtcatgcttggttttgccgcttatcagagcctttttaagcaggtctatatcaagcttttggaatggatgatttccttttttatattcatctccaggctggtctcaaagatgatgcggatgatggtgtttcggcctgttgtatggacgtttcaagccattttagccatcattctctttacaatgagaaatatctatgttctttttcgtttttttgcggtatgtttatataagatattaaaatttgcaggatacccgatttattttatactatatcaatgctgcaggcttcttcccgccccggttcggggattgttgagacgctttttgcaaaaaggagcaggatttttcgaaaaggggaagaaactattcataacaattaaggcaaaacttttaaaaaaatgaagggaggccgtctggaatgaatgatcctacaagacgcaacatatcgcaaatacagaacgaatacaaagagcagatggagcgaaaacagcagcagctgaaaagaaaaagacgcggtctatacagacggttgatggttttcggcgccgttgtgctgctgtcggcgattgtgattgtcagctcgctctggtcgcagacttcggatatcagcgcgaagcaagagaagaaagctgagcttttgaaacaattggaacagctggaagcaaaaaaatcggatttgaaagatgagattgtgaaattaaaggacgaggactacgttgcagagcttgccagaaaggattactacctctcaaaggatggcgaaatcatcttcaagtttgaagataagagcaagtagccttgttgacacttaattttttctttatgtataattaaacaaatgatcttttttaagtctaaggaggagcactttttttatgtcgattgaagttggcagcaagttgcaagggaaagtaacaggtattacaaatttcggagcgtttgttgaactgcctggaggatcaacaggtcttgttcatatcagcgaagtagccgataactacgtgaaggacattaatgatcatctgaaggtcggtgatcaagtagaagttaaagttattaatgttgagaaagatgggaaaatcggcttatcgatcaaaaaggctgtagaccgtcctcaatcatcaagacctgcgagacctaaaaatgatttccgctctaaagaaacgtttgaacagaaaatgaataagtttttaaaagacagtgaagatcgcttatcgtctctaaaacgcaacacggaatcaaaacgtggagggcgcggagcaagaagaggttaacttgctgctttctatataaacgaaaggcattcgtcttatcccaacggatgcctttttattttctaataaaatttttattaaaatttctattgacggatagggcaatcctttgtaatatagaacttgtgcgttaaaagaaatcaacaacatggcggtgtagctcagctggctagagcgtacggttcatacccgtgaggtcgggggttcgatcccctccgccgctacttatatgaaggcccgttggtcaagtggttaagacaccgccctttcacggcggtaacacgggttcgaatcccgtacgggtcattccggaaaccggcttcttctgaagccggttttttgctgcataaaaatatgcaaaataacgggaatggactcgacttatcaagagtgattgaagcatgctacaaaaagcgtcgaacagttctttgaattcgttaccttcttttgacaaaatcctatttcatctttcgctataatggcaagcaacgaataaacgagtgggagatgagagcatggaaaaagcggaaagaagagtgaacagcccaatagctggacctgctgttcaaaaattgtattcatggtttggcagcatgacgaagcttatgatgcagcatttatattccctctttttttataaagggctgatctatatggtcatcggttttttattgggacgagccttcattctgtcagaggtcattccctttgctcttccatttttcggagcgatgcttttaatcaaaaaagataaagctttccttgcatgcctggcgcttcttgccggagctctgagcatatcgcctcagcattcgctgttcgtgcttgcggctctgtttgcatttgcgatatgttcaaaaatgacgtcccttattataaaagaccgtgtcagaacgctgcctgtcgtcgtctttttggcgatggctgtgacaagatgcggattcgtatatgccgaatacggaacggtttcaggttatcactatattatggctttcgttgaagccggattatcgtttatcctcacattgatttttctgcaaagcctgccgattgtcacatcaaagcgggcgaaacagtcgctgaaaattgaagagatcatttgttttatgattttaatcgcttccgttctcacgggcttgacaggcgtttcatttcaaggcatgcaggctgaactgatattggcccgttatgtcgtgctcgctttcgcgttcatcggaggcgcaagcatcggctgtacagtcggggttgtgaccgggctgattctcagcctctcaaacatcggcaatttatatcagatgagcctgctggctttctcaggccttctcggcggtttgctaaaagaaggaaaaaagttcggcgcagcggtcggcttattgattggatctctattgatttctctgtacggagaaggttcggctgaattagtgccgacgctttatgaatctctgattgcaatcggcctgttccttttaacccctcagtcgattacgaaaaaagtggccaagtatatacctggaacgactgagcacgcccaggaacagcagcagtatgcaaggaaaatccgcgatgtcaccgcccaaaaagtcgatcagttttcgaacgtttttcacgctttatccgaaagcttcgctaccttttatcattcagctccggacgatgaaggaaaagaaaaagagatcgatctgtttttgagcacggtgacagaacattcctgtcagtcatgctataagaaaaacaagtgctgggttcagaactttgataaaacatatgatttgatgaaacgggttatgcaggaaacggaagaaaagcaatattttaaaaaccgcaagctgaaaaaggagtttcatcagcactgctccaaatcaaagcaagtagaagcgctgattgaagacgagctgactcattttagggcgaaccagacattaaaacaaaaggtgcatgacagcagacgtctcgttgcagagcagcttctcggcgtttctcaggttatggcggacttttctcgggaaataaaaagggaaagggagcagcattttattcaagaagagcaaattcgggatgcgctgcagcacttcggcatcgagattcagcaagtcgaaatatacagccttgagcagggaaacatcgatattgaaatgagtatcccgtattgcaacggccatggagagtgtgaaaaaatcatcgctccgatgctgtccgatattttggaagaacaaattatcgtcaaagcagaacagtgcgccggccatccgaatggatattgtcatgttgccttcggttcggcgaagtcatacagggtggtgacaggagccgcgcatgcagcaaaaggcggagggcttgtctccggcgacagctacaatatgatggagctcggcaccggcaaatatgccgccgccattagcgatggtatgggaaatggcgcaagggcccattttgaaagcaatgagacgatcaagctgctggaaaagattcttcagtcgggcatcgacgaaaaagtggcgattaaaacgattaacagcattctttcattaaggacaacagatgaaatttattcgacattggatttatcggtcatcgatcttcaggatgcgagctgcaagtttttgaaaatcggctccaccccgagctttattaaaagaggcgatcaaattataaaagtgcaggccagcaatctgccgatcggcatcattacagaattcgatgtcgatgttgtcagcgagcaattaaaagcgggagaccttttgatcatgatgagcgacggaatctttgaagggccgagacatgtggaaaatcatgatctgtggatgaagcgcaaattgaaatcgctgaaaaccgaggagccgcaggaaatcgccgacttaatcatggaagaagtgatccggacaaggtcgggtctgattgaggacgacatgacggtgattgtcatcaagctggaccataatacgccaaagtgggcctccattccggcgccggcttttttccaaaagaatcaagagatttcttagcattcgtataaatcaaatttcttctggcgatgatggaactaaatcaagatatctttgtccaggaggaataaaaacgatgaaaaaggggcatttgaatcaaatcctgcttttgacggacggctgttcaaaccgcggcgaagacccgcaggccatggctgcctttgcgaaagagcagggaattaccgtgaatgtgattgggattatggacgagcatgaaatggatcaggaggcgatgaaagaagtcgaagggatcgctctcgcaggcggaggagttcaccaggtggtttacacgtcgcagctgtcgcagaccgttcaaatggtgacaaaaaaggcgatgacgcaaacccttcaaggcgtggtcaacagtgagctcaaacaaattctcggcaagcataccgaaatggatgaactgcctcctgataaacgcggtgaagtcatggaagtcgttgacgagcttggtgagaccgtgcatcttcatgtactggttcttgtcgatacaagcgcaagcatgaatccgaagcttccgaccgttaaagaagcgttgatagatctttccatcagtctcaattcaagaatcggcgaaaacgaatttgcgatgcttatatttcccgggaaaaaacaagaggtcgaacttgtgctcgattggaccccgaagtttgaatctctttcttcaatattttccaagctttcagccggtggcattacaccgacaggacccgcaatacgagaggcgattcagcattttaacaaaatcggctcaagaaggagaatgttagaagacgatgaaaaacgcttcgacgagtttggcggctagtctaaagccgggtgcagccgttgttggaaagtggaacaatcattcctacaagatcatcagacagcttggaaaaggggcaaatggggttgtttatctggccgattcaagaaagggccgggttgcattaaaagtgagcgatgacagcctgtccattacctcggaagtgaatgttctgaaatctttctcaaaggcccaggcaaaagcaatggggccttctttttttgatgtggatgacatgatggttacaggcaccggcaaaaaactttcattttatgtcatggaatatattgaaggtccgcttcttttaagatatgtaaacgaaaaaggcgaggaatggactccggtgctgatcagccagcttctctcaagcctgtcggcgattcatcgcgaaggatgggtgtttggagatttaaagcccgagaatttaatcgtgacgggtcctccgccgcaaatccgctgcattgatgtgggcgggacgacaaaagagggccgggcaattaaggaatatacggagttttttgacagaggctattgggaattcggcactcgtaaggctgagccgtcgtatgacctgttttcagtcgccatgattatggtgaactgtgcggtgaaaaaagaattcaagaagacagcaaggcctcaggagcagctcatgtcagtcattgacggacatccgtttttaaaacggtataaaccggttcttgcttctgctttaaaaggaagctatcgaacagctgatgaaatgaagggagatcttctggaaatcggccggccgccacgaatgcaaagcagccgccagtcgagaacagcccgttcctcatcggcatctgccccgtcgcaaggcctgcggcataagcgggggacgcctcagcagcaaaggttaaggagcgggcgcagaaagcaaagaaacccttctaaatccggcggtgtttttgaaacgctgttgatcgtcgtaagcgttcttgccctttactttgcgtatatcgttctcttttttatttagctgtgcattctcggcggatagctcttctttgcagggaccgattgaaagtgttaggatatttatatcttttgaaatacaccctgctcttagtgggaggacattgtgaaaagtattgaagatttcatgaaaaaatacgaactgtcatttgatggagtgacgctgattgcaggtgtctccggcggacctgattcgatggcgcttttgcatgctctgcaccatacggttcccgcttctgcaacgctgattgccgcacacgtcgatcatatgttcagaggcgaagagtccgagcgtgatatgcggttcgttcaggactactgcgaggcggaaggcatacaatgcgaggcggtgcaaatcgatgtcctggcatttgccgctgaaaacaatctgaataaacaggctgctgcgagagaatgccggtatgcgttttttcaagagttaatgaaaaggcaccgggccgaatacctggttctgggtcatcatggagatgatcaggtggagacgatgctgatgaagatggcaaaaggcactgtcggaatcgggcttgccggaattcagccaaagcgccgttttgacagcggctggctgctcaggccgtttctgaagctgtcaaaggatgatcttttggcttactgcaaagagaatcgaataccgtttagaaccgatccgagcaacagtgaggatgattacaccaggaaccggttcaggcaccatgttctcccttttctgaagaaagagtcggaagatgtccataaaaggtttcaatccgtcagtgaattcctgacagaagacgaattatacttacaggcattaacgaaagacaaaatgaatacagtaatcacaagcaagtcaagttcaggcgtggaaatcagcatcgaacgacttcttgcgctccctatgcctttacaaagaaggggagttcatctaatattaaactatctttatgaaaacgttccatcagcgttttcagcccatcatattcaagtgtttctggattggatttcacaagacggaccatccggttcccttgattttccgaatgggttaaaagtcgcaaaatcttatcatacatgtttgtttacatttcagcgtttacaatgtgaaaatgtttcctatcattatgaaataagcggggcaggcgaagaagaactgatacttcccggcggctcctcccttcatgtgagcggacccggttcaacccggaagctgcaaggaaatgatgtttttgcaacaagtcccaagcaggttcagtttcccctttacgtacggacaaggcaaaacggagaccgagtcaaacttaaagggatgaacggctcaaaaaaggttaaagatatatttattgatgaaaaagtgcctctttcaaaaagagacagctggcccattgtaacagacgcggttggaaacattatctggatacctggtctgaaaaaaaccatttttgaggaacttgatgttacaaacaacgatcgcattgtattacaatatagacagcatgaaaagtgtagggggctagcaaagaatgaaacaggatattgaaaatatcttgatctcggaagaagagatccaaaagaaagtcaaggagctgggcgcgactctgacagaagagtacagcggcaagtttccgctggcaatcggtgtgttaaaaggagccatgccgtttatggctgatcttttaaagcatattgatacatatctggaaatggatttcatggatgtatcaagctacggcagttccacggtttcttccggagaggtgaaaatcataaaggatttggacacatctgtagagggccgtgacatcttaattattgaggatatcatcgacagtgggctgaccttgagttatcttgtagagcttttccgataccgcaaagcaaaatcgattaagatcgtaacccttcttgataaaccaagcggacgaaaagcggatatcaaagcggattacgtcggctttgaagttcccgatgctttcgttgtcggatacggtctcgattatgctgaacgctatcgtaatcttccgtacatcggagtgctgaaacctgcggtttatgagagctgatacgggcttgtcagcgaaagggatatctgttgtattggaacgattttctatgatactattgaacatagttgtgcttactgtgggaggaggtaaggaatgaatcgggtcttccgtaataccattttttatttacttattttattagttgtgatcggagttgtgagctacttccaaaccgcaaatccgaaaacagaaaatatgacgtatagtgactttgtttcaaacctagaaaacgggaaggttgaaaatgtctccatccagcctgtcaggggtgtgtacgaggttcgggggcagctgacgacctatgaaaaagatcagtatttcctgacccatgttcctgaaggaaaaggggcagatcaaatcattgatcaagtgaaaaaaacgaagatacaaatagaacctgcgcaagaagcaaatggatggatgacgttctttaccaccatcatcccttttgttattatcttcattcttttcttcttcctgcttaatcaggctcaaggcggcggcagccgtgttatgaactttggaaaaagcaaggcgaagctctatacagaagaaaagaaacgcgtcaaattcaaagatgtggcaggagcggatgaagaaaagcaagagcttgtggaagtcgttgatttcctcaaggatccccgcaaatttgccgagctcggtgcaagaattccgaaaggcgtgcttttggtcggacctccgggtaccggtaaaacattgctggcgaaagcatgtgccggtgaagcaggggtgcctttcttcagcatcagcggatctgacttcgttgaaatgttcgtcggggttggtgcatcacgtgttcgcgacttgtttgaaaacgccaagaaaaatgcgccgtgtctgattttcatcgatgagattgatgctgtcggacgccagcggggagcaggccttggcggaggtcacgatgaacgtgaacagacgctcaaccagcttcttgttgaaatggacggattcagcgccaatgaaggaatcatcatcatcgctgcgacaaaccgcgccgatattttagaccctgcattgctgcgcccgggacgttttgaccgtcaaattactgttgaccgcccggatgtcaaaggccgtgaagctgtacttcaagtacacgcaagaaacaagcctcttgatgaatccgtaaacctaaaagcgatcgcgatgcggacgccagggttctcgggtgcagaccttgaaaaccttttaaatgaagcggctcttgtggcggcgcgtcaagataagaaaaagatcgatatgcgagacatcgatgaagcgacagaccgcgtcatcgccggacctgcaaagaaaagcagggtgatctcgaaaaaagaacgcaatatcgtggcttatcacgaggcgggacacaccgttatcggacttgtcttggatgaggcggatatggtgcataaagtaacgattgtaccgcgcggccaagcaggcggatatgccgtcatgcttcctaaggaagaccgttatttccaaaccaaacccgaacttctcgataagattgtcggcttgcttggaggccgtgtagctgaggaaatcatcttcggcgaggtcagcacgggcgcccataatgacttccagcgcgctacaggcattgccagacgaatggtaaccgaattcggtatgtctgaaaagctcggtcctcttcaattcggacaatcgcaaggcgggcaagtattcttgggtcgagatttcaacaatgaccaaaactacagcgacgcgattgcgtatgaaatcgataaagaaatccagcgcttcattaaggaatgttatgaacgtgcaaaaacaatccttactgaaaatcgcgacaaacttgagctgatcgctcaaacattgctggaagttgaaacgctcgacgctgagcaaatcaagcatttgtctgagcacggaagacttcctgatcgaacatactctgatgatcaggagaagacagatgatgtgaaagtcaacatcaataaacgagatgacgaagagaaaaacgaggatgaaaaagagtaatgacgctttttcgtctcttcaggaaaactgccaagctctgcttttggcagttttctttttttatggctgaaaaaatccgctttggaaaatctttctcctcaccggtttgattcgtttacaaacagaatcggcatcgtgtattgtatgatggtagaatgttttatgtccaagtaagagaaactagtcaaaagtggtgatcagaatgttgcttgttatagatgtaggaaatacaaacaccgtccttggcatctaccacgaaggagagcttgaatatcattggcggattgagacaagccgccataaaacggaagacgaattcggcatgcttcttcgttctttatttgattatgtcggactgatgtttgaccagatcgaggggattattatttcatcagttgtaccaccgatcatgttctccctcgaaagaatgtgtatcaaatattttcagatcgagcctcagattgtcggtccgggaatgaaaacaggattaaacataaaatacgataatccgaaagaagtcggagcagaccgcattgtaaacgcagtagccgctattcatctctatggcagccccttgattgtcgttgattttggaaccgctacgacgtactgttacattaatgagcgcaaggaatatatgggtggtgcgatcgcgccgggcatcacgatttcaactgaagcgctttattcaagagctgccaagcttcccagaattgaaattgcacggcctgatcatatagtcggcaaaagtacggtcagcgcgatgcagtccggaattctttacggctatgtcggacaggttgaaggcattgtcaaacggatgaaatggcagtccaagaaaaatccgaaagtcatagcgacgggcggccttgcttccttgattgcagacgaatcggactgcatcgatattgttgacccgttccttacgttgaaggggctagagctcatttatgaacggaatcgtgttgaaagtgtataggaggatgaggtatggattatttagtgaaagccattgcatatgacggcaaagtgagggcatatgcagcgaatacaacagaaacgattcatgaagcccaaagaaggcataacacatggcctaccgcttccgccgctttaggaagaacgatgacggcggctgtcatgctcggcgccatgctgaaaggcgaagacaagctcaccgttaagattgaaggaggcggaccgatcggcgcgattgtcgctgacggaaatgcaaaaggagacgtcaggggatacgtgtccaatccgcacgttcatttcgacttaaatgaacacggcaaacttgacgtcagaagagccgtcggtacgtcaggaacgctaagcgtagtaaaagatctcggtctccgcgatttatttacaggccaggttgagatcgtttccggagaaatcggcgaggattttacttattatctcgtgtcctctgaacaggttccttcttcggtgggtgtaggggtgctcgtcaaccccgacaatacgattttagctgcaggcggatttatcctgcagctgctgccgggaacggacgacgaaaccatcacgaagcttgaaacaaacctttcacaagtggagccaatttcaaagctgattcagaaaggtttgacacctgaggaagtgctggctgcggtattgggagaagaaccggaagtactggaaaccgttcctgtccgatttacatgcaattgttcaaaagaacgtttcgcaagaggcatcatcggtcttggcaaggatgaaattcaacagatgattgatgaagatggccaagccgaggctcaatgccatttttgcaatgaaacgtatctgtttacaaaggaagagcttgaagcgcttcgagatgaaatataagcccgctatccagtagcgggtcttttacaatggggaaaggggagacaccatattgaaatcgagaacactttggccgattattttaggtgcgatcttcgtcaattgcattgtgatcgcgtatgttctgacgaaagcgcagaccgcttcttcatcgtcagctcaagaagtcattgcccatatcggaaaaaacggcatcacgcgtgaagaatggctgagcgaaatggaagagcgctacggaaaatcaacccttgaagatatgatcaacgaccgcgtagttacccaaatgccgaaaaaaacaagatcaaagtgtctgatgatgcatgaaagagaatttctgctgattaaagctgtatacaattccttctccgaagacgaaaacacaacagaaaaagaatggaaagagcagatcaagcataatattcttcttgaagagctcctgacaaaagacattgtcatttctgacagcgaattgaagtcattctataacaaaaataaggacttatataaattcgatgattcttatcgcctcaagcatatcgttgtcaaagataaagatgaagcagaacaagttcttaaagaactgaaggaagggtccagttttgaagcggccgcagccgaacactcgactgaccggtatacggctccttacggcggcgacctcggtttcgtcaatgatcagcatgaaaacgttccggccgaatatttggagaaagctgaacaactaaaggaaaatcaatgggtggatgaaccgattaaaacaagccagggctatgcgattatccagctcaaagaaaagctcccggggcaagctttcacttacagcgaagtgaaaaatcaaatcagaaggcagatcgcgatggatcaattaggcgacaaagcttctgtcaagacgctctggaaagatgcgaaactgtcttggttttatgacgataaaaaataaagattgacaaaatattttgatattgataaattagatataatcccaataaaattactcggaaattgaggtgttcaaatggttcgcgttgcaaactctgtttatgacttaatcggaaatacacctgtcgttaaattaaatcgactagttgatgaagacagtgctgaagtatatgtgaaactggagtatatgaaccctggaagcagcgtaaaagaccggattgcgcttgctatgatagaagacgctgaagagaaaggccttctgaaagaaggagatacactgattgaaccgacaagcggaaatacaggaatcggacttgccatggtcgctgcagcgaaaggcatcaaagcgattcttgttatgcctgatacaatgagttctgagcgccgcaaccttctgcgtgcatatggagctgagcttgtgctgactccaggtgctgagggaatgaaaggcgcgattaaaaaagcggaagaactggctgaggaacacggctattttatgcctcagcaatttaacaatcctgcgaacgcagaagttcaccgccgcacgacgggaaaagaaatcgctgaacaattcggagacggtttagatgctttcattgcaggtatcggaaccggcggaacgataacgggtgccggagaagttctgaaagaaaaaaatccgtccatcaagattttcgcggtggaaccgactgattctcctgttctttccggaggaaaaccagggccgcacaaaattcagggaatcggagcgggattcgttccgaaaatcttgaatacggaaatttacgatgaaatcatcacagtgaaaaacgaagaagcctttgaatttgcccgtaagcggcgagagaggaaggaattctcggaggatttcttcaggcgcagccatctgtgctgctcttcagttgctaaaaagcttggaaaaggcaaaaaagttctcgctgtgcttcctagtaacggagagagatacttaagcacgcctctttaccaatttgaataggctccagctgaaacaggaggctgccgacgatgtcggcggccttttgtttgtcatggagcgcagcccttttaaaagctcggtgtccttgagtgaacatgctcaagggcttttttctgtattggaaatgaaattctcttttcctagaaaaaagatatgcattacaataaggacattagactaacggcagaggaatgatatgatgagacaacgaaggcctgtagccagagcgttcccattttccaatcaacagtttttgcagcaatatgaaagcctatcgaaaggaaaagaataccacgttctgctggaaagcgcgagaggcggagaatacagcatagccggactcgaccctgtcgcaatagcgaaagggaaagacggtatcacgacgattcaatataaaggggacgtcatattcaaagagggggatccgtttctgcagttttctcaatggtttgaaacgctgaaaacggagacagttgcagattttcccgactttcagggcggggctgtcggttttcttagctatgactatgcccggtatattgagaaattcaaaatcctgtctattgatgatctgcaaacgccggatttattctttctcgtatttgatgatatagccgtctatgaccatgagcagcagcagctttgggtgattacccacactgatgaagaaacgccggccgctgcggaagagaaattggacaggcttgagcaaatgtggaagacggaacatccgaaggccgctggaggtcatcagccgaatgataacaaaggcccggcattcgcggcctcatttacagaagccggcttttctcaggctgttgagaaagtgaagcaatacatcgcaagcggtgacgtatttcaggtgaatctttctgttcgccagtcggagcgcctttctgcgcctccttatgaggtgtataagatgttaagagaaatcaacccttcgccgtacatggcctacttggaaaccccggattttcaaatcatctgcgggtcgcctgaactgctcattaagaaaaagggcaccaggcttgaaacaaggccgattgccggaacgcgatcccgcggggcggatgaagcggaggatgaagcgctcgcgaacgaattgatcatgaatgaaaaagagcgcgccgaacatgtgatgctcgttgatttagagcgtaatgacctcggcagggtctccaagtacggttcggtccgggtcgatgaattcatggtgattgagaagtattcccacgtcatgcatattgtctcaaatgtgtgcggtgaactaagggatgaatgcgatgccgttgatgtcatccatgccgtgtttcccggaggtacgatcaccggagcgccgaaagtcagaacgatggaaattattgaggagcttgagccaacgagacgggggctttatactggttctatagggtggttcggatataatcaggatatgcactttaatatcgtcatccgaacgatttatgtgaaagcgggccaggcgttcatgcagtcgggagcgggaatcgtcatcgattcaaatcctaggcatgaatataaagagtcaattaaaaaggccctggcgatgaaaaaggcgctgcagttgagtgaagaagagaaaaaagagcagaggagagctgagatatgattctaatgatcgacaattacgattcgtttacgtacaacttggttcagtatttaggcgagcttggcgaggagttggtcgtcaagcggaacgatgagatcacccttcaggaaatagaggacatgtcgcctgactttttgatgatttctcccgggccttgcagtccggatgaggccgggatcagccttgaagcgatccgccattttgccgggaagataccgattttcggggtttgcctcggacaccagtcgatcgcccaggttttcggcggcgatgtcgtcagggcagagcggctaatgcatgggaaaacttccgagatttcgcacgacgggctgacggtttttaaaggcctggaacatccgctcacggccacgaggtatcattctttgatcgtcaaaccggatacactgcccgattgttttgagacatcggcttggacggaagaaggggagattatggccatcaggcataaagaactgccggttgaaggcgttcagttccatccagagtcgattatgaccgcttacggaaaagagatgctgaagaattttattgagacttaccgaaagaaagtgaacgcatgatcatttacctgaacggtcaatatgtaaaggaggaggaagcaagactttctccttttgaccatggttttttatacggagtcggggtattcgaaacgttccggctttatgaagggaagcccttccttttagactggcatatggacagattgaacaacgctttggaacagctgaaaattgagcttgagctgacaaaaagcgaagtgcttgtcattcttgacaggctgcttcagttgaatcagccgcagaatctggatgcgagggtccggctaaatatatccgccggtcccggcggccccggcctttttcctgattcatacaaaaatcccggcgtcatggtgatgatgaatccttttcagcctgcatccgttccggctgaaaaggagggcgtcatcttgcaggtccgccgcaatacgccagagggtccgttccgcttgaaatcgcatcactttttaaataatttgtacggaaaaagggagctcggacatgacgcggccaaagaagggatttttcttaccgaaggcggagctgtagctgaaggaattatttccaacgttttttggcggaaaggcagctgtgtgtatacaccttctcttgataccggcatattaggcggtgtcacacgccgctacgtcatcgagcgccttgcagatatgggaatcgaagtcatagagggggtataccccttggaagagcttctctttgcggacgaagcatggatgaccaattccgttcaggaaatcgttccattccggagaatcggcagcactgaatttccgggaaaggatggaaatttgtcgaaacgtctgcaagaggcatacactaatgataggaaagcagcaaaagaatatttgagttaaagggtgaaggatatggcgcttcaaacagcggtgcgttcaaagcaactgatcgcaaagcaatacacgttgtcttatgaagataaaacattgatcatgggaattttaaatgtgacgcccgattctttttcagacggcggaaaatataacagcatcgatcgcgccgtcattcatgcaaaacaaatgatcgaagacggcgcccatatccttgatatcggaggagaatcgacgaggccgggggcggaaaaggtttctcttgatgaagagctgtcaagagtcatacctgtaattgaaaaacttgttcaggaaatcgacgtcccgatttccgttgacacttataaagcgcaagtggcagatgaagccattaaggccggtgcagccatcatcaatgatgtctggggagcaaaagcagatcctgacatggcccgagttgcggccgctcataatgtgccgattatcttgatgcataaccgcgaggaacggaattataaggatttgatcccggacatgctgtctgatttgatggaatgtgtgagcattgcaaaatcagcaggcgttcaggatcatcacatcgtacttgatcccggcatcggctttgccaaaacgtatcatgacaatttggcggtcatgaatcagctcgagaagttcagcgaaccgggatacccggttttattggggacgtcacgaaaaaaatttatcggccgagtcctggatctgccgcctgaagaaagagcggaaggcacgggggcgacagtatgcctcggtattcaaaaggggtgcgatatcgtcagggtgcatgacgtcaagcaaatctccaggatggcaaaaatgatggatgccatgattgataaaggaggcgtttatcatcgataaagtgcatgtagagggcatggagttttacggatatcacggtgttttcaaagaagaaaacaaactcggccagagattccgcgttgatctgacagcatttctagatttaagcgaagccgggaaaacggataatattgaggccaccattaattatgcagagctgtataagctgtgcaaagaggttgtggagggagagccggtcaaccttgtggagaccctcgcggaaacgattgccgcacaagtgctggagaattttgaagcggttcaggaatgtacggttaaagtcgtcaagcctgatcctcctatacctgggcactataaatcggtggccatcgagatgacgagaaagcgaaaatgaacaacacggcatatatagcgctcggctcgaatatcggccggcgggaagaatatttaaaaaaagctgtctctctcctccatcaacatccgtctgtagaggtgacagacatctcgtcaatttacgaaactgatcctgtcggttatacagaccaagatctatttttaaacatggctgcagctgttaaaacatctctttcaccgtttgaattgctcgatttgactcagcgtattgaaaaagaactcggccgcaaacgcgacattagatgggggccgaggactgcagaccttgacattttgttgtataatcgtgaaaatattgagacagagcaacttatcgttcctcatcctagaatgcatgaacgtttgtttgtactcatcccgctgctggagatttatccggatcttgagggagctgtcaatcatgcaaaaaatcaagaaggtgtaagagtatggaagcagaaatctggggtagacgaattcgtgcatatcgaaagctgaagggttatactcaagaagggtttgccaaagcattgggtatatccgtttctgtgcttggtgaagtagaacgcgggaatcgtatgccgacggagagcatgctcagggatgtagccaatactttaaatataacagtggaggaactatctccatcagaagaataagaaaggaggactaaaaatgtttaaaatcggtgatatagaattaaaaaacagggttgtgctcgcgccgatggccggtgtctgcaactcagccttccgcttgacggttaaggaattcggagcgggtttggtctgcgccgaaatggtcagcgataaggcgatcctttacaataatgcgaaaacgatgggaatgctttatatcgatgaacgtgaaaaaccgctcagcctgcagatcttcggcggagaaaaagaaacgcttgtcgaagcggcgaagtttgttgaccaaaacacaactgcggatattattgatataaacatgggatgtccagtgccaaagatcacaaaatgtgatgcaggagccaaatggctgcttgatccgaataaaatttatgaaatggtttcagctgtcgtggaggctgttgacaagcctgtgaccgtgaaaatgagaatgggttgggacgaagaccatatctttgctgttgagaatgcgagagctgtagaacgagcaggcggaaaagcggtcgctcttcacggacggacccgcgtgcaaatgtacgaaggaacggcgaactgggatattatcaaagaagtgaagcagtccgtttcaatccctgtaatcggaaacggtgatgtcaaaactccgcaagatgcaaaacgcatgcttgatgaaacaggggtggacggcgtcatgatcggccgtgcagcgctgggtaacccgtggatgatttaccgtacggttcactatttggaaacaggcgaattgaaagatgagccgaaagtgcgtgagaaaatttctgtctgcaaacttcaccttgaccgattaatcgggctgaaaggcgaaaatgttgcggttcgcgaaatgagaaagcacgcagcctggtatctaaaaggcataagaggaaacgcaaaggtccggaatgaaatcaaccattgcgaaacgagagatgagctcgttcagcttttagacgcgtttacgattgaagccgaggcaaaagagcttcaggatgcaaaagtaggataaatccgacctctgctcactgccagttttcactggcagtttttctgcttttttcctgaaagactaaaagtaacggagtgatatatgatgagccatgaagagcataaccatgaagaattaaacgaccagctgcaagtcagacgcgataaaatgaatcagttgagagaaagcggaaaagatcctttcggacagcgttttgatcgcacccatcaatcaactgatctcattgagtcgtataatgaattctcaaaagaagaattagaggaaaaagcaattgaagtaacgattgccggccggatgatgacaaagcgcggaaaagggaaagcgggattcgcgcatattcaggatttaaagggccagattcagatctatgtcagaaaagacagtgtcggtgaagagcagtacgaatggtttaaaagctctgacctcggggacatcgtcggcgttacaggcgtcatgtttaaaacgaatgtaggcgaattgtctgtaaaagcaacatcttttgatttattgacaaaagctcttcgtccgcttccggacaaatatcatggattaaaggacatcgagcagcgctaccgtcagcgttatttggatttgatcgtaaatccggaaagcaaaaatacgtttattacacgaagcaaaatcattcaatccatgagaagatacttagatgaccacggatacttagaagttgaaacgcctacgatgcacgcgattccgggtggcgcatctgcccgtccgttcattacacatcataatgcgctggatatgccgctttacatgaggatcgctatcgagctccatttgaaaaggctgatcgtcggcgggttggaaaaagtctatgaaatcggacgtgtattccgaaatgaaggggtctccacacggcacaatcctgaatttacgatgatcgaactttacgaagcttatgctgactataaggatattatgagattgacggaaaatctcattgctcatattgcacaagaagtgctcggcactacgaccgttcaatatggagattatgaagtcgacctcaagcctgaatggaagagactccatatggtcgatgctgttaaagaagccaccggtgtagacttctggaaagaagtatcggtagaagaagcaagagcatatgccaaagaacacggaattgaaatttctgaaggcatgtcagttggacatatcattaatgaattcttcgagcaaaaagttgaagaaacgttgattcagcctacttttatatacggacaccctgtggagatttctcctctggctaagaaaaatcctgaagaccctcgatttacggaccgttttgagctgtttatcgtgggccgtgagcacgcgaatgcatttactgaattaaatgatcctatcgaccaaaaagaacgctttgaagcgcaattaaaagaacgtgaagaaggaaacgatgaagcgcatatgatggatgaagactttgtcgaagcgctggagtacggaatgcctcctaccggcggccttggaatcggcatcgacagactgattatgcttttgacgaattctccttcaatcagggacgttttactattcccgcaaatgagacatcgttagttgactttcgtgcagcagccgcgtaacaagcggctgctgctcatttaaaacaaattaaattttttctcaaaaaagtattgcacaatcataaatacggtggtatattattattcgttgccgcaaaacggcggcgaaagaaaaaaagaacttgaaaaaaagttcttgacttaatatctgagattggatataatataaaagacgctttaataatgatcctttgaaaactaaacaagacaaaacgtacctgttaattcattaaataaatcgcacatgtaagtgtgcgtagtcattatcaaacttcatggagagtttgatcctggctcaggacgaacgctggcggcgtgcctaatacatgcaagtcgagcggaccgacgggagcttgctctcttaggtcagcggcggacgggtgagtaacacgtgggtaacctgcctgtaagactgggataactccgggaaaccggggctaataccggatgcttgattgaaccgcatggttccaatcataaaaggtggctttcagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaaggatattatacggaatataagaccttgcggtcttatagacaggtgcgtttggatcttgtttagttttgaaggatcattccttcaaagcgtgttctttgaaaactagataacgaaagtagacattcacattcaattgtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccactgctcgtaatggagcagtatccatatctgaattcataggatatgagaaggcagacccggggaactgaaacatctaagtacccggaggaagagaaagcaaatgcgattccctgagtagcggcgagcgaaacgggaacagcccaaaccaagaggcttgcctcttggggttgtaggacactctgtacggagttgcaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagtttgaaaagacggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaaagacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttgcgaacagtggtaggagagcgttctaagggctgtgaagcgagaccggaaggactcgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccgtaaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgctgcccttatcgggcagggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattcctataaggaagtaagatccctgaaagatgatcaggttgataggtctgaggtggaagtgtggcgacacatggagctgacagatactaatcgatcgaggacttaacctaaatatttgtgaatcgtctgtccgttatctagttttgagagaacacctctcagaaagccaaaggcaaggaaactcggctaaaggccctcacatcctgtgaggaacgcccagtaccttcgtcctgaaggcatagtttggtggcgatagcgaagaggtcacacccgttcccatgccgaacacggaagttaagctcttcagcgccgatggtagttgggggcttccccctgtgagagtaggacgccgccaagcgcttagaaagaccagcttatataaaagctggtcttttttcttttccctaaggttttatgacagctaaaagtggaaataataaaggacgagagcaattagtgaaaaaaaacgaaaaccacttatagtaaagttaaagtcaaatatagtcaaagtcaagtgaaggagggggctgagtggggaaaaatatttctgacataatcgaacagtatttgaaacaaatattagaacagaacgggaaagaaatattagagattaaacggagcgaaatagccgataaatttcagtgtgttccttctcagatcaattacgtaatcaatacgcgttttacgagcgagcgcggatatattgtcgaaagcaaaagaggcggcggcggttatatccgaattattaaaattaaaatgaacgacaaaattgatttgattaacaatattatgaatcaaatctatacaaggctctcccaggctgcttcagatgacatcattttaaggctgttagaaaatggtgtcattacagaaagcgaagcgaaattgatggtgagtgtcatggaccgttctgttttatatattgatttgcctgaacgagacgaattaagagcaagaatgatgaaagccatgcttacgtcacttaaatttaagtaaagcgggtgagaagcgtgatatgtcaagagtgtaaagaaagaccggcaacttttcactttacgaaagttattaatggtgaaaaaaaagaaatgcacatctgtgaacaatgtgcgaaagagaacagcgagtcatattctatgaatgaaagtggcggattttccatccataatttattatccggactgcttaattttgactcgtcttttacaaacagcagcgaggcgcagctttttcaacagccggatcaggttttgcgatgcaaaaaatgcaatatgacgttcccggaatttcgaaaaaccggccggtttggatgttcggaatgttataaaaccttccactcctatatcactccggttttaagaaaagttcacagcgggaacacggtccacgcgggtaaaataccaaagcggatcggcggtaatctgcatgtaagaagacaaattgaagcattaaaaaaagagctgaaagaattaattcagcaggaggaatttgaaaaagcagccaacatcagagatcagatcagatcgcttgaacaaaacctgaatgcaaacaaggaggaggaggactgatgtcactgcagcattttattcagaatgctttaagcaattggatgcggcaagaaggccctgagagtgacatcgtgcttagcagccggatccgtcttgcgcgcaatttggataaagtccgttttccaacgcttttttcaaatgaagaggcttcagcgattatagcattgtttgaagaacagttcacaggctatgaagtgcccggtatcgggaagtttgagcttgtgaaaatggatcaggtccagcctttggaaaaaagggttcttgtggaaaaacatctgatcagtccgcatttgacggaagcttcctttggcgcatgccttctttctgaaaatgaagaagtgagtattatgctgaatgaggaagatcatattcgcattcaatgtctatttccgggatttcagctgtcagaagcattgaaagcagcaaatcaggtggacgattggattgaagaccggatcgactacgctttttccgaacaaagaggctacttgaccagctgccctacaaatgtcggaacagggcttagagcttctgtcatgatgcaccttcctgctttagtgttaactaggcaaataaacagaattattccggcaattaatcaattagggcttgttgttagaggaatttacggtgaaggcagcgaagcattagggaatatctttcaaatttccaaccaaattaccctcggtaaatcggaacacgacattgtcgaagatctgaacagtgtcgttgctcagctgatcgaacaagagcgttcagcaagaaaggcgctttatcagacttcgcaaatcgaacttgaagaccgcgtctacagatcttacggcgtactgtccaattgccggatgatcgagtcgaaagaaacagcaagatgtctttcagacgttcgtcttggaattgacctggggataataaaaggtctttccagcaatatacttaatgagctgatgatcctgacacagcctggatttctccagcaatattccggaggagccttaaggccaaacgagagggacatcaggcgggctgctcttatcagggagcgcttgaaattagaaaacaacggcaatagacaggaggatgaaacgatatgatgtttggaagattcacagaaagagcacaaaaagtattggcgcttgctcaagaagaagctctgcgtctgggccataataacattggaacagaacatattctcctcggccttgtccgcgagggagaaggaattgctgcgaaagcgctgcaggcgttaggactcagccctgacaagattcaaaaagaagttgaaagcctcatcggccgcggacaagaaatgtcacaatcgatccattacacaccgagagccaagaaagtgaccgaattggcgatggatgaagcgagaaagcttggccactcctacgttggaactgaacacatcctccttggcttaatccgcgaaggggaaggtgttgcggcaagggtgctgaataatttaggcgtcagcttaaacaaagcgagacagcaagtattgcagctgttgggcagcaatgagagcggaggcgctgcttcaggcgccaacagtagcgccaacacaccaactttagacagtcttgcccgggatctcacggcgattgcaaaagaagacagccttgatcccgtgatcggcagaagcaaagaaattcaacgcgtgattgaagtgttgagccgcagaacgaaaaataaccctgtgttaatcggggagcctggtgtcggtaagactgcgattgccgaaggcctggcccagcagatcatcaataacgaagtaccggagattttacgcgacaagcgcgtcatgacacttgatatgggaacggttgtcgccggcacgaaatatcgcggtgaatttgaagaccgcctgaaaaaagtgatggacgaaattcgtcaagcgggaaatatcatcctcttcatcgatgagctgcatactctcatcggagccggaggagcggaaggggccatcgatgcctccaatatccttaaaccgtcgctggcgcgcggagagctgcaatgcatcggggcgacaacccttgatgaataccgcaaatacattgaaaaagatgctgcactagaacggcgttttcagccgattcaggttgaccagccgtctcctgaagaaagcattcaaatattgaaagggctcagagaccgctatgaagcccatcaccgcgtatcgattacggatgaagcgatcgaagcggcagtaaagctgtcagaccgctacatttcggaccgttttctgcctgacaaggcgatcgacttaatcgatgaagccggctcaaaggttagactgcgttcattcacaacgcctcctaacttaaaagagcttgaacaaaagcttgatgaggtaaggaaagaaaaagatgccgctgttcaaagccaggaattcgaaaaagcagcgtctttacgtgatacggagcagcgcttgcgtgaacaggtcgaagaaaccaagaaaacctggaaagaaaagcaaggtcaagaaaattccgaagtgaccgtcgacgatattgcaatggttgtatcaagctggaccggagtgccggtttccaaaattgcgcagaccgaaacagacaaattgctgaacatggagagcattcttcattcccgcgttatcggccaggatgaggctgtcgttgcagttgcaaaagcagtcagacgcgcgcgtgccggcttaaaagatccaaaacgtcctatcggttcgtttattttccttggcccaacaggcgtagggaaaacggagcttgcccgtgcacttgccgagtccattttcggcgatgaagaagcaatgattcgcatcgatatgtccgagtacatggaaaaacattcaacatcaagactcgtcggttcacctcctggatatgtcggctatgatgaaggcggacagctcactgaaaaagtgagaagaaaaccgtattccgtcgtcttgcttgatgaaatcgagaaagctcacccagatgtcttcaatattttgctgcaggtgcttgaagacggccgcctgactgattcaaaagggcgcacggttgactttaggaatacgattttgatcatgacatcaaacgtcggtgcgagcgaactgagaagaaataaatacgtcgggtttaatgtccaggatgaaacccagaattataaagatatgaaagacaaagtcatgggtgaactaaaacgcgcctttagacctgaatttatcaaccggattgatgagatcatcgtcttccactctttggagaaaaaacatttgaaagatattgtatccctcatgtcagaccaattgaccaagcgtctgaaagaacaggatctttcaattgagctgactgaagcggctaaagaaaaaatcgccgatgaaggcgtggatctcgaatacggagcgcgtcctctcagaagagcaatccaaaaacacgtggaagaccggctgtcagaagagctcctaaaaggccatattcaaaaaggccagcatattgttttggatgtagaagacggagaatttgtcgtaaaaaccgaagctaaaacgaactaatatagagacaaaagaaagaggcatacgatgttcatcagtatgcctcactttcttataaagggagcgttttgaaaaatcaatggctaaaacaaagactaaattcatttgtcactcatgcggctacgaatccgccaagtggatggggaaatgccccggatgcggtgcatggaataccatggtggaagaaacgataaaaaaacccgccgccaacagaagaaccgctttttcacattccgttcaaacggtgcaaaagccttcacctctcacttcaattgaaacaacagaagagccgcgaattaaaacgaaacttggcgaattcaaccgcgtcttgggaaacggcatcgtcaaaggttcacttgttttaatcggaggcgaccccggcatcgggaaatcaaccttgctgcttcaagtatctgcccagctcgctgattcaaaagaaaatgtcctgtacatctcaggcgaagaatcggtcaagcagacaaagctgagagcagaccgtctaggtatcaacagtcccactcttcacgttttatctgaaaccgatatggagtatattacgtcttctatagaagagatgaacccatcattcgtagtggttgattcgattcaaaccgtttaccaaagtgatatcacatccgctccgggcagcgtctcccaggtcagggaatgcaccgctgagctgatgagaattgcaaaaacgaaagggattccaatatttatcgtcgggcatgtcacaaaagaaggttcgattgccggaccgagacttctggaacatatggtcgacaccgtcctttactttgaaggtgagcggcatcatacatttcggattttaagagccgtcaaaaaccggtttggatcaacgaatgaaatgggaatctttgaaatgagggaagagggcctgacagaggtgctgaatccgtcagaaatctttctcgaagagcgctcggcgggagcggccggatcgagtgtcgtggcctcaatggaaggcacgaggccagtcttagtagagattcaggcgctgatttcccccacgagctttgggaatccgcgccggatggcaaccgggattgatcataaccgcgtctcattgctaatggcagttttagaaaaaagggttggactgctgctgcaaaatcaagacgcctatttaaaagtcgccggaggcgtcaagctggacgagccagcgattgacctcgccgttgcagtgagcatcgcctcaagcttcagagacaccccgcctcatccgacggattgttttatcggagaagtcggattgacaggggaggtccgcagagtatcaaggatagaacagagggtgcaggaagcggcgaagcttggttttaaaagaatgattattccttctgcaaatgtagaaggatggacaaagccgaaaggaatcgaagtcgtcggcgttgaaaatgtagctgaggcccttcgagcttcattaggaggatcataatatatggacaaagacaaaaaaggagcgaaacaggatctttcagaaatattgcagtttgtcgcccccggcacgcctcttcgcgaaggaatcgaaaacgtccttcgggccaaaacaggcggattaatcgtggtcggcttcaacgataaagtgaaagaagtggttgacggagggttccacataaattcttctttctctccggctcatctgtacgagctggctaaaatggacggggcgatcattctcagcgattcagggcaaaaaattctatatgccaatacacagctcatgcctgaggcgacgattccctcctctgagacgggcatgagacacagaacagccgagcgtgtggccaagcagaccggctgtctgatcatcgcgatttctgaaagacggaatgtgattacgctctatcaggaaaatatgaaatatatactcaaagatatcggctttatcttaacaaaagccaatcaggcgattcagacgctcgaaaaatacaaactcattttggaccatgcgatttccaatttgaacgcgctggaatttgaagagcttgttacatttggggatgtcatctccgttctgcatcgatatgaaatggtgctcagaatcaaaaacgaaattaatatgtatattaaagagcttggaacagaaggccatctcatcagactccaggttagcgaactgatcaccgatatggagcaggaagcggcgctgttcgtcaaagattatgtgaaagaaaaaatcaaagacccgtttgttctgctgaaacagcttcaggatatgtcgagtttcgaattgctggatgatgcgattctccttaagcttttaggctattcagcaactacgaacatggaagaatacgtttttccgagaggctacaggcttctccacaaaattccccgcctcccgatgccgatcgtcgaaaatgttgtcgaagcattcggccatttaaagctcattatcgaagcggatgtaaaagatttggatgaagtggaaggaattggggctgttcgtgcccaaaagataaagaaagggttaaagagacttcaggagaaacattatactgacaggcagctgtgagaaaattttctagaagtgattaaaatttgcaatttatgggtatattattcttactttttgttttccctttttcacgtggaaacagctgcatttataaaaattaaaacgattattttaaaggaggtgaaggtatgttaaaacgaatagttcaagcgttctttgcgattttgggaggcgttatcggtatttttctcataccggaattgtttgtactgttaaatgtacaggacatacctttagtaacaaacccgtatgcgtctgcttgtttaggagctatcatcttttttcttctgggcatctggtgtgcggatcacgtcatcaactgggtgaaacagattgaggattccttgatcaaagcacctgtctcagacttgttgttcggctctttgggattaatcttcggacttatgctcgcttatcttatcgtcaacgtcattccgttaaaagacatcccttatcagttaatcagcacggtcattccgattgtgttggccgcatttctcggctatctcggattccgtgtgggtttcaagaaaaaggatgaaatgctgacactttttacatcgagaaagaaaaaaggttctgctgaggaagagcgtccggaagaagacaaaaagctgaaaattttagacacaagtgttattatagatgggagaattgctgatatttgtcagaccggatttcttgaaggcgtcattgtgattcctcagtttgtgcttgaggaactgcagcatatcgccgactcttcagacgtcctcaaacgaaacagagggcggagaggactggatattttaaaccgtatccagaaagagcttgatattaaagttgaaatttatgaaggcgattttgaagacatccaagaggtcgacagcaagctcgtcaaactggcgaagctgacctcgggcgttgtcgtcacaaacgatttcaatttgaacaaagtatgcgagctccaaaaggttgccgtattgaacatcaacgaccttgccaacgccgtcaagcctgtcgtgcttccgggagaagaaatgaaggtgcaggtcatcaaagacggaaaagaacataatcagggcgtggcttatctggacgacggcacgatgattgtcgttgaagaagggcgaaattatattggcaaacatatcgacgtgctcgtgaccagcgtgctgcagacagcggcaggcagaatgatattcgccaagccgaaactgctggaaaaggcgctttgaaaaagggagaaataaaatgaattatgaagtcgtcattcctgccgccggacaaggtaaacgaatgaatgccgggaaaaacaaactgtttatcgaggcgaaaggaatacctgtgattattcatacattaaaggtgtttgaaaaccatgatgcctgcaaaaggatcattcttgtcatcaatgaacaggaattcggtgaattcaacacccttttaaaaacctatcattttaagactccgatcgagatggtgccgggcggaagagaacgccagcaaagcgtttttgcgggcattaaagcggccggcaaagaggaaacggtcctcgtccatgacggagcaagaccttttattaaacgggaatatatcgaacagcttgtcgagaaagcaaaggaaacaggggcagccatcgttgccgttcctgttaaagacacgatcaaacgcgttcaagacggtgagatagccggaacgattgaacgttcaagcttgtgggccgctcaaaccccacaagcttttcgtctttctattctgatgaatgctcaccttgaggctgaagcaaaaggtttcctcggtacggacgacgccagtcttgtcgaggaagccggaggtacggttgcaatcattcaaggggattatcaaaacatcaaactgacgaccccggatgacttgcttgtcgcagaagcgatattagaagcggaaaagaggaatgaacatgtttagaataggccaaggatttgacgtccatcaactagtggaaggcaggccgctcataatcgggggaattacgattccttacgaaaaaggccttctcggacattcagatgcagatgtgcttttgcacacgattgcggatgcatgtctcggtgccgtcggcgagggcgatatcggaaaacactttccggataccgatcctgaattcaaagatgccgactccttcaaactccttcgccacgtctggatgatcgtgaaggaaaaaggctatacgctagggaacctggattgtacaatcatcgcccaaaagcctaaaatggcgccgtatatcgaagacatgagagccagaattgccgaagggctagaggcggaaatttcccaaattaacgtaaaagcgaccacaaccgaaaagctcggatttacgggaagagccgaaggaatcgccgcccaggcttccgttctgctccaaaaggtataattcattttgaagacaggttcatttgatgatagaataggaaataaatttgaactctgctagagacgaaaggaagttagacagatgggaaacgaagttcgggttcgttatgcgccgagcccaacaggccatttacatatcggaaatgccagaaccgctctttttaattatttgtttgcccggagccaaggcggaaaattcatcatccgcattgaagatacggaccgcaagcgcaacattgaaggcggggagcaaagccagctgaactatttaaaatggctgggcatcgactgggatgaaagcgtggatgtcggaggagaatacggaccataccgccaatccgaaagaaacgacatttacaaaacatattacgaggagcttcttgaaaaagggctagcctacaaatgctactgcacggaagaagagcttgagaaagagcgtgaggaacaggctgcccgcggagaaatgccgcgctactccggcaagtgccgcaatttaacaaaagaagagcaggaaaagctcgaagctgaaggaagacagccgagcatccgctttaaagtgcctcaaggtgaagtcatccgctttgatgacatcgtcaaaggagaaatttcttttgaaacagacggaatcggcgacttcgtcatcgtgaagaaagacggaacgcctacttacaactttgccgtagcggtcgatgactatttaatgaaaatgacgcatgtcctgcgcggcgaagaccacatttccaatacgccaaagcagatcatgatttacaacgcccttggctgggatatcccggcatttggacatatgacattaatcgtcaatgaaagccgcaaaaaactgagcaaacgtgatgagtccatcattcagtttatcgagcagtacgaagagctcggctatttgccggaagcattgtttaacttcatcactcttctaggctggtcgccggtcggagaagaagaactgtttacaaaagaacagtttattgagatatttgatgtaaaccgtttgtcaaaatcaccagcggtgtttgatacgcataaactgaaatgggtcaacaaccagtatgtgaaaaaacttgatcttgatcaggtcatcgaattgaccgtgccgcatttgcaaaaagcgggcaaggtttcagaagagctttcaggcagcgaacaggaatgggtgcgcaagctgatttccctatatcaggaacagctgagctacggcgctgaaatcgtcgagttaacagagttgttctttaaagacgatatccagtataatcgtgaagcaagaacagttttagaagaagagcaggttccggaagtgcttcgcgtatttgccgaaaagcttgagcagcttgactcgtttacggcagatgagatcaaggcatccatcaaagccgttcaaaaagaaacaggacataaagggaaaaagctgtttatgccgatccgcgtagcgacgacaggccagacccacggtcctgaactgcctcagtccattgaattattggggaaagacaccgttttaaaacggctgcataacattattcaataagataaatcgttgacagggataagtataaagccagggcctttaaagagagagtcttcatcggctggaaaagacttaagcgccgggctttagaaatgcacctcttgagacctttgaagaacgtttttataacaagtattcaaaggcggtatccgccgttatggatgagagttgagaaaacagctgtgctgttttctaaacagagtggaaccgcgcgtcaaaaagcgtctctgtcatcagacagaggcgttttttatatggtttgacaatagagacaaaggaagcggggaacggggggaatcatgtgttctttaaaatgctgaaagaagatgtagatgtcgtatttgaccaagatccggctgcgagaagctacattgaagtcatcttaacttattcaggtttgcatgctatatgggcacatcgaattgcacatgctttatataaaagaaaaaggtttttcatcgccagagcgatctctcaaatcgcccgcttctttacgggaatcgaaattcacccgggtgccaagatcggcaggagatttttcattgatcacggcatgggggttgtgatcggcgaaacctgtgagatcggaaacaatgtcacggtttttcagggcgtgacgcttgggggaacaggaaaagaaaaaggcaaaaggcatccgacaatcgaggacgatgccctgatctcaacaggggctaaagtgcttggatccattacagtcggaagaggggcgaaaatcggtgcaggctccgtcgtcctgcacgatgtgcctgaatgctccaccgttgtcggcatcccgggccgggtcgtcgtacaaaacggaaagaaaatcagacgcgacttgaatcaccaggatttgccggatccggtggctgaccgcttcagagaattggaaaacgaaatcaggcagctgaaacaagagctccggagaaaagaaagggaagatgagctgtgacactaacattgtataatactctcacacgaaaaaaagagccgtttgtgcctcttgaagaaggcaaggtcaaaatgtatgtgtgcggtccgacagtatataactacatccatatcggaaacgcaaggccggctatcgtgtttgacactgtcagaaagtatttagagtataaaggctatgaagtccaatatgtctccaattttacagatgtcgatgacaaattaattaaagcggcaaatgaacttggagaggaagtgccggtcatcgccgaacgctttattaaggcatacttcgaagatgtcggttcactgggctgcacaaaagctgactgccatccgcgcgtcactgaaaacatggatgagatcatcgactttattcagacgctgatcgataagggctatgcctatgaggcggacggagatgtttattataaaacaagatcgtttgaaggctatggaaagctgtcgcatcaatcggtcgatgagctgagatcaggcgcccgaattcaagtgggcgaaaagaaagaagatgcgctcgattttacactatggaaagcggctaaagataacgaaatctcctgggatagcccttggggaaaaggccgtcccggctggcatatcgagtgctctgcgatggcgagaaaatatctgggcgattcgatcgacattcacgccggcggtcaggatctggccttcccgcatcatgaaaacgaaattgcccaatcggaagcattaacagggaagcctttcgcgaaatattggcttcataacggctacattaatatcgataatgagaaaatgtcaaaatcgctcggcaactttgttcttgtgcatgacattattaaagagcatgacccccaagtgctgcggtttttcatgctgtctgttcattacagacatccgataaactattcggtcgaacttctcgagaacacaaaaaacgcttttggacgtctaaaaacagcttatagcaatttgcagcatcgcctaaaaagcagtacaaatttaacagagggcgattcagaatggcttgaaaaaatcgaagagcagcgaaaagccttccaaacggctatggatgatgatttcaatacagcgaatgccatttccgtcctgtttgacctggccaaacatgccaactactatttgcaggaaaagaatactgcagaacatgtcattcaggcgtttatacagctgtttgacgagatctgctcagtgctcggcttctccctcaaggaacaggaacttttggataaagacattgaagaactgatcgagaagcggaatgaggcccggagaaaccgcgactttgcaacatctgatcagattcgcgaccagttgaaaagcatgaatattatcttggaggacactccgcagggcacgcgctggaaaagaggagaatcataaacatgaatttggaaaccattaaagacgccaaacagctgaatggtttggcgcttgcttacatgggtgatgccgttttggaggtatatgtgaggcatcacctcttaaagcaaggcatgacaaggcccaatgatctgcaccggcagtcgaggcgatatgtctccgccaagtcgcaggcaagcatgctgtttgcgcttgaggagcaggaatttttcaccgaggaagaacaggctgtgctgagaagagggcggaatgccaaatccggaacggtaccgaaaaacacggatgtccaaacatatcgttacagtacggcttttgaggcggtcatcgggtatctttttcttgagaacagggaagataggcttaatgaactcatcaaagcagcgctggaaaaacgggatggcagggaggaagtaaaatgagtcagcagcatgattacgtcataggaaaaaacgcggtcatcgaaacattaaagtccggccgggaattgtataagctgtggatggcggaaaacacagtgaagggacaggctcagcaagtcgtcgatctcgccgccaaaaatggcgtcacgattcattatgtcccaagaaaaaaactcgatcaaatggtttccggacagcatcaaggcgtcgtcgcccaggtagcggcttacgagtatgccgagctggatgatctttttcaaaaggccgaagacagaaatgaacagccgtttatccttgtattagacgaaattgaggatccgcacaacctgggctctattatgcgcaccgcagacgcggtcggggctcacggcatcgtcattccgaaaaggcgcgcggtcggccttacaacgactgtcgccaaagcctcgacaggagccatcgaacatattccggtcgtcaaggtgaccaatctgtcgcggaccctggaagaaatgaagggacggggcatttgggtcgtcggtaccgatgcgtctggacaacaggactacaggtcgctggacggaaatatgccgcttgcgcttgtcatcggcagcgaaggaaaaggcatgggaaggcttgttaaagagaaatgtgattttctcattcgcctgccgatggcgggaaaggtcacatccctgaacgcctcagttgcagccggcctgctgatgtatgaagtgtaccggaaacgaagccctctgggagaatagacggaatggacatcctgttggtcgacggttataacatgattggggcttggcctcagctgaaagatttaaaagaaaacagttttgaagaagcaagggacctgttgattcagaagatggcggaatatcaatcgtatacagggtttcgggtaatcgttgtctttgatgcgcatctcgttaaaggaatcgagaaaaagaaggtcaatcatcgcgtagaagtgatattcacaagggaaaatgaaacggctgatgaacggatcgagaaactggtgtcagacttgaatagtattcagacgcagatccatgttgccacatccgattacacagagcagtgggcgatttttggccagggggccctgcgcaaatcggccagagagctgctcagggaggtcgaagcgatcgaaaggcaaattgaaaacagggtgaaacaaatcacctcagagcgtcccgcagggaaaattccattgtcagaagacgtcttgaggatcttcgaaaaatggcggcgtggcgacttggattaggttgacgcttttttgtccattactgtataatatttctatctacgtgcggtcggggggatcggagtgaacttacaaaacaaccagggaaaattcagcaaagaacagttcagcaaagaacgtttttgccagttggaagacgagcaggtcattgaaatggttcatgtcggagacagtgatgcgttagattacttgattacaaagtaccgtaattttgtaagggcaaaagcaagatcctacttcttaatcggggctgatcgggaagatatcgttcaggaaggcatgattggactctacaaatctatccgtgattttagagaggacaagctgacttcattcaaagcttttgcagaattatgcattacccgccaaattattaccgctatcaaaacagctactcgccagaaacatattccgctcaattcttatgtgtcgctggacaagcccatttatgacgaggaatcagaccggacgcttctcgacgtgatttcaggggccaaggtcatgaatcctgaagagctgatcatcaatcaggaagaattcgatgatatcgagctgaaaatgggagaattgcttagtgatttagaaagaaaagttcttgcgctctatctcgacggaagatcctatcaggaaatatccgaagaattaaaccgccatgtaaaatcgatcgataatgcgctccagcgtgtcaaaaggaagcttgaaaagtacctggagctccgcgaaatcagcttgtagccgatgcttatggcatattgacagtcattttatgactgtgatatgttacttaggaaatgaacgtccagaaaaaggtgtaaacatgaagaaaaaagtaacgttagcctgcaaaaattgcggaaatcgtaattatacgacaatgaaaagctccgcagctttggctgaacggctcgaagtaaagaaatactgcaataactgcaattcacatacagtacatctggaaacaaaataggtgtttttgtttttaggttgtggaggtttcttaccatgggtattatcaaatttttaaagaatgtcggaaaagaaatgaaaaaggtcacctggcctaaaggaaaagaactaacgcgctatacgatcactgttatcaccaccgttatctttttcgccatcttttttgcactcatcgattcgggtattacgcaattaattcgtttaatagttgaataatgatcagcataacgtgttataatagatctaaatatgacttgccaaaaaacccgttcaacggttttttcattgtttcaaaatatgaggctcgtataaaagaaagtgtcagtttcccggtacggccaataaacttttaaggtgtggggagggaaggactgaaagggtcctgaatgagaatggaaaagaaatggtatgtggttcatacgtactccggctatgaaaataaagtaaaggcgaatttggaaaagcgggtagaatcgatggggatgcaagataagatattccgcgtcgttgtacctgaagaggaagaaaccgatattaaaaacggcaagaaaaaagtcgttaaaaagaaagtcttccctggttatgtacttgtcgaacttgtcatgacggatgattcctggtatgttgttcgaaatacgcctggtgtgaccgggtttgtcggttcagccggatcaggttcaaagccgactgcactgcttccgggcgaagcggaaaaaatcctgaagcggatggggcttgaagaaagaaaaacagaaatcgactttgaattaaaagaaaccgtcaagttatcgacggcccgtttgctgatttcacagggacgatcgaagagatcgaccacgacaaaaataaagtcaaagtttttgttaatatgttcggaagagagaccccggttgagctcgaatttactcaagttgacaaattgtaatggaaaagcgcttgaaatcactatataaaagtggtaatatacaaaggtgcgtcttggcaaaaaggtcaaggcagctagcttgatattttcatcattcatataaagaatgagaccttgagtgggagggttcaccctattaccacatcacggacttaaggaggtgtgtctcgtggctaaaaaagtagttaaagttgtaaaattgcaaattcctgctggaaaagcgaatccagctccgccagttggtcctgcgttaggtcaagccggtgttaacatcatgggattctgtaaggagtttaacgctcgtacatctgaccaagctggtctgatcattcctgtagaaatttcggtttacgaagaccgttcatttacatttatcacaaaaactccgcctgctgctgtattgcttaaaaaagcggctggaattgagtcaggttctggtgagcctaaccgtaataaagtcgcaaccgttaaacgcgataaagtacgtgaaatcgccgaaacaaaaatgcctgacttaaatgcggcagatgttgaagcggctatgcgtatggttgaaggaactgcccgcagtatgggtattgtgatcgaagactaatttttgtctctttgctgggttgcgagtttggatcagacaagttcgcaacccttattcgtgggaggttattccgctaaaaccactaaggaggaaattttaaaatggctaaaaaaggtaaaaaatacgtcgaagctgccaagcttgtagatcgtacaaaagcttacgacgtaaacgaagcgattgagcttgtgaaaaaaacaaacacagctaaattcgatgctactgttgaagcggcatttcgtttaggtgttgaccctcgtaaaaacgaccagcaaatccgcggtgcagttgtacttccaaacggaacaggcaaaactcagcgcgttcttgttttcgctaaaggtgaaaaagcgaaagaagcagaagctgctggtgcagactacgtaggcgatgcagattacatcaacaaaattcagcaaggctggtttgattttgatgtgatcgttgcgactcctgacatgatgggtgaagtcggtaaaatcggacgcgtgcttggaccaaaaggtcttatgccaaaccctaaaacaggaacggttacatttgaagttgaaaaagcagtcaacgaaatcaaagcgggtaaagttgaataccgcgttgataaagcaggaaacatccacgttccaatcggaaaagtgtctttcgaagaaggcaagcttgtagagaacttcgcgacaatgtacgacacaattttgaaagcgaagcctgctgctgctaaaggtgtatacgtgaaaaacgtttctgttacatctacaatgggacctggaatcaaagtggacccttcaactttcaacgtaaaataatattgacttttgataagacgttctgatataattcaaaacgttgtaaaaataaaatatgtccatttataccgtagacagtaggtgctgataaggcttaatttcctaccgaggtgtatatatatcacagctctagcgttacgtatgcttgtatatacagcctccatgtcgaatggaggctttttatatggaacatgtcgttaaagaacgtgatcaccgaacggtataagtgttacacagatgaatcttacaggaggtgtaaccatgagcagcgcaattgaaacaaaaaaagttgttgttgaagaaattacttctaaactgaaagaaagtaaatcaacgatcatcgttgactatcgcggccttaacgtagctgaagtaacagaacttcgtaaacagcttcgcgaagctaacgttgagttcaaagtgtacaaaaacacgatgactcgccgtgcggttgaacaagctgaacttgatggtttgaacgatttcttaacaggaccgaatgcgattgcattcagcactgaagatgttgtcgctccagctaaagttcttaacgagtttgctaaaaagcacgaagctcttgaaatcaaagcgggcgtaatcgaaggcaaagtgtccacagttgaagaagtgaaagctcttgctgaacttccatctcgcgaaggcttgctttctatgttgcttagcgtacttcaagctccagttcgcaatcttgctcttgcaactaaagctgttgcagaacaaaaggaagaacaaggcgcttaatagcatcagtatctaaaaaataaaacaaaatggaggaattacaaatggctttaaatatcgaagaaatcattgcttccgttaaagaagcaactgtacttgaactgaacgacttagtaaaagcaatcgaagaagaattcggcgtaactgctgctgctcctgtagctgtagctggcggagctgctgcaggcggtgctgctgaagaaaaaactgaatttgatcttgttcttgctggtgcaggagatcaaaaaatcaaagttatcaaagttgttcgtgaaatcactggtcttggcttgaaagaagctaaagaacttgttgacaacactccaaaacctcttaaagaaggtattgcgaaagaagaagctgaagagcttaaagctaaacttgaagaagttggcgcttctgtagaagttaagtaatcttcacctaatctttaggggaaagctcgcttttaaaagcgggctttttctttgctaattaattgtagccccttccgcataagataagccatcttgtttcaagatatctggagagttcaccaactgaggaggttctgtgatgactgaccattattattcggaaaaaccttcagcaaaaagcagcagatcaatgtgggcatttcgcttgagaaaccggacgtttacttttatcagcgacagcggagttttttcaaaaagagaagtggactttggctcaaggctgctgattgaagctttccgggaaccggatgcagaaggtgattttttggatgtaggctgcggctatggcccgattggtctttcgcttgctgcggatttcgaagatcgaatggttcacatgatcgatgttaatgaaagagctgtcgaactttcgaaggaaaacgcgttaaataatcagatcgacaacataaagatctaccagagtgatctgtttgccaacgtcgaacctgcaaaaaaattcgcttctattattactaatccccccatacgcgccgggaaaaaaactgtgcacgccatctttgaaaaaagcgctgaacatttgcggccttcaggagagctgtgggtcgtcattcagaaaaaacaaggcgggccttctgccattgaaaaattaaaagaactttttgcggacgttgaagtcgttcaaaaaaagaaagcgtactatatcatcaaagcaaaaaaagtttgactcggattttcagctatgttaacattataaaatgccaatgtatatattttgctgccgtttttaagaaacgcctaggtttgtataaaatatacattattgggaacactaataaaatcggtattttgtttttggatgtggttttctaaattagaaacccttttttcttttgtcttgtaaaagtatttcttacatatttgaggaagaaatgcttgttacacatatattacgcatgatttgaggggtgaatcagttgacaggtcaactagttcagtatggacgacaccgccagcgcagaagctatgcacgcattagcgaagtgttagaattaccaaatctcattgaaattcaaacctcttcttatcagtggtttcttgatgagggtcttagagagatgtttcaagacatatcgccaattgaggatttcactggtaacctctctctggaatttatcgactacagcttgggcgagcctaagtatccggtagaagaatcaaaagagcgggatgtgacctattcagctccgctgcgggttaaagtccgcttaatcaacaaagaaaccggcgaagtaaaggatcaggatgtcttcatgggcgatttccctattatgacagacactggaaccttcattatcaacggtgcagaacgggtcatcgtatctcagctcgttcgttctccaagtgtatattttagtggtaaagtagacaaaaacggtaagaaaggttttaccgcgactgtcattccaaaccgtggcgcatggttagaatacgagactgatgcgaaagatgttgtttacgtacgcatcgatcgcacacgtaagttgccggttacggttcttttgcgtgctcttggcttcggatctgaccaagagatcattgatctcatcggtgaaaacgagtatctgcgcaatacgcttgataaagataatacggaaaacaccgataaagcgcttcttgaaatctacgagcgtcttcgtccaggggagccgcctaccgtagaaaacgcaaaaagcctgcttgattcaaggttctttgatccgaaaagatatgaccttgcgagtgtaggacgttataaaattaataaaaagcttcacatcaaaaaccgactttttaatcagcggcttgctgaaacgctagtcgaccctgaaacaggcgaaatccttgccgaaaaaggagcgattttagacagaagaacgcttgataaagttctgccgtaccttgaaaacggaatcggttttaaaaagctttatccgaacggcggagttgtcgaagacgaagtaacgcttcagtctatcaaaatctatgctccgacagaccaagaaggggagcagacaatcaatgtgattggaaatgcttatatcgaagaaggcgttaagaatattacaccttctgatattatcgcttccatcagctatttctttaacctgcttcacggagtgggcgataccgacgatatcgaccatctaggaaaccgccgtctccgttcagtgggagagcttctgcaaaaccaattccgtattggtttaagcagaatggagcgcgttgttcgtgaaagaatgtctattcaagatacaaacacgatcacgccgcagcagctgatcaatattcgccctgtcatcgcatcaatcaaagagtttttcggaagctcgcagctttctcagtttatggatcagacgaatccgcttgctgagctgacgcataagcgccgtctgtcagcgctcggaccgggcggtttgactcgtgagcgcgccggaatggaagtccgtgacgttcactattcacactacggccggatgtgtccgattgaaacccctgagggtccaaacatcggcttgatcaactcgctttcttcattcgcgaaagtgaaccgtttcggcttcatcgaaacgccgtatcgccgcgtcgatcctgaaactggaaaagtaacgccgagaatcgattacttgacagctgatgaagaagacaactatgtcgttgcccaggcaaacgcacgcctgaatgatgacggttcttttgtggatgacagcatcgtcgcccgtttcagaggggagaacaccgttgttccgaaagaccgcgtcgactatatggacgtttcgcctaaacaggttgtctctgccgcgactgcatgtattcctttcttggaaaacgatgactcaaaccgcgcccttatgggagcgaacatgcaacgtcaggccgtacctcttatgcagcctgaatcgccgatcgtcggaaccgggatggaatatgtatctgcgaaagactccggtgccgctgttatttgccgccaccctggaatcgttgaacgggtggaagcgaagaacatctgggtgcgccgctatgaagaagtcgacggccagaaagtcaaagggaaccttgataaatacagcctgctgaagtttgtccgttccaaccagggaacttgctacaaccagcgtccgatcgtaagcgtcggtgatgaggttgaaaaaggtgaaattttagctgacggtccgtccatggaaaaaggtgagcttgcccttggacgcaacgtcatggtcggctttatgacatgggatggctacaactatgaggatgccatcatcatgagcgaacgccttgtaaaagacgacgtatacacgtctattcatattgaagaatacgaatcagaggcccgggatacaaaactcggacctgaagaaatcactcgcgatattccgaacgtcggtgaggacgctcttcgcaatctcgatgaacgcggaattatccgtgtcggtgctgaagtaaaagacggagatcttcttgttggtaaagtaacccctaaaggtgttacagagcttacggcggaagaacgcctgcttcatgccatcttcggggaaaaagcgcgtgaagtgcgtgatacgtcgctgcgtgtacctcacggaggcggcggtatcatccttgatgtaaaagtgttcaaccgcgaagacggagacgaactgcctccgggcgttaaccagctcgtccgcgtctacatcgttcagaagcgtaaaatttctgaaggggacaaaatggccggacgccacggtaacaaaggtgttatttcgaaaattcttccggaggaagatatgccgtatctgcctgacggaacgccgattgacatcatgttaaacccgctgggcgtaccatcgcgtatgaacatcgggcaggtgttggagctgcaccttggtatggctgcacgccgcctcggtctgcatgtcgcgtcacctgtatttgacggtgcccgcgaagaagatgtgtgggaaacccttgaagaagccggcatgtcaagagacgcaaaaaccgtcctttacgacggccgaactggggagccgtttgacaaccgggtttctgtcggcatcatgtacatgatcaaactggcacacatggttgacgacaaattgcacgcacgttcaaccggtccttactcactcgttacccagcagcctctcggaggtaaagcgcagttcggcggacagcgttttggagagatggaagtttgggcgcttgaagcttatggtgcagcatatacgctacaagagatcctgactgttaaatcggatgatgtcgtaggccgtgtgaaaacatatgaagccatcgtaaaaggcgacaatgttccagaacctggtgttccggaatcgttcaaagtattgatcaaagagcttcaaagcttaggtatggacgtcaaaattctatcaagcgacgaagaagaaatcgaaatgagagacttggaagacgacgaagacgcgaaacaaaacgaagggctttctctgccgaatgatgaagagtccgaagagttggtttctgctgacgcagaacgcgatgtcgttacaaaagaataaacgaattttatacgcaagtgacagggtataacccgaagataaaaagggaggtaggccccttgctggatgtgaacaattttgagtatatgaacatcggtctcgcttcacctgacaaaatccgttcatggtcttacggagaagtgaaaaagcctgaaacaatcaactatcgtactttgaaacctgaaaaagatggtctattctgcgagcgcattttcggtcctcaaaaggactgggaatgccactgcggaaagtacaagcgggttcgttataaaggcgtagtctgcgaccgttgtggagttgaagtaacccgggctaaagtccgtcgtgagagaatggggcatatcgagctggcagccccggtttctcacatctggtattttaaaggaattccgagccgtatgggtcttgtgctggatatgtctccgcgcgcattggaagaagtcatttactttgcttcttacgtcgtaacagatccggccaatacaccgctcgagaaaaaacagcttctttctgaaaaagagtatcgggcgtacctcgataaatacggaaataaattccaagcgtcaatgggtgctgaagcgattcataagctccttcaagatatcgacctcgataaagaagtggatatgctgaaagaagagcttaaaacgtcacaaggacagcgccgcacacgtgcgatcaaacgtctggaagtattggaagccttccgcaattccggaaataagccgtcatggatgatcctcgacgttcttccggtcattccgcctgagctgcgaccaatggtacagcttgacggtggacgttttgcaacttccgatctgaacgatttgtatcgccgcgtaatcaaccgtaacaatcgtttaaaacgtcttctggaccttggagcgccaagcattatcgttcaaaacgaaaagcgcatgcttcaggaagccgtggacgcattgatcgataacggacgcagaggacgtcctgttacaggtccaggaaacagaccgttaaaatccctttctcacatgctgaaaggtaaacaaggccgtttccgtcaaaaccttctcggtaaacgtgttgactactcaggacgttcggttatcgtcgtaggtccgaacctgaaaatgtatcaatgcggtcttccgaaagaaatggcgctggaactgttcaagccattcgtcatgaaagagcttgttgaaaagggccttgcccacaatattaagagcgcgaagcgtaaaattgagcgcgttcagccggaagtctgggatgtccttgaatcagttatcaaagaacaccctgtgcttctcaaccgtgcacctacgcttcacagattaggtattcaagcgtttgaaccaacgcttgttgaaggccgtgccatccgtcttcatccgcttgtatgtacggcatacaacgctgactttgacggtgaccaaatggcggttcacgttcctttatcagcagaagcgcaagctgaggcgcgcatccttatgcttgctgcgcaaaacatcctgaaccctaaagacggaaaaccggttgttacaccgtctcaggatatggtacttggaaactactatctgacgctagaacgccctggtgcagtcggcgaaggtatgattttcaaagatacggatgaagcgctgcttgcttaccaaaacggatatgttcatttgcatacgagagtagccgtcgcggttaactcattgaaaaatgaaacgtttaccgaagaacagcgttccaagctgctcattacaactgtcggaaaactgatcttcaacgaaattcttccgccgtcgttcccatacatgaacgaaccgacgaagagcaacattgaagaaaaaacgcctgaccgtttcttcttggattacggtgcagatgttaaagaagccattaagaaccaagaaatcaacccgccgttcaaaaaaggcattttgggtaaaatcattgcggagatcttcaaaaggttccatattacagaaacatcaaaaatgcttgaccgcatgaaaaacctcggctttaaatactctacaaaagccggaattacggtcggtgtttccgatatcgtcgtattggacgacaaacaggaaatccttgaagaagcgcaaggaaaagtcgataacgtgatgaagcagttcagacgcggtctgattactgaagaagagcgttatgaacgggtcatttccatctggagtgcagctaaggatacgatccaaggcaagctgatgaaatccttggatgaaatcaacccgatttacatgatgagtgattccggagcccggggtaacgcatcaaactttacgcagcttgcgggtatgcgcggtctgatggccaacccggccggacggatcatcgaacttccgatcaagtcaagtttccgtgaaggtttaacggtactcgagtactttatctctactcacggtgcgcgtaaaggtcttgcggatacggcccttaagacagccgactcaggttacctgacacgccgtctcgtagacgtagcccaagacgtcatcattcgtgagactgactgcggcacagaccgaggcattcttgccaaagccatcacggaaggcacagaagtgatcgagcgtcttgaagagcgtcttgtcggccgattcgcgagaaagcctgttaaacatccggaaacaggtgaagtgctcgtgaatgaaaacgagctgatcgacgaagataaagcgattgaaattgtcgaagcaggcattgaagaagtgtggatccgctccgcatttacatgtaatacgtcacatggtgtatgtaaacgatgctacggccgcaacctggcaacaggaaccgatgtcgaagtcggagaagcagtcggaatcatcgctgcccagtccattggtgagccgggtacacagttaacgatgcgtaccttccatacgggcggggttgccggagacgatattacacaaggtttgccgcgtatccaggaattgtttgaagcgcgaaaccctaaaggtcaagcgacgatctctgaaattgacggtgtcgtggccgaaatcaatgaggttcgcgataaacagcaggaaatcgtcgttcagggcgaagtcgaaagccgttcatatacggcgccttacaacgcgcgcttgaaagtcactgaaggagagaagatttctcgtggtcaagtgctgacagaaggttcggttgatccgaaagagcttctgaaagtcactgacatcaccacggtccaagaatacctgcttcatgaagtgcagaaggtttatcgtatgcagggggttgaaatcggagataagcacgtcgaggttatggttcgccagatgcttcgcaaagtgcgcgtcatcgatgccggcgacacggaagtgctgccaggcacgctgctcgatattcaccagtttacagaagcaaacaaaaaagttctgcttgaaggcaaacgccctgcaactggccgtccggtgcttctcggtatcaccaaagcatcgcttgaaacggattccttcctgtctgccgcgtcattccaggaaacaacacgtgtcctgacagatgcagcgatcaaaggaaaacgtgatgagcttctcggcctgaaagagaatgttatcatcggtaagcttgttcctgctggaacgggtatgctgaactatcgtaaagtgaagccggtattgcaagtccaatcatctgatgaaatggttccggctgaataaataaaaaatcctaaagaaggatgtcactaaaaattgtcatcatatgttgacatccttctttcaggatgataatataaccaaggtgctcaatttaaacctgttactttggaggatatatgatgtcttatgataaagtatcacaggctcaatctattattatcggtacgaagcagacagtcaaagcactgaagcgcaattctgttaaggaagtcgtcgtagcaaaggacgctgatccttgtctgacgtcaggtgttatcaatctggcaaatgaacaaggggttccagtctcaatggcagagtccatgaaaaagctcggcaaagcctgcggaattgaagtcggagctgcagctgttgccattattcaataacgtactcgttgtttttgcttttatgcaaaggcattgttttttgcttttaaatgaaccacctgggtatgtgggttataaaacgtaatgaagggaggaaatacaaaatgcctacaattaatcagctagtccgcaaaggacgcgtaagcaaagttgaaacttctaagtctccagcacttaacaaaggatacaacagcttcaagaaagagcacactaacgtatcttcaccacaaaaacgcggagtatgtacccgtgttggtacaatgacaccgaagaagccgaactcagcgcttcgtaaatatgcccgtgttcgcttaactaacggaatcgaggttacagcctacattcctggtatcggacacaacctgcaagagcacagtgtcgtattgatccgcggtggacgtgtaaaagacttaccgggggtacgctaccacatcgtgcgtggcgcacttgatactgccggagttgaaaaccgtgcacaaggccgttctaaatacggtacaaaacgtcctaagaaaaaataattccgtttgaatacaaataaaagggtttttaaaagcaaggagttctggcaatgctgttaagggcgtcgggcttttcgcgccaagcgtcagtttgatcccggcagctgaaccgtgaaatccctctgcttgctgtaaacccgtaacaagagaagggaggataatcagatgccacgtaaaggtcctgtagcaaaaagagacgttttacctgatccgctttacaactctaaactggttactcgtttgatcaacaaaatgatgatcgacggtaaaaaaggtaaagctcaaacaatcctatacaagtcattcgatattattaaagaacgtaccggcaacgatgcaatggaggttttcgaacaagcattgaagaacatcatgccagtgcttgaagttaaagcacgccgcgtaggtggtgcgaactaccaagtacctgtagaggttcgtcctgaacgccgtacgactcttggacttcgctggttagtaaactacgctcgtcttcgcggagaaaaaacgatggaagagcgtttagctaacgaaatccttgatgcagctaacaacactggtgctgctgttaagaaacgtgaagatactcataagatggctgaagcaaacaaagcgttcgctcactatcgctggtaatctcacacgacaaaatattattccctaagaaggaaggagaaaagacccaatggcaagagagttctccttagaaaaaactcgtaatatcggaatcatggctcacatcgatgccggtaaaacgacaacaactgaacgtatcttgttctacacaggccgtatccataaaattggtgaaactcacgaaggggcttcccaaatggactggatggagcaggaacaagaacgcggtatcacaatcacatctgctgcaacaactgcacagtggaaaggctaccgcgtaaacatcatcgacacaccaggacacgtagacttcacagttgaggttgaacgttccctgcgcgtacttgatggtgccgttgccgttcttgacgcacaatcaggcgttgagccgcaaactgaaacagtttggcgtcaggcgacaacttacggagtacctcgtatcgtatttgtcaacaagatggacaaaacgggtgcggacttcctttactctgtaggaactcttagagaccgtcttgaggcgaacgctcacgcgatccaattaccgattggcgccgaagacaattttgaagggatcatcgaccttgtagaaaacgttgcgtactactatgaagatgaccttggaacacgctctgaagcgcgtgaaatccctgctgagtacaaagacaaagctgaagagcttcgcgctagcttgattgaagctgttgctgagcttgatgaagagcttatgatgaagtacttggaaggtgaagaaatcacagttgacgagctgaaagcagcaatccgcaaaggaacttgtaacgttgagttctatccggttctatgtggttcagctttcaaaaacaaaggtgttcaattagtgcttgacgcagttcttgactacctgccagctccaactgacgtaccagcaatcaaaggtactctgcctgattctgatgaagaggttactcgtgagtcttctgacgatgcacctttctcagcgcttgcatttaaagttatgactgacccttacgttggtaaattgacgttcttccgtgtgtactcaggaacacttgattccggttcatacgtaagaaactcaacaaaaggcaaacgtgagcgcgtcggccgtatcctgcaaatgcacgccaacagccgtgaagaaatctctactgtgtacgcaggggatatcgctgctgctgtaggtttgaaagacacgactacaggggacacgctttgcgacgagaaaaaccttgttatcctggaatcaatggaattccctgagcctgttatccacgttgcaatcgagcctaaatctaaggctgaccaagacaaaatgtctactgcactggctaaattggctgaagaggatccaacattccgtgcgcatactgaccctgaaacaggtcaaacgatcatcggcggtatgggtgagcttcaccttgatatcatcgttgaccgtatgaaacgcgaatttaaagttgaagccaacgtcggtgctcctcaagttgcgtatcgtgaaacattccgtgcgagcgcgcaagttgaaggtaaattcgtacgtcagtctggtggacgcggacagttcggacacgtttggatcgaattctctccaaacgaagaaggaaaaggctttgagttcgaaaacgcaatcgtcggtggtgtcgttcctcgtgaatacattccggctgttcaagcaggacttgaagatgcacttcaaaacggtgtagtcgcaggttaccctgttatcgacatcaaagcgaaactttttgacggttcttaccacgatgtcgactctaacgaaatggcgtttaaaatcgctgcttccatggcgcttaaaaacgcggcaagcaagtgtaacccagttattcttgagccgatctccaaagttgaagtcgttatcccagaagaatacatgggagacatcatgggcgacattacgtcacgccgcggtcgcgtagaaggtatggaaggacgcggaaacgctcaggtcgttcgcgcgatggttccactttctgaaatgttcggttacgctacggctctccgttcaaacacacaaggacgcggtacgttcacaatggtctttgaccactatgaagaagtgcctaagagcatcgctgatgagatcatcaaaaaaaatcaaggtgaataattgattttgcctcttcattaaagtataactactattgtaagatgagaaagtgaaacattgctttcactttctatcactctatataacaaaaactaacctttttaaggaggattttcagaatggctaaagaaaaattcgaccgttccaaatcacatgccaacattggtacaattggacacgttgaccatggtaaaactacattaacagctgctatcactactgtgcttcataagaaatctggtaaaggtactgctatggcatacgaccaaatcgacggtgctccagaagagcgcgagcgcggtatcacaatttctactgcacacgttgagtacgaaactgacaaccgtcactatgcacacgttgactgcccaggacacgctgactatgttaaaaacatgatcactggtgctgcgcaaatggacggtgcgatccttgttgtttctgctgctgacggcccaatgccacaaactcgtgagcacatccttctttctcgtaacgtaggtgtgccttacatcgtagtattcttgaacaaatgcgacatggtagacgacgaagagcttcttgagctagttgaaatggaagttcgcgatcttctttctgagtatgagttccctggtgacgatgtaccagttatcaaaggttctgctcttaaagctcttgaaggagatgctcagtacgaagaaaaaatctttgaactgatggctgctgttgacgagtacatcccaactccagagcgtgaaactgacaagccattcatgatgcctgttgaggacgtattctcaatcacaggtcgtggaacagttgctactggacgcgtagagcgcggacaagttaaagtcggtgacgaagttgaaatcatcggtcttcaagaagaaaacaagaaaacaactgttacaggtgttgaaatgttccgcaagcttcttgactatgcagaagctggagacaacatcggtgcacttcttcgcggtgtatctcgtgaagaaatccaacgcggtcaagtacttgctcaaccaggtacaatcactccgcacaaaaaattcaaagctgaagtttacgttctttctaaagaagagggtggacgtcacactccattcttctctaactaccgccctcagttctacttccgtacaactgacgtaactggtatcattcagcttccagaaggcgtagaaatggttatgcctggagacaacatcgaaatgactgttgaattgatttcaacaatcgcgatcgaagacggaactcgcttctctatccgtgaaggcggacgtacagttggttctggcgttgtttcttcaatcatcgaataatacttataaaataaaaaacgagatccagccgggtctcgttttttattttgagccgctatgctaaagggatttattttccgcctgtaagtccttgattaacactgcttgaatctgtataataaaaaaagtgtgcaaaagccggtaatattcaatattaccttgcaacatgcctataaattttgtataatagtgcatgttggtctttgactgcgatggaagtgagaggttgctgacacacccggccgctttgccatggcaaggtgattcaggtttttctcacggagaattgtctaatgtaagtaggcgaaaaggagggaaaataatggcaaaacaaaaaattcgtattcgtttaaaagcgtatgatcatagaatccttgatcaatctgctgagaagattgttgaaacggctaaacgttccggagccagcgtttctggtccgattccgttgccaactgagaaatcagtttacacaatccttcgtgcggtgcacaaatacaaagattctcgtgagcaattcgaaatgcgtacacataaacgtttgatcgacattgtgaacccaacaccacaaactgttgatgctctaatgcgattagatttaccatctggtgtcgatatcgaaattaaactttaatctaaaatatagaatgatctttataggaggtgtgacgaatgaccaaaggaatcttaggaagaaaaattggtatgacgcaagttttcgcagaaaacggtgatcttattccggtaactgttatcgaagctgctcctaacgttgtgcttcagaagaaaacttctgaaaacgacggctatgaagcgattcagatcggttttgacgacaagcgtgaaaagcttgccaacaaaccagaaaaaggacacgttgcaaaagcggaaactgctcctaagcgcttcgttaaggaattacgcggagtggatatggatgcgtatgaagttggtcaggaagtcaaagttgatattttctctaacggagaaatcgtagatgtaacaggaacatcgaaaggtaaaggtttccaaggcgctatcaaacgccacggacaatctcgcggaccaatgtctcacggttcacgctaccaccgccgtcctggttcaatgggaccggtagaccctaaccgtgtattcaaaggaaagctgttgcctggacgtatgggcggagagcaaatcactgttcaaaaccttgaaatcgtaaaagtagatgcagagcgcaaccttcttttagttaaaggtaacgttcctggtgccaaaaaatcactagtcactgttaaaagtgctgttaaatctaaataattctcttaggaaaggaggaaattgatcatgccaaaagtagctttatataaccaaaacggttctactgctggtgatatcgaattaaacgactctgtatttggaatcgagccaaatgagagcgtagtattcgacgctattcttatgcaaagagcttccttgcgtcaaggaactcataaagtaaaaaatcgttcggaagtacgtggcggaggtcgcaaaccttggcgtcaaaaaggtaccggccgtgctcgtcaaggatctatccgttcaccgcaatggcgcggaggtggtatcgtattcggtcctacaccacgcagctatgcatataaattaccgaaaaaagttcgccgcttggctatcaaatcagcattgtcttctaaagtgaatgacaacaacttgatcgttcttgaagatcttaatcttgatgcggttaaaacaaaagaaatggcagctatccttaaaggtctgtctatcgagaagaaagctttaatcgtaactgcggatgcaaacgagacagttgaactatctgctcgcaaccttccaggagttactgttgttgaagctaacggaatcaacgtcctcgatgttgtcggtcacgagaagcttgtgatgacgaaagcagcggttgaaaaagtagaggaggtgcttgcataatgaaagatcctcgtgatgttctaaagcgccccgtcattactgaacgttctgctgatttaatgactgaaaaaaaatatacgtttgaagttgacgtaaaagccaacaaaacagaagtgaaagacgctgttgaacaaatctttggagtgaaagttgaaaaagtcaacatcatgaactacaaagggaaattcaaacgtgtcggccgctactctggtatgacaaacaaacgcagaaaagcgattgttaagcttactgaagacagcaaagaaatcgaaatttttgaagcttaatcacttgtaaaaagaaggagggaaattcaaaatggcgattaaaaagtacaaaccgacctctaacggacgtcgcggcatgacttcttctgatttcgcggaaatcactacagatcagccggaaaaatccttgcttgccccgcttcacaaaaaaggcggacgcaacaaccaaggtaaattaactgtacgtcatcaaggcggcggacataaacgccaataccgtattatcgacttcaagcgcgataaagatggtatacctggacgcgttgctacagttgagtacgatccaaaccgttcagctaacattgctctaattaactatgtagacggagaaaaacgctacatcctagctcctaaggggcttcaagtaggcactgaaatcatgtcaggtccagaagctgacattaaagtaggtaacgcacttccactgatcaacatccctgttggtacagttgtgcacaacattgaattaaaacctggaaaaggcggacagcttgtacgttcagctggtacatctgctcaagttcttggtaaagaaggtaaatacgttcttgtacgtcttaactccggtgaagttcgcatgattctttctgcttgccgcgcaacaatcggtcaagtgggtaacgaacagcatgaactgatcaacatcggtaaagccggacgttctcgctggaaaggcgttcgccctacagttcgcggttctgttatgaaccctaacgatcacccgcacggtggtggtgaaggacgcgctccaatcggacgtaaatcacctatgtctccatggggtaaaccaactcttggattcaaaactcgtaagaaaaagaacaaatcagataaattcatcgtacgtcgtcgtaaaaataaataacggggttgtctacggttcatatcggaccgtagtgcaatcacgaagggaggttccaaaatggctcgcagcttaaaaaaaggaccatttgtcgatgatcatctaatgacaaaaatcgagaaattaaatgaagcggataagaaacaagttgtgaaaacttggtctcgccgttctactattttcccgcaatttatcggtcacacaatcgcagtctatgatggacgcaaacatgtgcctgtttacatctctgaagatatggtaggtcacaagttgggtgaattcgcaccgactcgcacttacaaaggtcatgctagtgatgacaagaaaacaagacgctaatgagaggaggcttttaaatgcaacaagctaaagctgtcgcaagaacagtccgtattgctcctcgtaaggcacgtctagtaatggacctgattcgaggcaagcaagtaggtgaagcagtatcgatcttaaaccatacgccaaaagctgcttccccgattattgaaaaagttttaaaatctgctatcgccaacgctgagcacaactacgaaatggatgcaaacaacctggttgttactcaagcttacgtgaacgaaggccctacgttaaaaagattccgtccgcgcgctatgggacgtgcaagccaaatcaacaaacgtacgagccacattactatcgttgtatcagaaaagaaggagggataactcgtgggtcaaaaggtaaatccagtcggtcttcgtattggggttatacgtgattgggaatctaagtggtacgctggcaaagattacgctgacttccttcacgaagatctgaaaatccgtgaatttattaatcaacgcctgtctgacgcttcagtttctaaagtagaaatcgagcgtgcggcaaaccgtgtaaatattacgatccacacagctaagcctggtatggttatcggtaaaggcggttccgaagtcgaagcgcttcgcaaagcccttaacagccttactggcaagcgtgtacacattaacattcttgaaatcaaaagagctgatcttgatgctcagctagttgctgataacattgctcgtcaattggaaaaccgtatctctttccgtcgtgcgcaaaagcaacaaatccaacgcacaatgcgcgctggtgcacaaggaattaaaacaatggtttccggtcgtcttggcggcgctgacatcgctcgttctgaatactacagtgaaggaactgttccattgcacacacttcgtgcagacatcgactatgctacatctgaagctgacacaacttacggtaagcttggtgtaaaagtctggatctatcgtggagaggttcttcctactaagaagaaaactgaggaaggaggaaaataatatgttaatgccaaaacgcgttaaatatcgcagagagcatcgcggaaaaatgcgcggccgtgcgaaaggcggcactgaagtgcatttcggtgaatacggtatccaagctcaagaatcttcttggatcacaaaccgccaaatcgaagcagcacgtattgcgatgactcgttacatgaaacgtggcggtaaagtttggatcaaaattttcccttctaagccttatacagctaagcctctagaggttcggatgggttccggtaaaggtgctcctgaaggatgggtagctgttgtaaaaccgggcaaagttttatttgaaatttctggtgtgtctgaggaagtcgctcgcgaagctcttcgtcttgcatctcacaaattgccaattaaaacgaagttcgtaaaacgtgaagaaattggtggtgaatcaaatgaaagctaatgaaattcgtgaccttaccactgctgaaattgaacaaaaagtaaagtctcttaaagaagaacttttcaatcttcgctttcaattagcgacaggacaacttgaaaacactgctcgcattcgtgaagtgcgcaagtcaatcgcgcgcatgaaaactgtgattcgggaaagagaaattgctgccaacaaataattccggagggaggttctctaaaacatgagcgaacgcaatcagcgcaaagtctaccaaggacgtgttgtttctgacaaaatggataaaaccattactgttgttgtagaaacatacaaaaagcattcactctacggtaaacgcgtaaagtactctaaaaaattcaaagcacatgatgaaaataaccaagctaaaatcggagacatcgtaaagatcatggaaactcgtccattatctgcgactaaacgttttcgtctagttgaagttgtcgaagaagctgttattatctaataaagttcggaaacttttttccgaagggaggtaacaaataatgattcaacaagagactcgtttaaaagtagctgataactctggtgcccgtgaagtgttaacaatcaaggtgcttggtggttctggacgcaaaacagctaacattggtgatgtcattgtttgcacgggttaaaccaagcaacacccaggaggcgttgtcaaaaaaggtgatgtcgtgagagctgtagtcgtacgttctaagagcggtgcacgcgaaatgacggatcttacatcaaattcgatgagaatgcatgtgttatcatccgtgacgacaaaagcccgcgcggaactcgtatcttcggacctgtagcacgtgaacttcgtgataacaacttcatgaaaattgtttctctagctccagaagtactttaatgatatcaatgccggactaaggaggtgcgatcaggatgcatgttaaaaaaggcgataaagtaatggttatctctggtaaagacaaagggaagcaaggtgtaattcttgcagctttccctaaaaaagaccgcgtaatcgttgagggtgtcaacatggtgaagaagcactcaaagccgactcaagcaaaccctcaaggcggaattttaaatcaagaggcgccaattcatgtgtcaaacgtaatgccgctcgatcctaaaacaggtgaagtgactcgcgtaggatacaaagtagaaaatggcaaaaaagttcgtattgcaaaaaaatctgggcaagttctagataactagtaataaaggaagggaggtctatctcatgaaccgccttaaagaaaagtacaataaagaaattacacctgcattaatgaaaaagttcgaatacaaatctgtgatgcaagtgcctaaaatcgaaaaaatcgtaatcaacatgggtgttggtgacgctgttcaaaacgctaaagctatcgatagcgctgttgaagaactaacgtttatcgctggtcagaaacctgtcgttactcgtgcgaagaaatctattgctggattccgtcttcgtgaaggaatgccaatcggtgcgaaagtaactcttcgcggagagcgcatgtacgatttccttgataaactaatttctgtttctttaccgcgtgtacgtgacttccgcggaatttcaaaaaaatcttttgacggtcgcggaaactacacactaggaatcaaagaacagctgatcttccctgaaattgactatgataaggtaactaaagttcgcggtatggatatcgttattgtaacgactgccaacactgatgaagaagctcgtgaactgttaactcaattaggtatgccattccagaaataatcaatgaaagggaggcgaaatcgtggctaaaaagtcaatgattgcgaaacaaaaacgcacaccgaagtttaaagtacaagagtacactcgctgcgaacgctgcggccgtccgcactctgttattcgtaaatttaaactttgccgtatttgtttccgtgaacttgcatataaaggacaaattcctggcgttaaaaaagccagctggtaatccccgtttatgggaaggaggttattaaataatggttatgacagatccgattgcagatatgctgactcgtattcgtaatgcaaacatggtacgtcatgagaagctcgaaattcctgcttctaagttgaaaagagagatcgctgaaatcttgaaaagagaaggtttcatccgtgacgtagaattcattgaagataacaaacaaggcatcatccgtgttttcttgaaatacggacaaaacaacgagcgtgtcatcactggccttaaaagaatcagcaaaccaggtctgcgcgtttacgctaagtcaaacgaagtgcctcgcgtgcttaacggacttggaatcgcaattctttctacatcacaaggtgtgttaacggataaagaagcccgcgctaaacaggctggcggagaagtattagcatacgtttggtaagaagtttaacatgaatggaggtgtttggtatgtctcgtgtaggtaagaagctacttgagattccttcaggcgttacagttactctgaacgacaacactgtaaccgtgaaaggaccaaaaggagaattaactcgtacgtttcatcctgatatgaagattaaaattgaggacaatgtacttactgtagaacgtccttcagataataaagaacaccgtgcgctgcatggcacaactcgcagcatcatcggaaacatggttgaaggtgtatctaaaggttttgaaagaggtttggaattagtcggtgtcggttaccgtgcttctaaatccggaaacaaacttgttttgaacgttggatactctcaccctgtagaaatcgttcctgaaaacggaattgaaatcgaagttccatctcaaacaaaagtggttgtaaaaggtacagataaagaacgtgttggagctactgctgcaaacattcgcgctgtacgttctccagagccttacaaaggcaaagggatccgctatgaaggagaaatggttcgtcgtaaagaaggtaaatctgctaagtaaaaccgcttaatgtgagaaaggagtgacccagatgattacgaaaacaagcaagaatgctgcacgtcttaaaagacacgctcgtgttcgtgcgaagctttcaggaacccctgaaagacctcgtctaaatgttttccgttcaaacaaacatatttacgcacaagtgatcgatgacgtgaacggtgttacacttgtgagtgcatctactcttgataaagactttaacgctgaaaatggcagcgatacggctgcggctgcaaaagttggagagcttgttgcaaagcgcgcttctgaaaaaggtatcacaaatgtcgtgttcgaccgtggcggttacctttatcatggacgtgtaaaagcattggctgatgctgcacgcgaagctggattagaattttaataaaagaaggagggacatatgaatatgcgtcgtattgacccaagcaaattagagttagaagaacgcttagttaccgttaaccgcgtagcgaaagttgttaaaggtggtcgtcgtttccgtttcgcagctctagtcgttgtcggtgacaaaaacggtcacgttggtttcggaactggtaaagcacaagaagttccggaagcgattcgcaaagctgttgaagatgcgaaaaagaatttgatcgaagtaccaatggttggaactacaattccacacgaaatcatcggacgtttcggtgcaggaaacatcttgttaaaacctgcttctgaaggtacgggagtcatcgctggaggcccagtacgtgcggtacttgagcttgcaggtgtatctgatatcctttctaagtctttaggttctaacacaccgatcaacatgatccgtgcaacagtccaaggtttaagcgagctgaaacgcgctgaggacgttgcgaagcttcgtggaaaatctgtagaagaactgttaggataaggagggaacattaatggctaaattagaaattaccctcaaacgcagtgtaatcggacgcccggaagatcagcgcattactgtaagaacgcttggtttaaagaaaacaaaccaaactgtcgttcatgaagacaacgctgcaatccgcggtatgattaacaaagtatctcatttagtttctgttaaagaactttaaaaataaacgataggctaaggaggtgtccaaatgaaacttcatgaattaaagcccgcagaaggttcacgtaaaacgcgcaaccgcgtaggtcgtggtattggttctggtaacggtaaaacagctggtaaaggtcataaaggtcaaaacgctcgttctggcggcggtgtacgtcctggattcgagggtggacaaatgcctttattccaacgtcttcctaaacgcggtttcacaaacatcaaccgcaaggaattcgctgtggtcaacctagacaaactcaacagctttgcagaagggacggaagttactcctgaacttcttttagaaacaggtgtaatcagcaagttgaaatctggagtgaaaattcttggcgacggtaaattagaaaagaaattaactgttaaagccaataaattctccgcttctgctaaacaagcaattgaggctgctggcggtacagctgaggtgatctaacttgtttaagacaatctccaattttatgcgtgtgaaggatattcggaataagattatcttcactcttttaatgcttatcgtctttcgtctcggttcgttcattcctgtgccgcacgtaaacacagaagttttaaaggcacaggatcaaatgagcgtatttgggattctaaacacatttggcggcggtgcattgttcaacttctccattcttgcgatgggaatcatgccttacatcacagcttctatcatcatccagctcctgcagatggatgttgtgccgaagtttaccgaatggtctaagcagggggaagttggtcgccgaaaactagctcagttcacaaggtacttcacgatcgttcttggatttatccaggctttaggtatgtcttacgggtttaacaacatggccggcggcgcgttgattacagacccgggagtcggtacttatttgcttattgcgattgtactaactgctggaactgcttttttaatgtggctgggagaacaaattacgtctcatggagttggtaacggaatatccattatcatcttcgccggtatcgttgccggtattccgcagacgattaatcagatctacgctcagcagtttgtagatgctggagatcagttattcttgcaaatcataaaggttgtcgttatattggttgcgattttagcgattgtcgttggcgttattttcatccaacaggcggttagaaaaatctcaattcaatatgcgaaaggttcaggccgttcaccggttcctggcggccagtctacacacttgccgctgaaggttaacccggcgggagttattccggttatctttgccgtagcatttatcaccactccgcggaccgtggcaacattctttggctccaatgacgtcacgaattggattcaaaaaacgtttgattacacgcatccggtcggaatgggagtttatgcagcattgatcatcgcctttacctatttctatgcatttgtgcaggttaaccctgagcaaatggccgataatcttaaaaaacaaggtggctatattccgggagttcgtccaggaaaaatgactcaagatagaattacgagcattttgtatcgacttacatttgtaggctccatattcttggccgtgattgccattcttcctgtcttgttcgttaatattgctgggctgccttcttctgcacaaattggtggaacaagtttgctgattgtcatcggggttgcacttgaaacaatgaagcagcttgaaagccagctggtaaaacgaaactatcgtggatttatgaagcactagaggaaatggggcgcgcccattccctctaaaatagagaggacggggaatccgaaatgaacttagtcttaatgggactgcctggagccggtaaagggacacaggctgaacggattgttgaagattttgggatacctcatatctcaacaggagacatgttccgcgctgcgatgaaagaagaaacggatctgggactcgaagccaaatcatacattgataaaggtgagcttgttccggatgaagtgacaattggtattgtcagggagagacttggcaagaatgattgtgacggaggttttcttctggacggatttccgagaacagtcgctcaagctgaagcacttgaggaaattcttaaaggacttggcaagtcgattgaccatgtcatcaacattcaagtcgataaagatgcattgatggaacgtctgacaggacgcagaatctgcaaaaactgcggtgcaacttatcatttagtctttaatccgcctgcaaaagaaaatgtatgcgacaagtgtggaggagagctttatcagcgtgaagacgataatgaagctaccgtatccacgcggttagaggtcaacatgaagcaaacccagcctttactcgatttctatgaagataaaggatatctcgtaaacattgacgggcagaagcacatcaatgaagtttacgctgatataaaggagcttctcggaggccgggacaaatgattatttgtaaaactccccgagaaatcgaaatcatgcgggaggccggacgaattgtcgctttaactcatcaggagctaaaaaagcacattaaacccggcatctcgacaaaagaattggatcaaattgccgaacgttttattacaaagcaaggtgcaatcccatcttttaaagggtataatggttttcgcgggagcatttgcgtttcggtcaacgaagaactcgtgcacggtattccgggaaaacgagtccttcgcgacggggacatcatcagcatcgatatcggtgcgaagctaaacggttatcatggtgactccgcttggacttatccagtgggtacgatcagcgatgatgatcagaagctgctggatgtgacagaggagtctttatatagaggcttgaaggaagcaaaaccgggagaacgtttgtcgaatatttcccacgcaatacaaacgtatgtcgaaagcgaacaattttcagtcgtcagggaatatgtaggacacggggtagggcaggatctgcatgaggatccgcaaattcctcactacggtccgccgaacaaaggcccgcgtttaaagcctggcatggtcttggccattgagccgatggtcaatgcaggtacacgctatgtcaaaacattggctgacaactggacggttgtaactgtggacgggaagaagtgtgctcactttgaacacacgattgccattacggatgccggttttgagatactgacaaaagcctaggtgaaatgagatgtatcggaaaacacctgaaattggacagttcgtacgcatgacaagaggccgcgaaatgaaccaatacgcagttgttattgatatagtcgatcatcatcatgtgctggtagcagacggagaaaagcgtaaatttcattctcctaagaaaaagaatatcaatcatttaaccttttatgattgcgtatctccggaagttcagaacagtataaacgaaacagggcgtgtgacaaacggaaaattgagattttctcttttgaaatttgtcagagagcaagttactgatttgaagaagggagaacacttgaatggcgaaagacgatgtaattgaagtggaaggtactgtagtcgaaacgctgccaaacgcaatgttcaaagttgaacttgagaatggccacacggttttggctcacgtatctggtaaaatccgcatgcacttcattcgcattttacctggagacaaagttacggtagaattatctccatatgacttaactcgtggtagaattacgtaccgttacaaataaagcactccggaaattgaaggaggttggaaacacatgaaagtgagaccatcagttaaaccgatctgtgaaaaatgcaaggtcattcgcagaaaaggaaaagtaatggtgatctgtgaaaatccaaagcataaacaaaaacaaggataatttttaaggaggtgcgagagagatggctcgtattgctggtgtagatatcccacgtgataaacgtgttgttatttcattaacatacatctttggaatcggtcgtacaacggctcagcaaatcttaaaagaagctggagtttctgaagatactcgcgttcgtgatttgactgaagaagaacttggtaaaatccgtgacgtgatcgacaaattgaaagtagaaggtgaccttcgccgtgaagtgtctcttaacatcaaacgtctgatcgaaatcggaagctaccgcggaattcgtcatcgtcgcggattgcctgttcgcggtcaaaatactaaaaataacgcgcgtactcgtaaaggtccgcgtcgtactgtacctaacaagaaaaaataagcgggggaggtaattaaacaatggctgctgcacgtaaaacaaacacgcgtaaacgtcgcgtgaaaaagaatattgaatctggaattgctcatatccgttcaactttcaacaacacgattgttactatcacagatgttcatggcaatgctctttcttggtcaagtgccggagctttaggatttaaaggttctaaaaaatccactccattcgctgcacaaatggctgctgaaacagctgctaaaggttctatcgaacatggacttaaaactcttgaagttactgtaaaaggaccaggttccggccgtgaagctgcaattcgtgcacttcaagctgctggactagaagttacagcgatcagagacgtaacgcctgttcctcataacggatgccgtccgccaaaacgtcgccgcgtgtaatttgtttgtataaattttgtgtccctgtcaataatgggttatgatacagttaatttataaaacgaatgcacactcgttgcctgagcacatacgggactaaacaatggggaatttcggatagaatcagagaaattctttccggggtttcgacgttttgaaggagggttttatgaaatgatcgagattgaaaaaccaaaaatcgaaacggttgaaatcagcgacgatgccaagtatggtaaatttgtcgtagagccacttgagcgtggatatggtacaactttgggtaactccttacgtcgtatccttttatcctcactccctggtgccgctgtaacatcgatccaaatagatggtgtactgcatgaattctcgacgatcgaaggcgttgttgaagatgttacaacgattatcttaaacattaaaaaacttgcactgaaaatctactctgaagaagagaagacgcttgagattgatgttcagggtgaaggagttgtaacagctgctgatattacccacgacagtgatgttgagattttgaatcctgatcttcacattgcgactcttggccaaaatgcgagttttcgagttcgcttaactgctcaaagaggtcgcgggtatacaccagctgacgcgaataaaagagacgatcagccgattggcgtcatcccgattgattccatctttacacctgtttctcgcgtatcttatcaagttgagaatactcgtgtgggtcagattacaaactatgacaaacttacgcttgacgtatggacagatggaagcactggaccaaaagaagctattgcacttggttcaaagattttgactgaacaccttaatatttttgtcggtttgaccgacgaagctcagcacgctgaaatcatggtagaaaaagaagaggatcaaaaagaaaaagttcttgaaatgactattgaagaactcgatctttcagtccgttcttacaactgcttgaagcgtgcaggaatcaatacagttcaagaacttgcgaacaaaactgaagaagatatgatgaaagttcgcaacctgggccgcaagtcgcttgaagaagtaaaagcgaaacttgaagaacttggacttggccttcgcaaagacgattgactagtttccatgtgaactaggattttcgtgtgttttttatttcagatagagtatttcaataaaggaggggacaccacatgtcatacagaaaactaggacgcactagtgcacagcgtaaagcaatgctgcgtgatcttacaacagacttgatcatcaacgagagaattgaaacaacagaagctcgcgcgaaagaacttcgctctgttgtagaaaaaatgattacacttggcaagcgcggagatttacacgcacgccgccaagcagctgcatacatccgcaatgaggttgcagatgcagagaaaaaccaagatgcacttcaaaaacttttctctgatgtagcacctcgttatgaagagcgccaaggcggatacacacgtattatgaagcttggtcctcgccgtggtgacggagcaccaatggctatcatcgaattggtttaatcacatattttgtgtgtctaaagaagggcgggacagtttttaactggatctatgccctttttttagataccggggaattttctatgataaaagaatagtcagaaaagcagagctttagaggagaggaggccggacgggcaaatgaatcaagagcgattaatcgctgcagaagatatcacgtttcgctaccagaaagatgcagacaggcctgcgcttgatcacgtatctttccatgtgtcgaaaggagaatggcttgcgatcgtcggtcacaacggttcaggaaagtcgacgctcgcccgtgctttaaacggactgattctgcctgatgaaggatcgattaaagtaggcggtatcaagctgacggaagagacggtctgggatgtccgaaaaaaggtcggcatggtgtttcaaaatccggataaccaatttgtcgggacaaccgtccgcgatgatgtggcttttggtttagaaaacagcggagttccaagagaagacatggtggaaagggtggattgggccgttcaacaggtgaacatgcaagaatttctcgatcaagagccgcaccatctctcgggaggacaaaagcagcgtgttgcgattgcgggagtgcttgctgcccggcctgacatcatgattctcgacgaagcgacttccatgctcgacccgatggggcgggaagaagtgctggatacggtcagaaggctgaaagaccaaggaatggttacggtcatttcgattacccatgacttaaacgaagccgcgaaggccgaccggatcatcgtcatgaacagcggtagaaaatttgccgaaggcacgccgcaggaagtctttcgtctgaatcaagatctgattaaaatcgggcttgatttgccattttcttttcagctcacccaaatgctgaaggaaagcggtctggctctgaaaggcgatcatctgacacaagaaggattggtgaatgagctatggacattgaaatcaaagatgtagagcaccgataccagatgaaaacgccttttgaacgcctggcgatctatgatgtcaacgctgtgattaaagaaggaagctatgtcgccgtaatcggccatacaggatcgggaaaatcgactttgcttcagcacctgaacgggcttttaaaaccgacaaaaggacagatacgcctcggcgaggacgttcttgaagcaggcaaaaagaataaacatctaaaagctttgcggaaaaaggtcggcattgtctttcagtttcctgaacatcagctgtttgaagaaacaattttaaaggatatcgcattcggtccgatcaactttggcatgagccgggaaaaggcggaagaaaaagcgagggaaatgctgaagctggtaggtttgggtgcagagctgtccgacaggtctccgtttgaactaagcggagggcaaatgcgccgcgtggccattgcgggagtgctggcgatggagcctgaggttcttgtcctcgatgaaccgacggcagggcttgacccaagaggccgcaaggagatcatggacatgttctacagcctccataagcagaggaacctgacgacaattctcgtcacccacagtatggaagacgcggcagcgtatgcagatgaactgattgtgatgcataaagggacggtcaaagcaaaagggacgccgcgggagcttttttcaaggaaagacgacattgccgctttagggcttgatttgccggaaacgattaaattccaaaaacgccttgaagagacgctggggattacgttcaaagcgccgattttgacgattgaagaagcagcctccgaagttaaagctctttttcaggaggaaaatgccctatgatggacaatatcattatcggcaaatacgtacccgggaaatcggtcattcatcggctcgatccgcgtacaaagctgttaaccattttcctttttgtctttatcgtttttttcgcgaataatacggaaacatatgcattgctcggcctgtttacggttgcagccgccgctttgtcaggcgttccggtgcgattccttataaaaggaatgaagccggtgttctggattgtgctgtttacgtttctgcttcatatttttatgacaagggaaggaccggttctcgccgatctcggcctgtttaaaatttatgaacaggggcttgttcaagggatttttatttctctgcgctttgtttacctcatcatgatcacaacgattttaacattgacgacgactccaatcgaagtgaccgatggtttggagcatttgctcggtccgtttaaaaaattgaagcttcccgtccatgaactcgctctcatgatgtccatctccctcagatttataccgactttgatcgaagagacggataagatcatgaaagcgcaaatggcaagaggcgtcgattttgcgaacggcccggtcaaagaacgcgtcaaagcgatcgttcctctccttgtcccgctttttgtcagtgcctttaaaagagctgaagagcttgcaaccgcgatggaggcgcgaggatacaggggaggagaaggccgtacaaaatacaggcagctgacatggaaatggaaggatacttccgtgctcctcattttagctgttcttggcgttttgctaattttattgcggacttaggtgatggacgatgagaatgaagtgcacgatttcatatgacggacaccttttttacggctaccaagtgcagcctgggcaaagaacgattcaggatgagcttgaaaaagcgctgcaaacgctccataaagcgaaggagcgtattcctgtcgtttcatccgggcgcaccgacagcggcgtccacgcagtcggacagacgattcattttgacagtccgctatccattcctgaggcgaaatggccgtatgcattgaatgccctgctgcccgatgatatatcggtccgcaaggcggaagctgtcaatgatcaatttcatgcgaggttttctgcgaaaagaaaagaataccggtatatgatatacaggggcagacatccggacgtttttaaacgctactatgcataccatgttccttatgaccttgatatggagaaagttaaggaagcctcccgctatctggtcggaacccatgacttcacaagcttttgtgcgaccaaaaccgaagtgaaggataaagtcagaacggtccatgaactggaatggtctgacacaggggacggactgcagatgagaattgtgggaagcggatttttgtataacatggttagaatcattgccggtacgcttcttgatgtaggaaccggcaaattttcccctggtgacattgaaaagatgattcttgccaaaaaccgcgatgccgcagggcgcactgcaccggcacacggcttatatttatggcgtgttatctatgacaactaaaccaggtgtaacattttcttgacagagagtacagaaagttataagatatcatatggtatgtatttcaaccccacgataagccccggaaacttattgtgttttgaaatagaacgtaattgaagtttattgaaaatggcagatcatttaggagggaaatttaatgcgtacaacacctatggctaacgcaagtaatattgaacgcaagtggttagttgttgatgctgctggcaagacgctaggacgtctttctactgaagttgcatctatccttcgcggaaaacataaaccaacttacacaccacacgttgacactggagatcatgtgatcatcatcaacgctgaaaaaatcgagttaactggtaaaaagttaacggacaaaatctactaccgtcacactcaacatccaggcggtttaaaatcaagaactgctcttgaaatgcgtacaaactaccctgagaaaatgcttgaacttgcgatcaaaggcatgcttccaaaaggttctctaggtcgtcaaatgttcaaaaaattgaatgtataccgtggttctgagcatccacaccaagcacaaaaacctgaagtttacgaacttcgcggttaattaaaaaggaggttaccaatttggcacaggttcaatattacggtactggccgtcgtaaaagctctgtagcgcgcgtgcgtttagttccaggagaaggccgtatcatcgtgaataatcgtgaaatcagcgagcacatcccatctgcagctctaatcgaagatatcaaacaaccattaactttgactgaaacagctggtacttatgacgttttagtaaacgtacatggaggcggcttctccggtcaagctggagcaatccgtcacggtatcgcccgcgctttgcttgaagcagatccggaataccgttcaactctaaaacgtgccggtctactgactcgtgacgcacgtatgaaagagcgtaaaaaatacggacttaaaggcgcacgccgtgcacctcagttctcaaaacgttaatttctggcgtttcaaaaactctcaagccatttggtttgggagtttttttattatattttccgccctatatatgaagcggatactggagcagagcccgattccctcgtccagacggagatttggccgatatggtggatctcgtgtgcgattaaatgccttaaaatatcgccttgcgtacagacttcgtctgaccaagccgctttaaccggcagatgttcgaaggcgctggaataattaaaaattacactttctatttctgagcggtgcaggtcggaaaaccgagcgatctgctgaatcgtctggtaatgagagtaatcaggttgaatatccggtttttctaaaatggcgtagatccagcttacttccacatctacaatatgaaacagatttttcttaatgcttcccattccgcctgaacgcttcttgaccagctcctcttgcggctggctgaggcaccacttaaaccatgcatgtcgaacttcccaattatattgaaacaatcctttcactcatctcacctcttctaatattttcggcttcttcctccgtttcccttccttagaagagcatgatttccggctcctgactgcacaatacaaggtaaaaaggaggcggtttctatggggacggtcgtatcttttaacaatgaaaaacaaaagaagcagatcaatttggaaaaacagcttctgcgcgaactgtctttggaaaaaatgctgaattctgcagaggaatgctttgctcctctttttcactttttttctaagcatacggatatcttatatgacggctgcatcgactttgccattgaggcatatttgctgggagccgagtacgggaagttcggctatcacggagaacccgttcatcgagcgatgatccgctcagaaaaagaagaaaaacagctactgcacgagctttatgaatatgctgtcagctggtctgaggcttttaatgttcaagctgcttatgaaccgctctattatgcctgcgaatacttcatccaaagctggtggaaggaaggcttcagccagcgggaaagacgctttaagcttcggctcagataaaacaaagttttatgaaaaagtgaggccaagcttaatcatatttcctttccttgtcccatatcttgtagtaaggacgagcgggagggaaagggatgaagaaaaaaataaaatggctcgggtttttactcggctttgtcgttttattatgtttatttcaatatcaattcaacaatgatgattcttggcggtcatggaatcttccgctgagcggcaaaatcatttatattgatcctggacacgggggcgccgatggaggggcatcaagcggtgaactccttgaaaaagacgtggctcttgaagtatccctaagaatcagggactatctccaggagcagggcgccttggtgatgctgacgcgggaggacgatcatgatctcgctcctgaagaaacgaggggactcagcagaagaaaagctgaagacttgcggaagagggtcgatatgatcaacaattctgaagccgatctttacctcagcatccatttgaatgcgattccttccgcgcgatggagcggtgcgcaaagcttctattacgggcaatatgaagagaatgaacgggccgccaagtttattcaggatgaattaagacataatcttgaaaacacgacgcggaaggcaaagcggatacacggaatttatttgatgcaaaatgttaaaaagcccggggcccttgtcgaaatcgggtttttgtctaacccggaagaggcaaaacagctggccaagcccaaatatcaggacaaaatcgcagcatccgtttataaaggcgtattgcgctactttacagaagacagagaccctcctgaataagagggtttctttttgtgtcaaagacactataaggaaagatatgctatacttattttgtaaacgaatacaacaaagggtgagatcaatgttgcgagaagacgatgtaaaaaagatagtcggcgatttggacgagccatttcttcacaagccgctcagagagctggatgccgtaaaagaaattaaaataaaacccgaaaaacggcacgtcagcgtaaaggtggcgctcgcaaaaacgggatctgccgaacaaatgcagcttcagcaggaaatcgtcatacggttgaaagaagccggtgcagagacggtcggcctgcgttttgaggagctgcccgaagaagtcgtaatgagttatcaagagtctgccaaagggcaggatcaatctctgctgaatagtgaaaaacagcctgtgtttttagctgtggcaagcggcaaaggcggcgtcggcaagtcgacggtgtcggtcaatttggctgtgtccctggcgcgaatcggaaagaaagtcggattaatcgacgccgatatttacggtttcagtgttccggatatgatgggaatcactgtacggccgacgatcgaaggagaaaaggtcgtgccggttgaaagattcggggtcaaagtgatttcgatgggattctttgtagaagacaatgcccctgtcatttggagaggccccatgcttggaaaaatgctgaataacttcttccatgaggttgaatggggggatgtcgattatattatcttagacctgccgccgggaacaggcgatgtagcgcttgatgttcactcaatgcttccaagctgcaaagaggtgatcgtgtcgacgccgcaccctactgccgcgtttgtcgctgcaagagcgggcgcgatggccttgaagaccgatcatgaaatcgtggggatcgttgaaaatatggcttattacgaaagcgtcaaaacaggcgagaaagaatatgtattcggcaaaggcggaggcgaaaagctcgcagaggaactaggcgttccaattctgggcaaaattccgctgaagcagccggattgggatgacagcgaatttgcgccgtccgtttatgatgaaagccacccgaccggcgccatttatttggatatcgccaaaaaaatcgacgaaagcattggcgcaaaagcttaaagagcaaaaaaagcttcctccgcagaagaagcttttagggaatgaaaagcggctcagctttgtttttcttcgccgcctttcatttcttctttcatgctttcagcagcagcttttttcagttcctcttcaaactgctttctgtaaagagggcttgtcagagtgtcagatatgacttcctgcaggtggcttcggaattcctggcttctgacaagttcaccgtattttttggccatttcaggatcctgcatgacctgcatcagcattttttggtactcaggatctttcatcagttttttcagcactttttcatgttcattttgaagtgttttggcaaagccttcagcgaattttggatcttcaaagacttttttccaaaattcagctccttttttggaggtcattgttttttcaacggtttctttgacagttttttcatccattacaagtgtttcatttaatttgtcatcatttaatatttcttgaatcgctttttttccgtcatctgtctttaatatatcgacaaccatttttttggtttgatcatagtccatctcagctgcttggtccgtgggagcacaagctgttacagatagaaacagaaaacagcttatcgatagcattgcggtcttgaacatgcttaagctcctttcgaaaactcgtcttacctttaatatgaatgtcttttaaaaatttatacataacaaaatatcgctgttacagcggtttatttaggggttgggaagtctacaatgaaaagccgtaatctcgtccgatttttcttttccgtattgggtgtcggagctttgactacaagtattgtcggttttgccatagagtggggaagatataaggagctgtttctttccttcgaggtattggagattctgtctgttcttttctggtttatcggggttggcatgatctttagcgtgattgctcaaatgggatttgtgattttcttaacgattcaccgctttgcactggaaattttcagatctcattctttgtggaattcgattcagctgtttttgattatatttgtcgcgtttgacttggtttacttgcgctttctgttttttgaaaaagatggaggctccatcattccgtacatttggctgccgctctttattttggcggtaggcattgcggccgcttatgcaaagcaaaaacagtcctctaaaaaaacgttcgtttccgcattatttctaatgtttgtttttactgtgatggagtggttcccggcgttaagggtcaatgaagaggactggctctatttaatgctgcttcctttattagcctgcaacgcttttcagcttttaatgctgccaaaatttcaggcacgcgcttagaccggctgctactttacttctgaagattttgcatccgtatttgcgattaattcgctgactgttacgtttttgagccccttgcttctgagatggtgcacgatctctggcagggcttcttttgtttgtttggcggaatctgaagcgtgaaagagcacgatgtcaccggcgtttaccgttccatttacgttttggacgatcttttgaacccccgggttcgtccagtcatccgagttaatactataatgaacaacggtgtagccgtactgtttagcaacatcgagtacgtctttattaaactggccggtcggcggtcttaaaagcgtaaggtcgtcaagcccgagtttttgaaaggagtgtcgtgcttttgctaagtcttttttgatctcgcttttcttcatttgcgaatagtttttataagcatagcccatactcccgatctggtgaccatctttacggattctttctacgacatccgggtggcgctctgcccatgaagctgatagaaaaaaggtcgcgtctttaataccgtttgcttttaatgtgtctaaaatgggcattgccttttgatctccccagctgatattaaatgtaagggctacttcatttgtatctgaatctcctctatataccgcttttgctccgccttctgtagaaaacacaggaagagggagcaggttttgcacataaaaaaaacttgctgtcgcaaaagcggctatcataataatgattagctgcttaatccgtttgatatgccacacataaaaatggttcacagaaaaactcctccttgtccatgctgctttgttttcatcctatgcttgtttaaaatagaacataacaataattcatcttaagaaaaaaattaaaaagagggttgaccggaattaaataaacatgttatattgttattcgtcgctgataaacagctgacatgaaaaagctccaaaaaataattttgagaaaagttattgacaaatatgtgagcttgatgttatattattaaagccgctgaacgaagcggaaatgatctttgaaaactaaacaagacaaaacgtacctgttaattcatttttataaatcgcacatttgagtgtgcgtagtcattatcaaacttcatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttccaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaaggatattatacggaatataagaccttgcggtcttatagacaggtgcgtttggatcttgtttagttttgaaggatcattccttcaaagcgtgttctttgaaaactagataacgaaagtagacattcacattcaattgtaatgcaagatatcacgtagtgattctttttaacggttaagttagaaagggcgcacggtggatgccttgggcactaggagccgatgaaggacgggacgaacaccgatatgcttcggggagctgtaagcaagctttgatccggagatttccgaatggggaaacccactgctcgtaatggagcagtatccatatctgaattcataggatatgagaaggcagacccggggaactgaaacatctaagtacccggaggaagagaaagcaaatgcgattccctgagtagcggcgagcgaaacgggaacagcccaaacccaagaggcttgcctcttggggttgtaggacactctgtacggagttgcaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagtttgaaaagacggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaaagacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttgcgaacagtggtaggagagcgttctaagggctgtgaagcgagaccggaaggactcgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggtaagcgcggtattggatatccgcgtccaagcagttaggctgggaaataggcaaatccgtttcccgtaaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgctgcccttatcgggcagggagacagtgtcaggtgggcagtttgactgggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattcctataaggaagtaagatccctgaaagatgatcaggttgataggtctgaggtggaagtgtggcgacacatggagctgacagatactaatcgatcgaggacttaacctaaatatttgtgaatcgtctgtccgttatctagttttgagagaacacctctcagaaagccaaaggcaaggaaactcggctaaaggccctcacatcctgtgaggaacgcccagtaccttcgtcctgaaggcatagtttggtggcgatagcgaagaggtcacacccgttcccatgccgaacacggaagttaagctcttcagcgccgatggtagttgggggcttccccctgtgagagtaggacgccgccaagctgttatatatctttaccctgcagaattgaagcttttcttattccgcagtagctcagtggtagagctatcggctgtaaccgatcggtcgcaggttcgaatcctgcctgcggagccaatgcttccatagctcagcaggtagagcacttccatggtaaggaagaggtcagcggttcgagcccgcttggaagcttaagtgaatacgttgatatgacaaggtttctcctgttgtggggaaagctttttttgtttttgcgatattttgcttttagacttattgaatgtataaaagcaggctaaatgcctgcttttatttttatccccataaaacgttcagtgtgacttcaaagacaagaagagacaacatataacttgcgtactttaacgtatcaggttcatgctgttttgagtctttaaaagtccatataaataatgcagcaacgcctataaaatggtcacgattttgctaagcgttaataatgacatgacgaccttcctttatattgaaaattcatttatcatctatcttctacatttataattaaaatcccttttagctgtaaaaactttctctgctgttcaaaatccatttaaaatagagaagatccgattattcacactgccaaaagacttaatgttgttttggatgtttgaaaatagaatgacgtatctgctccctgtcagactgaaactgtttaatatgttgtagccgggcatgacaccgtggcttgaatagcttcctggagacacataaaagcccatgccgtatgttgctttattcggcgtaaacattttcataaaactttcattggaaatgatttttctttcgtaaagtgctttatcaaacaaatacatgtcataagcggtcatataaatatcaccggccccgtaaagctgtgataaatccggcatgtcaggcgtataaagctttttttgcaggtttaatttatatcctgtcgatggatttgactctttagcaaatgttttataaaagcctgcatgtttcataccggcaggtttaaaaatatgctttttgatgtattggtcgactggttcaccgcttaccatggaaacaatgtatgccagaaccgagtaattggagtctctataatcccatttccctgttgggtattttacaccccgtttttcgatatctttaattaaatcttccggcgaaatatatccgcggccttctttgtgacccctaattccggatgtgtgcgtcaagaaatgataaagggtgatctttgagccgtttggaaaattgggaagatacttagaaacagggtcatttacagatagcaatcctttttcctccagctgtaaaattgccgttgcaataatcgctttttgtgatgaccccacataaaagacggtatctggtgtattgggaaccatttcctcgcggtttgcatataaataccctttgcttgtcaccacttttccatcttctacgatcaatgctgtgccgctgaatccaatgcttttcaaatattgatccaattgagcattatcattttttgtgacgattttgctcttttttgtttcattttgtgttggctttttctttgcttcaggctgtgcctttttttcagttgcttgcaattggttttcctggtgatctcgcataccgcttggaagtgcaagataaattaatccacaaacaaccaaaaaggaaaatatgataagccttctttttgttttctgcttttttcttttctttattcgcgttctgtatgttcttgccatgtcgggtactccttcttttatatgtgacgtatttactgacgcaataaccccttaaaaagtttcttcaaaatgctaatattttcatacatgaactcgaataatgccaaaatttacattttgtttacacttgatcaagaacaaatgttcgtataaaatagaatgtgaggtgagacgatgaataagctgttgtatcgttccatggaagacggcattccggtagaaatcatatacatgaaaaaaagcggtttttctaagcgggcgattcttgtgaaagaaataaaaaacggttatgtgaaagcattttgcttccaaaaacaacagatcagaatgtttaaaatagagtccattttgtccgtgttcccatataaaaaaagaaattcagcccattatgcttaaaagcttcaccatcatcctgccttctttctgtattcccttcctgttttgatattccatcttttgttataatgaatgtaaattcgatttaaagagagcgggcgttttacatctatgcttcagacaatcaataaaacacttggtaagattatgcctttgctgacgcctttaagcgttgtcagcggagtactgcttgcagattatttaaatgggctggcgagtcttgtgccgtggatttttgcgtttatgacgtttgccggcagcctgggagcaaattttcagtcgctgaaaacagcggtggctcatcccttgccgatgtttctcgctttatttgttttgcacatatttatgcctgttttggcatggagcacggggcatcttgtgtttagcggggattcattgacgattacagggcttacccttggtgttgtcattccgacgggtattacgagcatgatttgggctgcaatgtataaaggtaacatcggtttaaccctgtcaattattttagtggacacgattctttcgccttttattgttccattcagtctttccatcttggccggggcgcatgttgaaatggatgtcatcggcatgatgaaggggttagttggaatgattgtgattccttctttattgggaatgctcgtcaatcaattttcaacgccggagcggacagtgcgattaagcgcaaattgtgctccgttttcgaaagtcgggttagccgccgtagtggcgattaacagctcggtggtcgctccttaccttaaaaacgtcgatttaaagtttttaacgatagccgttacggtctttttggtggcatttacaggctacctgacagcttggctgataggacggctgatgaagcggccccaggaggaaatcgtggctttaatttttactggaggaatgcggaatattagcgcgggcgctgtgttggccactagcttttttccgcctcaagtggcggtgcccgttgtcattggcatgctgttccaacagattctggccgcgctgtttgggcatttgcttgcaagaagcgagctgaaaaaagcgcatcatttggacaaaaagacgagtctgccctcatagttggcagactcagatcttgcgggagttaaatataatgaaaaccaatagagtaagtgtaatgatctggactttaatctccgcttttctgttttgttctatgatagtcgcagcttcactttctccgctcgctcattcaggccctcatgctaatgagtttggcactttggggatgtgggcggcaatcggaaccgttttgctcttttatatgctgcccctcgctgtttatatggccgggtttgatgcaatgaagtttgtaatggctgttctttgcggaattgggttaatcatcacgctgactatgagtccagtgtttgtgttgattggcgctattggcggaaatgcttctgcattactgggtgtcgcaggtctttgcgttctgttagcgattgtgaatgtgatttggctagtggttgcttttcgccggacgtcagcaagtgcctctttctgatattcaaagttgtgttcaaatttgccaacttcctttagcgatcaggtggacgtttcccccgacgtgaatttctgtgctgttttccgttatttgggcttcaagatgaagcagggaagggcggtttatttcaaatccttgttcagcccttatgctgaggtagtgttgattaaaatagccgtgatgcagtaaataccctgcgagacccccgattgcgcttcctgttgccggatcttcaggaacgctgaaacagtcgcaaaatactcgtgcattgatgtggttttgttcatgatatgtttcggtagtaaaaacgagcagacttgcttctgtttctttcatgaaagcttcaaaccgatccttgttgattttgcattttttaactgcatttaacgagtttaacggtacgataaccgctggaagccctgtagaaacctcctgtatcgggaaattcgaatccatatcagatgtgtcgattccaattacccccgccatcatttctttatcaaaggttcggttaaacacgggcggattttgcttcatccaaatgatttgatcagcacctttttcaaacgtcaccggtattgcgcctgctgttacatttaaaatgacattagaagatggttcagtttcgatttcattcttaatgataaacgctgtgcccagcgttggatgtcctgcaaacggaatttctttttccggggtgaagattcggacatcgtacccgccgtttccctgttttcccaatataaaagtagtctcggaaaaattgatttccctggctattttttgcatttcatcacttgataggttcttttctgctttaaaaacagcgagctggtttcctgtatattttgtttctgcaaacacatccacaagataaaaatccatctgaagtatctcccctctaataagacgcagtttcacatatcttacatgagatgggaatgattgaacagtctaatcaaaaataaagaagagcggctcccgctcttcctaataaagcaaatacttctttctgatattcataaaccgtttttgctctgcttcgtattttttggcgatttcatcaattgaagcgccttgctcaatcattgttttgacccatccgttcccgatcagacggttgaaattgcctgaagggaggaactcaaagtcgtccgggtagaggtcatggacggttttgatgatcgcaataccggtatttacaggcttaaaagcggacctgttggtcacgtaaagctccaccccgtggcacagtttattctgatgctttgaaaatgtcggattgaaggaggcggctctgaatctgacgccaggcagcttcagaccgtttaatttttcggcgagctccgtacttttcatgtaaggcgcaccaatcaattcaaatggctttgtcgtgccccttccctctgacatgttggttccttcaattaaacctgtgcccgggtagacgatgctcgtatccggcgtcggcatgttcggggaaggcaggacgaaaggaagaccggtgtcttcaaagaacatctgccgcttccagcctttcatttttatgacggttaggtcggctccgatgttaaattcatcattaaacagctttgccaattctcctgccgtcattccgtgacttagagggacgggatacattccgacaaatgaagaataatccggatctaggacaggcccttcaacttttaagccgttttgcgggtttgggcggtcaaggacgatgaatggaatatcattttcttttgccgcttccatcgcatatgccatagtgtaaatgtaagtgtaaaaccgtgttccgacatcttggatatcaaatagcaggacgtcaacgtttttcaacatctccggtgtcggctttctcgtatctccgtagaggctgtagacggggagaccggttttttcatcaatataagagtcaaccttgtcaccggcttgagcgtctcctcttacaccgtgctctggaccatagagagcggtcagctcaataccgggggcttggtgaagcaaatcgatgctgcttgttaatgtcgaattgacaccggttggatttgtaatgagaccgaccctttttccttttaatatgctttttttgttcatgagcacttcaatacccggtgagacctttgcttttttttctttgtccggaaaggcagctgctgcggttagtgtactgaagacaaacattccagcaagcagccagattgctttttttcccatcatgaccctcctttgtgaagcggcttgccgtttttaatattcaatccgtagccatacgggtaaagggtttccccggggcgcgtgactgaaggaatgtctacgggcaatgttcctttaggctttgcctttccgaaaatggcttccactccggccgggatattcggctgcctgaagcgtccgtttgcatagcctttaaagccgtataccgcaatcacggcttcggcttcttcaaaatttgccgtgtcataagggtttctcaggctcattaagacgaatttttttccgttggcctgcgcgtatttcatggcggcgcgcggaaaagcggttgcccacttgcttgagtcttgaatgctgtcatcaatgacaccgtcgttcacaaccggatcgtttttgatgacgtatgatcctgtgatgacataatcggcttcgtcaattttcttttgaatctcttcctcaaacgttttttctgcaaagcggtattcgactaccttgatgtttttccttattttgctgatggtctttgcgattgctgctgtttgctcttcatatggagcgagaatgaggacggtgtccccttttttcggtttaaacggcagggtgcttttgtcgtttttaaggatagtggcgctatcccttgccattttcttttcgtatttcatgtgtttgctgctgccgaccgttttcaaggcgtatttgatttttttctgaagcggttcggagccggtgtgatctatgatgcctcggtctatttttaattgaaggattcgctccaccgactgatcgatttgttccatggggatatccccatttttaacggctgtcagaagagcttcgaatacacgcgccagatttttttcggtctcaagcgatgtgacttgcgcgggcatgagtgcgatgtcgactcctgctttaacagccatgacgacggcttcctcctgtccgaaattatcagaaatggctttcatatttaaagcgtctgttacaacaacgcccttaaagctgagatctttgcggagaaggtctgtcatgacttttttggaaagcgtagcaggcaccatgatgtcctcgccgtcttttttgcttttataggtagtatcgtcaaaggcggggaactggacatgcgctgtcatgatcatgtcaatacctgcatcgatcgccttttgaaatggcgcaagttcaacacttctcagccttttttcattatgcggaacaagcggcaatccgtaatgactgtcaaccgctgtatcgccgtgtccgggaaagtgctttgctgtggcgatcatttgctcgtcctgaaggcccttcatcatctggatgccgagctttgaagtcagctcaggcttggaactgaaagaacggacgccgatgacagggttgtcgggattgttgttgacatcaagtacaggactgaaattcacgttaatgcccagtgatgataattcttttccgatgatttttcctgatctgaaggcgtttttgctgcttctcgatgctccgactgccatattgccggccaggtttgtgcctgattcgagtctcgtgacaatcccgccttcctgatcgatcgtgataaagagcggaatgtcagggctcgcttgttgcaggccgtccgttaaccgtacagtctgctctgtgcctgtgacgttttcagcaaaaagaatgacgcccccgagccggtatttttcaatgattccagcaacttcgtcattcatttctgttaatcctttggcgctcgattccccttttttcttccagtttctaaagtcaggcatcagcatttgcccgattttctcttcaagcgacatgctgctgaccatttgtttgatgttttgttccggacgctgttttgcttctgcttcgcgagcggccggctgcaaagcgagagacgataacagcaatgcaatcaacgcgcattgaagaaatcttttcatataaagggtcgcctcctattggtgatgtaacgcctcgtaaacagctgtaatgacgctgccgtactttccggttgcaaattcatcaccttcgaattgattcgggttttctttagggttgataacaggagagtgctttttattggttaacaacacaatgccgatttgatacacgggatcaatgatagtaaccgttcccgtccagccggtatggccatatgctttgctgctggcgtgcttgccgaacatccactccatatcggtattgccgttgagccgccatcctagtccatatgtgggatttgtttttgacggctctgtaaattgtgaaatgacagaactgctgaatagatgctgtcttccgtaaccgccgccgttcagcatgacttgaaggagcactgctgcgtcgtcaacggtggaaaacaggccggcatgcccagaaacgccttccattgaatagaatgctttttcatcgtggacttccccctgaagtgtgtaagttctgatgtttgggaacgaaatggtgccgtctctggtgtttcccaatcgttccgtagctgcaaaatgcgaccgtttaaagcccttttggagcggattaaacaaagtatgccgcaatccgagaggccggtaaaaccggttttcaacaaaggtatctaaacgctcgtttgtgattttttcaatgatcagcccgaggagcatatagtcgatgtcactgtaaatttgctttgtgccgggttcatatgccaagggggttttcacaagatattcaagcgttttgctccgtgattgagagtagaggtgtccggctgatttcgggtcgtaataattccagcttgcagggaagcctgcgttatgatgaagcaaatcaatcacgcggagccggttttttccctttacatcgtcttccgggtgatctttgaaatcagggagatattgagaaatgtttttgttcaagtcaagctttccggtgctcactaaatgctgcaaggcaaaattgacggcatacatttttgtattggaggctaggtcgaacatcgtgtttgctttcattttttttggatgtttgagcgctatgaggccgttgtatttctgcttgtagccgtagacttcttttttgatgatttttccgtctttaatcaaaataagggcagcgccgggaaagcccgctttgacatcctgttcgatcagacggtccacagctttaagctttttcgaagaaaaaccggcttcttcaggcgttttcgctttcgttaaaacaggatatgtcagccgctgttttgtctcgttcccgatggcagtctgtgctgtggacggaagcggaaaaaagcatgtcagcagcaatagggacgcggccgcactgatcataaactttttcagcttgcttcactcctttctgttaaaaattgcatagtgggaaattttaaacaaacgtttaatcaaattcaactgccatatcgtccttgaaaccaaaggagtatgttaagacaaagccggcagcataggaaataaacaaaccgagaatatacaaaagaacttggtgggtatgaaccaaaaacgacaaagggagccctgatacgcctatcgatacggtcgcaattttgaaatacgcttgaaatgctccgcctactccggccccgaggcacgcggttaaaaacggacgtccgagcggaagggttacaccgaatatgagcggttcgccgatgccgagcaggcctgacggcagtccgccggcaatggctctttttagctttgcttttttcgttttgaaatagatcgcaaaagcggcgcctacttgtcctgcgccccccatggccaaaatcggcagcagcgggtcatcgccgattgaattgattaattccatatgaacgggtgtcagtccttgatgaagtccggttacgacgagcggaaggaaggtggcgcccagtacaaagccggcgataatgcccccaagatctaagatggcgagaagacctgacgtaatggcgtcggaaatcaagccgccgacaggcatgaagacaacgtaggtgacgattcctgtgataagaagggagactgtaggtgtgatgatgatgtcgagtgagtgaggtacaaggcgcctgacccgtttttcgagaaaagcgataaatgcagctgcgaataaaatgccgattaaaccgccgcgtcccggcaaaagcgcttcaccgaaaagtgaaatttcaccaacggcggggttaatgattaaaataccggctaatccgccgagtgcgggggagccgccgaattctttcgccgtattgatccccaccaggatacccaaatacgtaaatagacctgagcctattaccgttaaaataatcgcggtttgtgaggtttccgcgagccagccagcctggataacggctttggtgattccggtaatcaagcctgaggcgaccaaagcggggatcagcggtataaaaatgcttgcgattcgccggagaaacagcttgaaaggcgtcgcgtttttcttggaaatctccgctttatgtttggctgcggattcttttaagtcaacgtgttctgcggatttaagcagcttcccgaactcgtctgatacgtgctgtacaacgcctgtgccgaggataatctgaagcgtttcctcctcaactacgccgatcacgccttcaagcgctttgatcgagtcgatgtcggttttttgactgttgacaggcgtgatgcgcaggcgcgtcatacagtgggtatgatctgcgacgttagacgggccgccgatgtgttgtaaaatcagtcttgccagcccggcatattttttctcatcgctcattttatatcccccttttttacaattcgctaaattcccatcatgcggatggccgcttttgtttgatcaatatactgaatgatgtcctcgtagcgctctgcggccatgcctaaaaacagtaagtcaatcatgtaaagctgagttaaacgagaggaggtggcggcgctgcgaaacggcgcttcatttgagcatgacgtatacagggcgatatcgcttaatgaagcgacagcagactgtcccaaccgcgtcagcccaatggttttaataccatgttttttggcgagcctgactgcattggcgatttcctgtgtttctcctgaatgggatatagcaaacagaacgtcattctcgccggcattggcgattaatgtcgcaacaagatgcatatcactaaaagcggtggcctttttattgatgcgcaaaaatttctgctgggcgtcttgtgcgacgattcctgaagccccgatcccgcaaaaatgaaccgtttctgcgttgatcaatatttgaatcgctttttgaagttcttcgtggtcaatgttttcaaaggtatcgcgaatcgcctgaatcgaattgctggttgttttttgaacgattgaatggagcggctcctgcggttcgatatcccggtatccctgatcagacggcttcattaaatcaccggcgactctcatttttaaatcttgaaagcctttcagccccaaagatttgcagagccgtatcgccgccgccccgcttgtctttgccgaagagctcacctcctgaatggtgccgtttacgatctcgtgggggtttttcaaaatgtattcggcaagctttcgttcagattgcggcaatttgtgaagcatattctgaatgatttccaatcctcctgcagccattgtttcttcctttcttatttaagatttttcataaatggatagggccttttcaatatcgccttctgatttctccagcagtttttctgcagcggctgcatcttcgtttgttttcagcatgatgatggcggttttgacttggttattggacatttccaatgcttgcgccgctgtttcatttggcatacctgtgaccgtttggatgatgcggatcgcccgctcctttaatttgtcattgcttacttttacatctaccatgaggttttcatagactttccccattttgatcatggccgccgttgagatcatgtttaaaatcattttatgagcggttgcggctttcattctcgtcgatccggcaatgacttcagggccgacgactacttctatgctgtgatctgccgcctggctgatcgccgagttttcattgcatgtcagcgatatggccttggcacctgttttcttggcatacttcagggcgcctaggacgtacggagttcggccgctggcggcgattccgattacggtatcattgtttgagaggttaacggcttctaaatcccgtctgccaaaagcctcatgatcttcagcgccttcgacggcattgtacaaagctttttctccccctgcaatgatgcctatgaccgactcgggagatatgctgaatgtcggcgggcattcagctgcatcaagtacgccgagcctcccgcttgtaccggcaccgatgtagatgatccgtccccctttctttaacgacccgacggcgtagtcaacggcggtcttaacatcgggcaagacttcttgtacagcttcggctaccgttttatcttcatcattcatgattttcaacatatcgatcgtttctgcctggtgaatgcgcttggatctttcattgcggcgttcggtcgttaaggaacctaaatggctgttttccatcgacaaatcctcctgatcataaaatgcatatatttctcaattttcagtatattatggctgaaatataatttcaataacaaaagataaatattaaaattttgtttcaattaggttctaaacatctgaacgccgaaataaaataaagcgcagatgaactgcgcttatgtcctggtactacagctcgtctatttgatgttcggaaatcacacggaagccttcttttttcagaagtgccgccgtaaggccgttgccggctatttttttgcttgagaaacttccatcgtatatatggctgctgccgcaagacgggctgttttccttcagcacgatcgtatcagccttgatttgccttgccatctccaatgtttgatatgccccttttacatataggtctgttacgtcatttcccgattgtgtcttgatcaccgctttgccgtctaaaacgtcttctcccgtcccgcctataatttcggccggttcccttggtgtttgaaatccgccgagcagctcgggacaagccatcaccgcttttttttcttcaacgagcttattgattttttcgacatagctgtgcgaaccgttatagcggcattccactccggccagacatgaacttaccagtatcattattcggtcccctctcttgcacatcagatagccctattttaaacaaaatttccgcgcttttctcaatctctatgataaaaaatttgaaaataaaaattttaatttacctctttacaaatggggaggaacctgtatataataacttttgtcagctttacgagagttgcttgaaacacggtgatggcccgttggtcaagtggttaagacaccgccctttcacggcggtaacacggttcgaatcccgtacgggtcaccattcttttttggacggcacgctgggaaaaggaaggcatgctaaagggagtaacattctgttgcaacgcgcacttgtacttcaaatgcaaggaaggcatgctaaaagcgcaacgtcctgttgcaacgcatgcacttgtacgtcctgtacttcggaggattagctcagctgggagagcatctgccttacaagcagagggtcggcggttcgatcccgtcatcctccaccatttttcgaagcggttttagacacaactgcgccggtaactgcataagataccgtatcatgccggtctagctcaattggtagagcaactgacttgtaatcagtaggttgggggttcaagtcctctggccggcactgtttttggaggggtagcgaagtggctaaacgcggcggactgtaaatccgctccctcagggttcggcggttcgaatccgtccccctccaccattattgggctatagccaagcggtaaggcaacggactttgactccgtcatgcgctggttcgaatccagctagcccagtttttggacatcctgctcggatgtcctttttattttgtcttttttgtataactattcaaaaaaatgtcttgttgagtcaattccgaatcggaaggtacaatgaaggtctgaaagggggatatcatatgttaaaacagcagatttcaatgatcggcgtgccgatggatcttggacagctgaggcggggagtcgatatgggaccgagcgcgattcgctgtgcaggtgttaatgaacggctggaatgtctttgtcaggatattgaagacctcggcgatatgacgatcgggcaaagagaggatgagaaagaaggcggggagccggcatctgaagagctaagaaatttgaaagcgattacaaaagcgagtgtaaaacttgctgagactgtcgataatatcgtagcttctggcgcttttccgctcgtgctgggcggtgaccacagcattgcgatcggaacgcttgccggccttgcgaagcattatcaaaacctgggtgtgatctggtatgacgcccatgccgatttaaatacaaaagaaacgtctccctcaggcaacattcacggcatgccgctcgccatcagcctgggaatcggccacgaagggctgaccgccatctatggaaaagaagctaaaattaaagcggagaacatcgtcatcatcggtgcgaggtcacttgatgacggggaaaaagaattgattcgcgacaaagggatcaaagtatatacgatgcatgaaatcgaccgcctcggcatgacaagggtgatggaagaaacgatagactatttgcgaggcaggacggacggtgtccatctgtcactcgatttggacgcgcttgatccgaacgatgcaccgggtgtcggaactccggtagcaggaggcatcagctacagggaaagccatctggctatggaaatgcttgaggaatcgaagctgattacgtccgccgagtttgtcgaagtaaacccgatattggatgagaaaaacaggacggcggaagcggctgtagccttaatgggatcgctgtttggcgaaaagctgctttaggtgcagttgaagagcggcttcaggctgctcttttttatgatagaagtctcaacttcataatatttatgatgtataataattttaagctaatattaagcgcatgaaccctgtcaaagcatttacaccctgccaaaaatttgataaactatttttatgaatttaatgaaaccttataaaaaccaattcgtatacataaagaccggtgaaggcagaggttagataaatatggaaacaatgattaaaaaaagaatcaaacaggtgaaaaaaggcgatcgtaacgcatttgcagacatcgtggatatttacaaagacaaaatttatcagctttgctaccgtatgctcggcaatgcgcatgaggcggaagatattgcgcaggaagcgtttatcagagcatacgtgaatatcgacagttttgatatcaaccggaaattttccacatggctttatcgaatcgcaaccaatttgaccatcgatcgtatccgtaaaaaaaagccggactattacttggatgcagaggtggcagggactgaaggactgacaatgtattcccaggttgcggcggatgttgcgcttccagaggatgaagtggtttctttggagctgcacagcaccatccaggaaaaaatcttaaggcttcccgataaatacaggacggtcatcgtattaaagtacattgatgagctttcactcattgagatcagtgaaatcctcaatattcccgtaggtacggtgaaaacgaggatacacaggggcagagaggctctcagaaaacaattaagggatctttaagtggggtgatgaaatgagctgtccggagcatattgttcagcttatgcataaataccttgacggagacatacttccggaagatgaaacgcgtttaaaagagcacctccaatcatgcgaaggctgcaaaaagcaccttcatgaaatggaaaaatccatcgctcttgtccagagcacgtcgcatcttacagctccggcgaactttacagccaatgtgctggcgaatctgccgaaagaaaagcggacggcatcgatcaacaggtggcttaaagcccatccgtttttagtggcggcggctttatttgcaattttgatgggcggcagctttttctccagctggaaaaacgatcacgatttcagcgtatccagccagcctaatcttgtggtgaaaaacaacacggtcatcgtgcctgaaggggaagttgtcaaaggcgatgtgaccgtgaaaaacggaaagctgattatagagggcaaagtcgacggcgatgtcacgattgtaaacggtgaaaaatatacggcttcagcaggacaagtcaccggtcagatccatgagatcaacgaggtgttcgactggatctggtataagatcaaatcgaccggaaaatcggtttttggtgtgaaggagtctaaagagtagagcaaagcgggcgaatgagctttgctctttttttatgaggggccgccatttcacttggaaaatcaatttgtgctataatagcccctgtatatataaaaataatagatcataccattttgaaacatattaaccttactaatgactgaattcttggaggacgaggaaatggcttttgaggatatccctttcttgcagtacctcggcgatgccgttgatattctccttgtttggtacgtaatatataaattaatgatggtcatccgcgggacaaaggcggttcagcttttaaagggaatcgtggtcattgttctcgtcaggctggccagtcaatatttaggattaagcaccctgcagtggctggttgaccaggcgatcacatgggggttcctggcgattattatcatcttccagcctgaattgaggagagcgctggaacagctggggcgggggcgctttttttcgaggagcggaacacctgaggaagagcagcagcagaaaacgattgatgcgattacaaaagcgattaaatatatggcgaaacgccggattggcgcgcttctgacaattgaacgggagacgggaatgggcgattacatagaaacggggatccctttgaatgcaaaggtcagctctgagctattgatcaacatctttattccgaacactccgcttcatgacggagccgtgattatgaaaaacgatgaggttgctgcagctgcctgctaccttccgctttctgaaagcccttttatttcaaaagagcttggaacgaggcacagagcagcagtgggaatcagtgaagtgaccgacagtctgacggttgttgtatccgaagagacgggcggcatcagcgtcgccaaaaacggagaccttcaccgtgatttatcggaagaggcattgaaaaatatgcttgaagcggaatttaagaaaaattcgcgggaaacttcctcaaatcgctggtattggagggcgaagaaaaatggataagttcttaaacaatccctgggctgtcaaagttgtcgcgttattgttcgcgtttcttctttactttgcggtccacagcgctcaggcgccgactccgaagaaaccaggtgaatcgtttttcccgacatcgacaacagacgaagcgacgctcaccgatataccggtcaaatcgttttatgatgatgaaaactacgtcgtaacaggcgtgccgcagacggtgaatgtcacgattaaaggcccgaccggaaccgtcaagaaggtcagacaagtgaaggattttgagatttatgccgacatgcaaaacctgaaaacaggcaggcataaagtcgagctgaaggccagaaatgttgccgacggcctcactctgaccatcaatccatcggtgacaaccgtgacgatcgaagaaaaaacgacgaaggaattcccggtcgaggttgatttttataataaaaacaaaatgaaagacggctacacgccggagctgccgatcatcaacccgaaaaacgtcagcgtcaccggctcaaaagccgtgatcgacagaatccagaacatcaaggcgacgatcaatttagagggcgtcgaccagacggttgaaaaagaagccaagcttacagtatacgacaaggacggaaatgtcctgccggttgaagtcagcccttccgtcgttaaaatcaccgttccggtgacgagcccgagcaaaaagattccggtcaaagttgaccggaaaggcagccttccggacggcatcagcatttccagcctcgatataagtccgggagaggtgaccgtctacgggccgcaaaatgttcttgattcgttagaatttgtcgaggccgacgagattgatttaagtaaaataaaggatgatactgaattggaagccggcattaaagtgccggacggcgctaaaaaggtgtcacccgaaaaagtgaaaatcaaggtgaaagttgacaaggaagaagagaaaaaactgaaaaacgtttcaattaaaaccgcggggctgaatgacagccgggatcttgaatttctcgatccgaagtcaggcaagctggatatcacggcaaagggctcgacagccgcgatcgaaaaactccagccttccgacgtcgagctctatgtcaatgtggcggatctcgatgacggcgagcacaatgtaaagctggaagtaaacggtccgcagaacatgacatggtcgctgccgcggcaaagcattcgagtgaaaatctcatctcaaacaacccaaaacgaaaaaaacaatggtcaggatgaagaagaagagaatcattctgaaaaggattcacaaccttcatgaatcaaaaaggagcgatattaatgggcaagtattttggtacagacggtgtaagaggcgtggcaaacagtgaacttacacctgagctggcctttaaagtcggacgctttggcggatatgtcctaacaaaagataaggagcgtcccaaggttctgatcggccgtgacacgcgcatttcagggcatatgctggaaggggcccttgtagcaggccttctttcgataggagcagaagtcatgcgtctcggcgtgatttcgacgcccggagtcgcatatttgacgaaggctatggacgcggaggcgggtgtgatgatttccgcttcccacaaccctgtccaggacaacggaattaagtttttcggcggcgacggctttaagctttccgatgaacaggagcttgaaatcgagcgtctgatggatcagccggaagatcacctgccaaggcctgtaggcgctgatctgggcatggtgaacgactactttgaaggcggacagaaatatttgcagtttcttaagcagtctgctgatgaagacttcacaggcattcatgtcgcgcttgactgtgcgcacggggcgacatcttcgctggcgacccacctgtttgccgatcttgacgcagatgtatcgacgatggggacttctccgaacggattaaacatcaatgacggagtcggatcaacccaccctgaagccctggcagaatttgtgaaggaaaagggagctgacgtcggcatggcgtttgacggggatggcgaccgcttaatcgctgtcgacgaaaaagggaatatcgtagacggcgatcaaatcatgtacatatgcgcgaagtacttgaagagcgaggggcgcctgacggacaataccgttgtctccacggtgatgagcaacctcggtttctacaaagcgcttgaagcggaaggcattaaaagcgttcagacagcggtcggcgaccgctatgtagtggaggcgatgaaaaagggcggatttaccctcggcggagaacagtcgggacacctgattttccttgattacaatacgacaggcgacggactgctttctgcgatcatgctgatgaacacgattaaaatgacaggcaagccgctgtctgagcttgcggcagagatgcagaagtttccgcagctcctcttgaatgtgaaagtaaccgataaacataaagtaacggaaaacgaaaaggtaaaagcggtcatcgaagaagttgagaaggaaatgaacggtgacggccgcatccttgtgcgcccatccggcaccgagccgcttgtccgtgtcatggctgaagcgaaaacgaaggagctttgcgagaagtacgtaggccgcattgcagatgtcgtgaaagctgaaatgggagcagagtaattttccgcagaagactgaagaacgagacatgctgatttcacataagataaagggaaccgttcaatcttggaaaaaatgtgaaccattttgaaaaatgtttgacggttcctttagcgtatagtaaaatcagcttgtcttgtttaatttataaggaaaggcagggcagaaaaatttttatagttatagcgcccggactaagcgtacggatgaaacagcttagttgacgaggatggaggtttatcgaattttcggcggatgcctcccggctgacctcaaagatcacagccgcaaggatttcctcaaaccaaagaggcgactctttgaacaaagggaaattgcatgatcttccataaaaaacatgtaggaggggacgattgaaagtccccgcctgacaagcagactttcttcgtctcctgcctgcgactttaggaggaagaaaattatgtgtggtattgtaggttatattggccagcttgatgcaaaggaaattttacttaaaggtttggagaagctggagtatcgcggctacgattcagctggaatcgctgtagcgaacgaagacggcgtacacgtgtttaaagaaaaaggacggatcgccgatcttcgcgcagccgttgatgcaaacgtgaagtcacaagcgggaatcggacacacgcgctgggcgactcacggagaaccgagccgtctaaacgctcatccgcatcaaagcgcatcaggccgttttacacttgttcataacggcgtcatcgaaaactatgttcaactgacgcgcgaatatttacacgatgtaacccttaaaagcgatacggatacagaggttgtcgttcaagtgatcgagcaattcgtcaataacggccttgacacagaagaagcgttccgccaaacgctcatgctgctcaaaggctcttatgcgattgcattattcgatcatgaaaacaaagaaacaatctatgttgcgaaaaataaaagcccgcttcttgtcggccttggagacaatttcaatgttgtcgcgtctgatgcgatggcgatgcttcaagtgacaaacgaatacgtggagcttatggataaagaaatggtgattgtcacagacaaaaaagtcgtgatcaaaaacctcgacggagaattgatgtcacgtgcctcatatattgcagagcttgatgcgagcgatatcgaaaaaggcacataccctcactacatgttaaaagaaatcgatgaacagccgcttgtcatgcggaaaatcattcagacgtaccaagatgaaaacggcaagctctccattcctggagacatttcaaacgctgttgctgaagccgaccgcgtctatatcattgcctgcggaactagctaccatgcaggtcttgtcggcaagcaatttattgaaacatgggcgaaagttccggctgaagtccatgtcgcaagcgaattctcttacaatatgccattgctttctgagaagccgctgtttatctttatttctcaaagcggagaaacggctgacagccgcgcggttctcgtacaggtgaaaaagctcggacacaaagcgctgacattgaccaacgtaccgggatccacgctttcccgtgaagcggactatacgcttttactgaatgccggccctgaaatcgcggtagcgtcaacaaaagcatatacggcgcaaatcgccgttctcgcaattttggcagccgtgactgcggaaagccgcggcaaagaactcggctttgatcttgtcaaagagctcggcattatcggaaacgcgatggaagccctttgcgaccaaaaagacgaaatggaaatgatcgcccgtgaatacttgaccgtaacacgcaatgcatttttcatcggccgcggcctcgactatttcgtctgcctcgaaggatccctgaagctgaaagagatttcttacattcaagctgaaggcttcgccggcggcgaattgaagcacggtacgatcgcattgatcgaagacggcacaccggtcatcgcccttgcgacacaggagcacgtcaacttaagcatccgcggaaacgtcaaagaagtgacagcccgcggcgccaacccttgcgtgatctccctgaaaggcctggaagaagcagacgaccgcttcgtcctgcctgaagtgcatccggagctcgcaccgctcgtctccgtcatcccgctgcagctgatcgcatactacgcagcgctgcaccgcggctgtgacgttgataagccacggaacctggcgaagagtgtgacggtggagtaggagtcggttgaaataaaagtttgtacccctcttggattggatgatctggaggggtatttttatgtttgaaagaggaataagtcttatcaaaaatcgaagtgcgctagattgtaagtgaagcgcacagcggaatgccggggcggtttggacgatgctcgtatatatacttatcttttaaggaagtgtaaccatgaacaatgaaacgtacattgaagttaacagaacatcgcagcttatgaataaaatgagaaaatttacagtgctgattgatggtgtcgaggctggaaaaatcaaagatggcgggagactgcgaattgatttggagcctggcgaacatgagatccaagtgaaaattgattggtgtgtaagccaagctttgaggtttactttagatgaaggagaagtgttaaagtttagatgcggaagtccggttcgtgggtggaagatgttcttcggacttttttatgtattggccgatccagagaaatactcgtttattgaactggaagaataggcgattgaaagacggccttggtcttcatcatccccatcaaacgctgcaccgtaacaacctgactaggagtgtgacggtgcagtttttttatccgaggatgaatatgaagcggtgtcaatgatggaaaaaagccctatcctatttaaaacactttatttctataaatccgaatcgacagaagccatgaacacccatacagcgtaataattgatatggcaacgatcagatagagaaaagtattttgtaaggttagaagcatgtgaatgaactctctaatttgatcgttcaaattttggacgagaaagttaatcgttagcatatataagccaaatgcagcaatagaagcaatcacgagatagttgcttttgaatttataacagaatggcagcatgaatgaagcagctgtcatcacaatggcaaccattagcaagatgtctttccagatcgtaaattcccggtgaatgatgaagtgtacgataaatatggctgcagccaccatagatgtaaagagaacgacgacaatatactttgaactgacaatctctttccgtgtataaggcaaagaattgagaagcatatgtatagaagacttttcatctattgaaaaggcatacatcgatataactatactaaatacaaccccaacccagattggagaaatatctaacattaaataaacacataataccaaaaacgaagccgccaatgtttttttctgcaagataatatctttaagaattaagttgaacatgttctttggctcctttcttcgtatagaacataatatcttcaagggtcggtttttctattaacgccatgtccccaaagattttttctgttcgtgatttattcgcagtcaatgcttcaaatccatgagttgattttcgaaccgctataaattcctgttcggtctcccggtctaacaactccattccgccttttacaattgcatattgttcctcaatttcgtaaaagtcctttgtaaagatgtgctctcctttatcaatgaacgtgatataatctgcaatcttatctaaatcagttgtaatatgagtcgaaaaaaagatcgtcttatccccatcttgcatgagctgatgcaagatttccaacagctcccggcggaaaatcgggtcgagtccggacgtcggttcatccataataattaattccgcatgatgggacaaagcaacggttaatgatgctttcattatcatcccttttgagaacgtcttgattttttttgtgagcggcaagttaaatgtgttcacataatcattaaatacttgttcatcccaattgacataggatcttttcacaatatctttcattttagctaacgttaaatgttcataaaatatgttggaatcaaatacaaagccaatacgttgtttgatttctttctcatgctccttgtaattcatgccaaataccgtaattgttccgctgtcaggctgcaataagttcatgatcagtttaatcgttgtcgattttcccacgccatttccgccgataaatccggtgataaaacctttttttacgctcatcgaaaagtccttgagctggaaaccatcgaacgatttatgaacatgccggagttcaattacattgtccatcattcttcctcctgatataaaatggtaagcaagtcttttaattctgtaagggtaacgcctatgtctttgctgttttttatcactgccgacaattgctcttcgatggctttcatttttccttctttcattatttcgtcattctgatctgatacaaaagagcctttcccgactacggaataaatgaacccattcttctccagttcttcataagcgcgctttgacgtaataagactgacattcatgtcctttgccaattggcgcatagaaggcagcggctgtccgggtttcaattcattcgcaagaatttgatccttaatttgggtgtaaatttgttcataaatgggttgctttgaactatttgaaattataattttcattttaaaccctcttttgtttatatacaatatacacaatatgtacaatatacacaaagattgcttgaatggcaacgatttttttattctttggggagtgaattgtcagccagaatttgatgttaagaataaaagggcacaatacatattgacaattttcgatatgaagatataatgattggtatggaacctattgaaattttcaaagctttatcaaatgaatcaaggctgcaaattttgcaatggctgaaggagcctgatcgtcattttaagccccatgaagggattgatatgaacacaatcggggtgtgtgtcagcccaatctcggacaaattgaaaatgacgcaatcgccggcttcccaatatctcgcgatccttttaagagccggcctgattaaggcggagcgaatcggaaagtatacgtactgcaaaagagatgaagaggccattggaaagcttgctgactttcttaaaacagagatatgatgagcattaaaaaataaacatctcttgatgatgtttatttttacaccatacatatcgacatatttctgatgtgtttattttttaattttacatatcgttatttcgtgatatgtaaatgtataatgtgataaaggagcgaacgataatgtttagcacttggaaaatttatcttttagcaatcatcagttttttggtagggacctcagagtacatcatttccggtattttggatcagatcgcccacacactcgggataactttagctgcagcggggcagctcattacgatcttttcactggtgtatgctgttttcaccccggtcctgatggcgttgacggcaagtatggataggcgcaagttaatgatgtatgctctcggtttgtttgtgataggaaatattttggcttttaccctgcctggttatggttggtttgttgcagcgcgtgtcgttatggctttgggggcaggcatggttgtggtcacggccttaacgattgccgccaagatcgcaccggcgggtaagcagggcagtgcaattgctacagtcgtcatggggtttaccgcttctttgattataggtgttccactcggaagaatgacggcagaagcattagggtggaagtctgtatttgggggaattgctttattgggattcatcgcaatgattgttctattcttaacattgccgcatactgaaggcgataagcccgtccctttgcttcagcagctttcccttttaaagaaacggaaagtagcgatggggttatcggtcacttttttctggctcggaggatattccgttgcatatacttatctgtctccttaccttctgaccgtttcagggatcagcggcaatttgctcagcggcgttttgcttatatttggaatcgccagcttggttggatcgaagtttggcggatatagcactgataaatggggagttccttttacgctcgttggcgggatggcgctgcatatcatcgcactgattttgctgtcgcttgtcacccattcctatgtcggagtactgttgattctcatattatggtcgttcgccgcatggtctaccggcccgacgcagcaatatcacttagcgacgcttgaacccgaattgtcaggtgtattgctcggcatcaatcaatcgatgatgcaattcgccatggccgcaggtgcaggaatcggagggatttttgtagaaaaagtgtcgctggcttctattacgtggtttggggcattgggggttatgattgcgattgttgttgttttgacgaccttcagttcacggaaagcagcacatgtaagagaaatcagttcataatagccttgattggtgttgaagattcaagggtttcattcgtcatatcttacctgcttttttgagcctgacaggcagcgctgagccgaaaaatctagcatccgctcgctgtaaaacgagcggatgtttttttactcagctaaaatccgcaaataagctttccaaggtccgacatcatcctgataccgcttcgccagcactcttgcgatttgcgagaggtgagtgagatcgtgggcaacccaagttgagatctattctctaagcttgacgattccaaactccgggtgcatccccgtttgttcgaagtcggtttcaggatcaagaatctgccgcaatgttttcagattcgcccgtctgatttcagcaaattcgttaagcagctgttcaatcgttttcccgtcgttttgattcaactggctgaagcggtcgaacggcggaaaagtttccgttgctccttttgtcacgatcattttgattcggggcaaccagttgtttttttctccctcaatcagatggccgactacatcaaaggcgttccaagtgtcttcgccttcatcgcagctgatccaggggtttgataatccggtcagcagctgactcaatgtttgtggtgtgcgctccaggatttcgatggcttcctcgagttgaaagttcatgtgaatgacctcctccttttataaaagatcacgtcaactgccgctcagcaaactcccgatacagcgcatgcgaagcaatcagctcatggtgccgtccccgccctgtaatctcgcctttttcgataaacataatttggtccgcgttcacgattgtcgatagccggtgggcgatgacgaaggtggtgcggccttccatgaggcgggcaagcgcctgctggacgatggcttctgattggctgtcgaggctggccgtcgcttcgtccatcattaaaattttcgggtcgcgcaggaaggcgcgggcgatggcgatccgctgtctctgtccgccggacagcttgacgccgcgttcgccgacttctgtatcaagctgctcagggaattgtttaataaatgtatcggcatacgccatttccgcgactttccacagttcttgatcatcaatgctgtcggcgtgatccaagccgtagcataagttctcacggatggtgccggacatcatcgggctgtcttgagatacgtagccgatctggctgcgccacgatttcatcgacagcttgctgatcggtgtttccccgatgttaatggctcctgagtccggttcgtaaaatcgttccaagaggccgaacatcgtggtttttccgccgccgctcggaccgacaaacgcaatcatctgcccgggatcgacgtcgaaagataccccgcgtaagaccggctcgccaccggcgtaagtgaaagttacattctcgacatgtatcggcagattggagatgtccatctcaagcccttcctggccttcttcctcttcagaatgcataatctcgatgatccgctctgttgccccttttgctttttgcagctgagtgaaaaacattgtgaacgatgtgatcgggaaaatgatttgaaacagataaagcaaaaaggcgatcagcgagcctgccgacatcgtcccttcagagacgcggatgccgccgtagccgatgatggcgacgatcacaatcataatgacaaggtgcatgaacggggagacgagcgcgaatatccgagcttccttgaggccgtattgaaagagctttgaaatgcctgataaccctttcattttttctgtatgctcggcgtttgatgctttcatcaatctgatttcgcttaatgtctgctggacatgtccggtgaaggaagctgtttcatcctgcattgttttggaaatgcgctgcattttcatgccgagcgggatcatgatgaaggtcgtgatcggaacggagatcagcataagaagcgtcattttccaatccatgatcagcagaatgaccacagatccgacaatggtgatgattccggaaacaaactgcggaaaatggtcggaaatcaagctttcaacaatgccggtatcattgacaactcggctgacggtttcgccgctcgtcttttcgtcaaagtagcggacaggaaggcgcagcagcttgaaccacatgcgctcccgcagggaagcgaccactttctgcccggcgtaagaaagaaaataggtcgaaaacccgtcgcagaccgcttgaacgataaaaacgagcgcaaggattcccgataaggccagattgatcgaattggcggaaaagccgtcaaccatttcccttgtcaacagcggaatggacaagccgaccaaagtcgtgacgaggcttgcggtcaaaccggcgcttaaagccagcctgggtacgccggatgtgagaatcattgagaaaaacggtttcatgctattgttgttttctgttttcatttaataaactccttatcgatataatgtcaaagaagttgatggcgcaagctgtaacgcatcataatacgatatagacagctgaaagttcccgatcattgccgattttaactccatactaaaagtttgacagatgacataattgtaactattattgttacatatagttgattgggtgacaagaaaggaagaaaaacatgacaataaatattaaagtatattccgattatgtctgtccattctgttttctcggaaaagaccagctcgaaaaagcgatcgaaggcaaagatgtggaagtcgagtggctgccattcgaactgaggccgcgcccatcggagcagcttgatccgttaaacgacccggccaaattggcgatgtgggacggcgccattaagccgcgaatcgaggcttggggcgtcaatatgaagctgccgaacgtctctccgcatccttatacagatctggctcatgaaggctatcacttcgcaaaagaacacggtaaagggaaagcgtacaatgaccgggtttacaaagcgttttttcaggaagagcaggatatcggcgacatcgacgtattaacgtcgctggccaaagaagccggactggatgaacatgcttttaaagaagctttaagcgcaagaacatatcaggacgtgcagcggaaggcgctccaacacgcttacgaagaagccggcatcacggccgttccgacttttatcatcggcaatgagcggattgccggagccgcggcgaaggaagtgtttgaacaggcgatcgaaaaagaaagcagacaaaaacctgttgacggcttgcagtgcgatcttgacggaaacaactgctaagcaggaaaaatgagcgatttgaagaaccctttaatagggttcttttttataaaggaaagaagagggaagacagttgacacttcatcattttattgcagccgatcgggagcttccgctggggagcttccgagaccaaacagaagaaggtttgattagcatcgttaagcttgatccaggatacgaaatggtcaaaacaaaactcagcaagccgtttgtatatgaggcaaccggctgtttacatagacccggaaatgacataagggcgctattcagctatatcaattcaaatattcccgagggtgaagatatagaagtttactcttgctgggacggtgaggaagacaaagaaaaagacgaccgcttagactttttcattgatatagagaaccttcagctgggcaagcatgtcaagctggataaaaagaaatacatcgatgaaattgccggcctgttttatttcgaggagcggcagctggtcaagattcgcaaataaaacacttgttggcacagggtttccacggtttttttcgccgtttcatttagatatccaatcaaggaggaatcaagatgtccgatcacaaagcggtacacagcgttcaagcgaaagcggaggggaaaactctggtcatggagcggagtttcgaggcgccacgggagctggtgtttaaggctttttctgggtcagtgcatttggaaagctggtgggggccgaaaggatggcagactgccaacagcaggtttgagtttcagccggatggcgtatggctttactgtatggaatgcagagatcaaaaccaaggcgaattctatggccggaaatcttgcggcaaggctgtttttcaagagattgcggcgccggaaaagatcgtgtacacggatatgtttacagacgaggaagggaatgttgttcccggcatgccggagattttgaatgaggtttattttcaagagcgcgacgtggggacaaaactgattacacgctcacatttttcttctccgaaagagcttcaacagctgctggataaggggatggtcgaaggcttttcttcacagctggagcgccttgaagactacctgaaagccattcgctaaaagaaggaggacatgtcgatgacgtttttagagcatttcatataaccgtgtattcgcggacctcctcatcaagatttactacaacaatcaaaaagaggaggtatatacatgcgtacagagcaggaaatcatcgatttggtgctgaaggtcgcacgggaggacagccgtgtcagagcggtcggcatgaacggctcgcggacgaacccaaacgtcccgcggacgaacccaaacgtcccgaaggacccttttcgcgattatgatattgtctatgttgtaacagatatgcagtcttttctcgatgagccgggctgggtggacgtttttggagagcggatcatcatgcagacgccggaagcgatggagctgtttccgaatgagcttggcaaccgcttttcgtatttgatgttatttacagacggcagccgcattgatttgattcttgtgccgcttgaagaaaagctggaatatagcagggaagacggcttgaccgtgatcctgttggataaggatcaggatctgcccgtcatcccgccgccgacggatcgggaatattgggtgcaaaaaccgtccccgcaatgcttcgccgactgctgcaatgaattttggtggacatcgacatatgtggccaaaggcttgtggcggcaggaaattctttatgcactcgatcatttaaatctcgtcagggccatgctgttgaaaatgctcgaatggaaggtcggctttgaaacgggcttttcgctgagcataggcaaaaatgcaaaatttttggatcgctatgttgatcaaaatacgtgggaaaggcttttggagacgtatccgccagctgattataagcgggtatggaacagtttgtttaagatgtgggagctgtttgaagagacagcagcagcagttgctgaacatctgaatgaacaataccttttcgcagaagcggagaaagtcagacagtatctgaggcgcgttcagcagctgaaacctgatgcaaaggaaattgactaatcaaatgatggccgcactcccggcaggtgagccgggagtgcgttttttgcggaggtgaacggaatgttcagtattaaaaaaatgctgcagaaccattatggaatcgacagtgtgaacatttctcccgagcaaggcgggtggacagcacttgcttatcaagtaaccgacggtgaagcggctttctttttaaaagtgtatgataaaaatagggcatcgacagcgaaatgggcagctttaatcgatgattacatccctgttctggggtggctgggggatcacaccgctctcaacgggaggctgcctgtgccgcttttgacaacagctggagaatacaagtgtgaagatgacgatgcggtgtatatgctttatgaatacattgccggtgaaaccattggagatcagccgctcggcaaagggtgcgtggagaagctcgccggaatcatagcggagctgcaccgatatgatgagacgatcccggtgaagacagaaggaattaaagaaaaatatgatatttcgtttttagatgagatgacacaatggcttgatcacctgccttgtgagctggcgacactcattcaaccctacagcggagcaatccgcgatatgatggagtcagccttatccctggcggatgatttgaaatgcagcggcagaagattggctttgtgccatacagatgttcatggctggaatttgatgaaaacgggcggggaattgattctgatcgattgggagggcttgaaactggcccctgttgaagcggatctgatgttctttgctaaccagccgtatgctcaagagtttttgcgcgtttactgcgagactcataaaggatttgaaatcgatcagaacgctttgcggttttatcagatcaggcgaagactggaggacatatgggagtttacagagcagctggcgtttgacattcagacagagaaagaaaaggcagagacgatgagcttgctgaaaaacgagcttgaagccataaaagacagcaagaccggctactaaaatgctaaacggaggaacactcgtgaaaaattatcgtactttattttttgatgtggatgatacactattagacttcggtgcggcagaaaagtcagcattgcgaatgctttttgaggagcagcaaattcgtttgacagctgaaatagaagcgaattataaacgaatcaatcaaggtttatggagggtgttcgaaaaaggggagatggaccgcgaccaagtggtgaacacacgcttttcccttttattcaaagaatatggtcttgaggctgacggcgttttgcttgagaagaagtatcgcagcttccttgaagaagggcatcagctgatagacggcgcttttgaattaatcaaaagcctgcgggatcaatatgatttatatatcgtgacgaacggtgtttcaaaaacgcagtataagcgcctgcaagcttcaggattgtacccgatgtttaaagggatttttgtttcagaagacaccggttttcaaaagccgatgaaagaatactttgattacgtttttgaacggattcctcatttttctgtcgatcaggggctgatcatcggggattcattgacagcggacatagaaggggggcggctggccggattggatacatgctggatgaatccgggcatgatagcaaatgacactggtattgtaccaacctatcaaatacaaaaacttgatgagttgtattatattttaaacattgaaaaagaatcggccgccggccattgtttataaggaaaaacgggcgcattttgattggttattcaagatgcgtactgctttttgatattataagaatattctttatattgggatagttgtttcttaataaatagatagagtaaaatttgttctcctggaaaaaacaattgtatttttggaaggagtttattatgatggaataagtaaattttgagatatatactaattgtaattatcagatttttattactacttaatacgatgaagatgctttgtcatcatatagttttttgggtgacatcagccgtgtaagaggaggaaaagaagtggcgaacaaagaattgaagagaggcctgggcgcgcgccacatccaaatgattgcgcttggcggcactatcggcgtcggtttatttatgggatcttccagcacgataaagtggacaggaccttccgtcctgcttgcttatgccatttgcggaatttttatcttttttattatgcgtgcaatgggggaaatgctatatgtagagccaagcaccggttcatttgcgacattcggccatcaatatatacacccgttggccggatatatgaccgcgtggagcaactggtttcagtgggtgattgtcgggatgtccgagatcatcgccgtcggggagtacatgaagtactggtttccggatcttcccgcttggataccgggcattatcgcaatggcgattctcggaggagcaaaccttgtctctgttaaatcatttggtgagtttgaattttggtttgcgatgattaaaatcgttacgattgtattaatgattgcagcggggttcgggattattttcttcggattcggcaacggcggacaagcgatcgggttttcaaacctttggtcgcacggcggtttctttacaggcggattctcaggattcttctttgcgctgtcgctggtcatcgccgcttatcaaggggtcgaactgataggaattacggcgggggaggcaaaagatccgcaaaacacgctgagacacgcgatccaaagtattatttggcgtattttaattttctatattggcgccatcttcgtgattgtcacagtctatccttgggatgagctgaatgcaatcggtagtccgtttgtatccacttttgcgaaagtcggaattacggcggcagccggcattattaacttcgtcgtcatgacggcggcaatgtccggctgcaacagcggaattttcagtgcgggccgcatgctttatacattgggagtaaacggccaagcgccaaaattctttacgaagatttccagaaatggcgtgccgttatacgggacgattgccgtcttgatcggtttggcaatcggcgtcgttttaaattatattgcgccgcctaatatttttgtgtatgtatacagtgcgagcgtgctcccggggatgattccgtggtttgtcattctgctcagccatatcggattcagaaaagcaaaaggagctgaaattgacaaacatccgttcaaaatgcctttcgccccagtgacgaactatttgacgattggtttccttcttatggtattggtgggcatgtggttcaacaatgacacacgcgtgtctctgattgtcggggttattttccttgcggttgttgccgccagctattatgtgtttggaattggcaagcgtgcctcagctgatgggaataaataatgaaatttttaaggcgcttggggctgtcgagatgttattggcagccctctcaggcgctatgatcaagaaccagctcctggttcttttttttataagcttggctgtgtttcaatacgggcgccaatgatgggcggaaacccgcccgctccggagagcctctggggtccatttcaaacaacgggtccgaaagatgttgtgtttcaagtgaagccaagccacacagtaaaggcttatgaaaaggtataagggaggtcttttttatccaaaagaaaaagcccgcagaaaacaggagtgtctctgcaagcttaaaaaggccgctatgtgaaaaggtatgctgcgatacgtgtatcgccctcataagggcattgaagcgatcaacaccatcaataaattgatatggatccgatgagaagcgcgcatcctgtcatcacgatgacagcgagcaccgcccacattatcgcaaatttttgatgatcgtcgatggaaaccccgacaagcccaacaagcaaatgtgttgaaggcacaagcgggctcagcatgtgaatcggctggccgatgatggaggctcttgcaatttcgaccttattaacaccgtatgcgacagcggtttctgataaaatcgggagcactccgtaaaaataagcgtcattcggcatcagaaaagtgaaaatgccgcttgttaaggctactatcatcggaataaagccgcccatttgttcaggaatcatagacgcaagcgaaatcgccatttcatctaccatttttgtgcctgttagtattccggtaaagacccctgcggcaaatatcattgaaccgatagccaatacattgctcgaatgcgccgaaattcgctgtctctgatgatcgaggtttggataattgacaatcaatgcgatgcagaacgcgataataaacagaacggtcaagcttacttttcctgatatgagaagccctatcaatgaaagcgtcaacaataagttgaaccaccaaagcttcggacgcttccactcatcctccgcagcggcggccgtttcattggcaccagccggatgtttgagttcaatcacgccgaggcgttttcgctccgcttttccgagcatatacgcaactccgatcatacaaagcatgccgcttacgatgacaggtatcatcgggccggtcaattcagccgggtcaaccccgagcgcactcgctgcccgcggtgttgcgcctccccatggaatcgtattcataatccccatgccgactcctgcgattcccgctaatataatcgggcggatgccaagcagcaaatagagcgggagcatcgcgctcgttgtaatcatatatgttgttgatccgtctccgtccaatgcgaccagcatcgtgagcaccgcagtgccgacgacgatttttaacggatcgcctttgaccatttttaatatttttgtgaccattgggtcaaacaggccagtatcaatcataatcccgaaatataaaattgcaaacataatcataacggcggttggcgcgacttgctgaatccccgaaatcatcatgtcgccgacatcgctgaatccgaatccggcgatcagcgcaaacactatcggtgtcaagactaatgccgtcagaacagaaagccgttttgtcatgatcaataccataaacacaagcatcatgaaaaaacctaaaattgctaacacagttattcccccctcatatgaatccgcttacatttttttctctcctgttccccctaagccttgcctttttgtcatcatatgagaagaactttctgaagtaaataatttggtttttatgtatttttaattttttaaaatcattttgttctttttgaccatttttaaatacataaaaaaagtattccgcagacgcgaaatacccggttaatccccagccatgatgttttgataaaatgctgattgctcctcaaggaatcgttgcgtctccttgctgtttaaataatagctttcccattcctgttcatttattttctgcttccattccggtgaggatgtgatctttttaaacacttgatcccagtaggaaatttcttctttggtcatatttttcgggcctaatacacctctccaatgggaaaatacaaacgggatgccctgctctctccacgtcggtacatgcggatatgcgggaagccttttgtctgaagtaacagccccaagtgtgatgctgccgcttctttcatatgttttagcttctgatagagtcatcgatgcggcgtcaatttcatgtctgataagcgcctgaatgagctcttcgctgctttcatactgtaaatattgaatgttaaaagggtcaactccgtacatatcggccgccctgacgaatgacagctggtcatcattgccaagtccgggggaaaaaccgatttttaccttgccggggttctttttgatctcattcagcaaatcctttccgctctttatttccgatccttttggaagagcgatcgtctgccattcttttgcaagaatcgccagcggggtgaaatcgtctgttttcagtttgctctgtccgagaatgtaattgctcagcattaagctggatgtcatgccgatggtgtacgtatcgctgctatttatatacttccagcctttgtcaccgccgcttccgggtttatagacgatcttcacttcgctttttatcacttgtttttgtttaaggacggattgtatcgcctgagccgttaaatcccagccgcccgaaggctcagcgggtacgacgatttcaaccggccctcccgggggacgcggggcggacgattgtctttcatcccccgacattaagatcaatagacaaatcattataatcgcaaagttcttcatgtttattcatccgccaaatagtattttctctccggtctgccgataattccgtattccagctcagcgcgcgcttcttcttttgacacgagatattcggcatagcggcgggctgttgtacgtgaagcccccattttttcaccgagtttttcggctgtcattcctttagctgcgtctcgcagaacatccctgattttttgcagtgtaatcgaattgatacctgtcggcaaatcctcagcctgacgggatccgctggagaagtctccgaagatttggtcaatcattgattggctgacctgtggctgagaaagcagtgtttgcctttttttcttatattgaagcagcacctgtttgaatttttcggcagtcacaggcttaatcaaatagtgcacaattcccgcccggagcgattcctgtaaatgacatgtttcggttgctgctgtgatgatcatgatatccacttccggaaaccgttttcgaatgacaggaatcaatgttgtgcccatctcatccggcatgtaaatatccaacagcagcaagtcggcctttcggacctcgagaatttccattgtttctttggcattggccgctttaccgataatgttgaatccatcaagctgttcgatcaatctttcatgaatttgcgctacacggaaatcatcctccgcgatcacgatatcaatcaaatggattccccctctcgtgtttgcttctccttcggtataaaaacggtaaataccgctccgccgcctttttgattggccacttcaatccaaccgccaagttcacgtacagattcctttacgttggccagcccgtagcctctcttcatcccctttgaagaatatcctcgttcaaagatggctttcatcttatcaggcgctacgccgcatcctgtgtcagccacttctatgacaatatcgcggccgatgtcagtgatgaaaaatgaaacaagccgcacattttgctcagctacggcttcgaaagcgttatcaattaaattcccgatgatcgtaatgagatgagacatcccgatatgctcaggaagcggctcaagcgtgctgttttcatcaatggacaacttaacttttttctccgaagcctttcccattttgcccaacaggatagcctgcacctgctgagaatgaatgtttttgaataaaatgtcgtgctgttcattttgaatggcgtattcctctttaatcaggtcgatcgctgcttcatactcacctagctcaagcaggcctaggatcacataaagcttatttgagaattcatgtgtttgcgcgcggagatcttcagagtatttttgcacctctgtcagcgtgtcaatgagcctttttaactcggttttttgacggaaacttacgacaattccgtaagtttgaccgttttggagcatcatttttgtatttaaaataaacacttgatcgttgacgcagacctcctgattcagcaacatctgccgctgctgaaggacagacattattccggctccgggcaggatgtcatcaattggccggttgaccacaggttcgggaagcctaagcatttccgctgccgatacgttcatcattgtgacgactccttcacggttggtggcaatgatcccttctttaatcgcacgcagcatcgcatttcgttcacggtaaagagatgcaatctcttggggttcaaggccaagcgtatcttttctaatgcttttggcaagagcggcggcacccgcaaatcctatgagcaaaacgagaacagccatgaagctcaattttctcacattctctttaatacgttgttctgtctcgtttaacagaaaatcaacagacacactgccgatgaccttgctgtaaccactttgttcctggataatcggcgcacttcctctgatcaccatgcggccatcgttttttgttttagagatgtgagagccgccgaacaagatttttctgcttcttgtcagcttcgtttgacctctcttttccgaggcgattttgatctctcccttttcgttgaggacataaatagtataggcaccggtctgttctttcatttgttcaatgacctcttgcgcctctcccttatgcccgcgcttcttttgaaagagctcttttaccggaggcatataagaaatggtttttgcagtctgaacggcaagctgttcggactgttttcttccttcttttgtttgctgaacggcaaacgtgactgtcagcaagccgattactaagataagcagtgctgcaatcaagcccataatttttgtttgcagagaaaaattgacccgttttttgaccacaggcaccagccgtcctttctaccaaaaatcataccactttttattcggaaattttggcatttttaaaaatatcctttgcaagataacgaaaaagcccaagtatatcttataagtgatgatttcataatgcaggatcaggcgtaggacagtgtgctgttagtttcttaagctgggatccggttttattccacatataggtctaaatccagaagaaagtctgcctccggccacaagacggagcttcgcatgacgattgaaggaagcagctgtcctcgcgaacaccgccccgagaatagctgctggctccttgtgttgttgtcataaattgaaaaaccattgattcacacattgagacggcccgtctgctgctgttgactactaaaacacctcaccaaacatgcgctcaataatattcaacagtacaacccccggcagtttacggcgttccacagccggtcgagctttgtaaagaacccatttaatggaaatcgagatgacgtccgttatagaggatattcatcggtcgaatcgatcatttgaataaagttaagggcagatggagatagatggtcttccgtccttacacatagcgaaatcgggttctttattacggctttatcaacatgaacctttgcgatgtctccgcgggcgatatattcgtttacttcaagagcggatacgaatgttacaccgtatccttccataaccgttctgattgtttcgtttaatccgtttatttgtacacccatatttggttttcccgcgttatgcaggttgcacagcgaaatcaatttttcccgcgaaaaacttccttcctcgcgaaagacgaaaggttcttttacaatctcctctaatgccacgtgttttgaggcgaatttatgtttttgattgactacgaataacatgtcatcttccaaaagcagcgttccttttaagaaggggccgaattccgttgtcccgccgatcaggccaatgtccgcttcgtagttgatcagctgttcacaagctttttgaaaattcgttgtcgtgatttcaacttccgttttcggaaattgctgtttaaatcggctgagccatcttggcagcaaataattggcggggaggaaggtggaggcaatacgcagttttccaattgacccttcccttaactgctccacgtacgattcaatttctttttcaagtgaaaacagccgcttggcctgttttgcaagctctgcgccggactgtgtcagcaggatccctctgcctttaggaacgaataaggtgcagtcgatctcgcgttctaatttcttaatttgcgaggtgacggcgggctggctgatacttaactgtttggcggcttgagtgacactgcctgtttcagcgaccgaatagaacaatcgcagtgcatggagattcatatttcacacctctatttataaataaaagttattaatactagataaagatatattagagttatctaaatacttttactattataaagttgaaaaacatgtattacaagaaaggagaaattgttatgagtacgcttatcttaaataaaacagcttatagcaagtctccgtatgatgtatggctgaagggactggatgaaccggtggcgatgctgacctcaaccgatcgtgcggatgaatgcaggaattatgatgtgatcgaagcatttgacgattatccggttaatggatgcatcgaaatgcgcgctttggagctgaatgaaacgtatcactttaaaacgattattgcatcctcggaatttgatatgctgagggcggggaagctgaggtcgcttttggggataaaagggcagtcttacaaaagtgctctgctgttccgcaacaaaatattaatgaaagagcaagtaagaaaagccggtgtgaaggttccagattttaagaaaatcgactcggcggccgacttatatacgtttgttcaaactttcggttttcctgtggtcgttaagcctatttacggatcggggtctgttgatacaaccgttttaaggaatcggcaggacgtgtggaatgttcttgcgaaaggtcttcccgatcatctggaagttgagtcgtttatcgaaggggatatgtatcatatagacggcctcatccttgatgaagaaattgtcctcagctggccgtcgcgttatatcaacgggtgtctagcgtttcaagatcatcagtttttaggcagcctccagcttgaattgaaaaatccgcttacccggcggttgactgattttgttcaaaaagcgcttgctgcccttcctgttccgaataccacaacattccatgctgaagtgtttcatacaccagatgatgaactggtgttttgtgaagtggccagtagaaccggcggcgctatggtccgtgaagcaactgtgcagactttcggttttgatatcaatgaagtgtgtgttaaagcgcaatgcggcctggaatttcatataccggaggtggacaacaatccggaccgcctaagcggctggctgttgattccgccgaaagacggcgtgctgaaagaaatcaagcctgcgccagccgcagactggatagcgaaacaaaatatatccgctcaagccggagacaggttccacggctcgtcttccagtgtagacgcaattgcaagctgtttaattatcggacgcacagaagccgaattgagaggccgtatcagccggcttgcaacgtggttccatgatcataccgtatgggaaaagaattcggatgtttgcgcaatttaaagcattcagccgccttcatccgttgatccgatttttgctgataggcacgcttgtcacgaaggcggctaagtcgatgacaaccccgtttttggcgctctatctccatatgaaaacgggagccgattttggaaccatcgggcttgtcatcggtttaggctatttttcaagcactgtaggaggggtagtcggaggagcgctttcagataaaatcggcagaaaaaaagtgatgctttcatccattttcatctggagctttgtattcattctttttggacttgttcatgatttcatgtggtttttattgctgaatattttaagctggctttgccattcgtgttttgaacctgtgtcaaaggctttgatggctgagttatcagaacgggagatgagattccgcattttctctttgcggtatttggccatcaatgttggagctgctgtcggccctttactgggcgcttattttggtcttgccaaaaccggaacgccgtttatcatcacagggctggtctattttggctatgccatacttttgagcttgatgatgattcggctgaccacggtgaaagagacaaaaatcgctcctgaaaaagtccaggcaggttcagttttgaagacgttaaagcaagacaaggctcttcgattatacatagccggcggcatcctttttttgttcagctattcgcaaatggaaagcactttgctgcagtatttaaataacgactttgcaaacggagttaaaatattttcgactttaatcacgttaaacgcggtgacggtcatccttttacaagtgccgctcacccgtttatttgagaggtataaatccttaacaacaatatcaattggaaccgttttttgcattttggggaatatcggtttttctatcgcaaatggctggattgtttttatgctttcgatgtttgttctgacaatcggcgaaattttatgttttccttcaatgaatgtccttttggacgagctggctccggatcatatgaagggcgcgtattacggcatgcaaaacttatacaacatcggtgagtttttagggccttggctggggggaatgatgcttgccttgtacgggggaaaagccgtctttcttattgctgcgtgttcagtctttttggctttaggcgcttaccatgtgggaaggagaaagtttttatctgcacagcattatggtgtatcgcctttttcttattgaaaatttaggccgcttatgcatgaatcattaagaattacccaacctaaaaggtaaaaaaggagtatgaatcatggacacaacattgggctacctccgtgagtcactgtcgaatcaccttgaacacggcataggacaaaacatttacagaaaaatcgtttccgggcgatatgccaatgaggaagagtttgtcgagcacttggaggagcgggaaatggaatttctgaatcaagtgcttgaacatgagatgaaatatgcgctgaatgaacaggaccataaacggacaagagaattaaacgaagtgtatgaactgctgttttgaaaggcgggaatgatcaatgggtgcaatagagcggaacggatacacgtttgaaccggaatacagcgtgaccagacaaaacggtgcgatccatgtataccggcgcggccggtttgtcgaggagattccctttgagtttcacggggagtttccagagcatgatttaattgaagagcttgtcaatcattattgttatgaaaataaaatataaggcttgaagaggctgccgaccgggcggcttttatttttggatttttatatctataatccgcttgcagttttttagaacggcagcagaaaagctgccataaatatgacagctcatgcatcgctattttttcttttcgtcgtagtattgaacagggtacatggatccttccgataccattttgttatcttcgatatcatgcggagacgggtgtcctgctttttcaaccgggaatgaatctacgttgtgtttttccgaaaagtaagggatcttttctttgacgttttgcaagtacgatttcagtttttgtctgtttgtttcgtctttgagcatatatgcggtgactccggcgacaacggcgagacctgagatcagattcttttgcttcatggtcataacccctttcgattaggtgtttgcaaatgttattcccatgattgccgccggttaaaccagctgatcgagcgcttcgtctatattcgtcgtcggctgcctgcaggcgaaattttcacaaatatagacagtcgttttgttatcgactgctttgtattcggccgcaaagtcggcaatccctttgaaatcgtcaggcgattctgcggcgaggacggcataattcggctggaaggcctgctgcaaagcgcttacgatcttctgtctgtccggatcattccgttttccgagcacaacgatttccttttgcggcatgaattggctcagcaaaccttggagaaagtttgtatggccgctcggataagcagagacgtctccatggaaggcagcaaacatttttgccgcttgatcatggagcgacaagtcgccagtcagcctgcccagccgggacagctgcacggccaggacgccgtttccggacgggagggcgccgtcgtatacttctttatcccgcacgatcaaagcctcggcatcgcttcccgtaaaataaaaaccgccgtgctcttcatcccagaacagccccttcatgtctgcttcgagctttttggcttttcgcaaatcggttaaatcaagtgatgcttcatacaattcgatgtaggcccacagcaggaaggcgtagtcatcgataaatcctttatttttcacctcgccgtcacggtagcggaccatgatgcgaccgtcttgaatcaatttattctcgataaactcggctgcagctcgcgccatctccaggtattcgggcgcattgtagactttcgccgctttggcaagacccgcgatcatcagagcgttccaagaagtcagcactttatcgtcgacatgaggatacgttctttcctgacgtttttcaaaaagctttgttctcgcttcttcaagcttgttctgaagctcttcatctgtcagcgcgaattcatccttgatgtcttccagcctggtgtagatcaagtttggaatattatggccttcaaaattcccttcttgcgtgatgttgtagaccgcgcaatacaattcgccaagttcatctccaagcgtttcaaggacttcttcttttgaccacacataatatttgccctctacgccttccgtgtcggcatcaagcgctgaataaaaagcgcctttctcatcggtcatttcgcggcggacaaatgtgatgatctgctcggaaatctgtttataccgttcgtttttcgtgatttgataggcttcagtatatgcgatcagcaataaagcattatcgtaaagcattttttcaaagtggggaacaagccattcgtcatctgtcgaatagcgggcaaacccgtagccgacatggtcgtaaatgccgccgttcgccatgctgtccaacgttttcatcacgctgtacagcgcgttctcctcgccgctgtattgatgatagcgaagcagaaatgtcagcatatgggggattggaaatttcggcgcgctgccgaaaccgccgtacgccgcatcaaagctgttgatcagctgctgatacgtccgcctcaatatgtcttcgccgagcgaatcgccggcatcgcttttcgctttgattctcaggttgttggccgctttttcggcaatatcttcaacatgctcccggtttttcgcgaaggtatcggaaagctgcttcaccacctcaacaaaccccggacggttaaaacggctcgtcttcggaaaatatgtacccgcataaaacggcttctgatcaggggttaaaaacacattcagcggccagccgccctgccccgtcatcatctggcagatcgtcatataaatcgaatccacatcaggccgctcctcgcggtccactttaatggagacgaatttctcattcagaagcttcgcaacttcttcatcttcgaagctttcatgagccatgacatggcaccagtggcatgtgcgtatagatacccaaactagctatacccaatagatacgagtacaggcttgttctcgcttttcgctttgtcaaatgcttcttctccccaagggaaccagtccacagggttatgagcatgttggagtaagtacggtgacttctcagcgattaatctattgggtttacttttgtttggcatgggatcaccttctttcatcacttttatttttatactttaccacaggctgtaattttaattcattttagtttttaataacaaattaagatggataatacaaaatcctaataatcaattgttgatatttacgaccagttattataaaatatattaaaaaaaggaatatttagattattctaaaggttgtgaaagggacatgggtgactttaacggtttacagagagggaaggtatgctgaaatcttcctaacgcagaaaagtttctcaccacctttgagctgtattagggaacttaagtatctaataccgtttatgcaacgttacagcatcagagccataagttgtccatttaacttatgggaaattgggtggaaccacgggtaatgcactcgtccctagctttggggattagtgcatttttttattttccactcaacgtggctattgcaaagctagggtttagagtgtaaatcaattttattaaaaggggatgcactataatgagtgaaagtttaataaaagttcaattcaaagaaggaaatacgaaggaatttccgaaggggataacaataaaacgtattgcagaatccattagtacaactttaagaaagcacgctgttgtagcaaaggttgatgaaaaattcgtggatttaagctatacccttgacaaggatgttaaactcgatatttttactctagattcgaaagaaggtttgtcggtgttaagacatacatccacccatatattggcacacgctgtgaaaaggctttacagtagtgtaagtttgggtattggaccagtaattgaagatgagtttttctatgatttgaaacttgaacacagtttgtctcccgaggatttactagcaattgaacgtgagatggaaaagattattaaggagaatatagaaattaaacgaattgttgtctcttatgaggaagctgaaaagttatttgaagaaaataatgaaccattaaagcttgaaatattaagaggaattccaaaaggccaagaaataactctttaccaacagggagaatttattgatctttgtcgcggtccacaccttccatcaactggtttcattaaagcatttaaattaactcgtgtatctggagcttattggagaggaaatcgccaaaaagaagttcttcaacgagtttatggagtagcttttaaaaagaaagacgatttaaatgaatatctatattttttagaacaagcagcaaaacatgatcatcgacagttaggaaaacaattagatttatttatgttctcagaggaagcaccgggaatgcccttttacctacctaaaggacaaattgttagaaaagaattggagaaattatcccgtgaacttcaaaataatgcatcgtacgatgaggtccatacaccgtttatgatgaattatcgattatgggagaaatccggtcattgggatcattaccaagaaaatatgtacttttctgaggtcgataatacaaagtttgcaatcaaaccaatgaattgtcctggacatatgctaatctttaaaaataatctttactcctatcgagatctacctattcgattggcggaatatggacaagttcatcgacatgaatttagtggttcattaaacggattgcttcgggtacgcacattttgtcaggatgacgctcacatctttgttcgagaagatcaaattgaaagtgaaattaagaaggtatttcatttaattgaccaagtgtatcgtactattggttttgagtattcagtggaactgtctactcggccagatgattcattaggaaataatcacctatgggaggtttctgagggatcattaaaaaatgtgcttgacgatttagcaatcaaatatcaagttaatgaaggtgatggggctttttacggaccaaaaattgatttccatattaaagatgctttaaaacggagtcatcagtgcggaacaatccaacttgattttcagatgcctgaaaaatttgatttgacttatattaatcataataacgaaaaagttcgtcctgttgttatccaccgtgctatttttggttctattgatcgtttttttggaattttaatagagcattttgcgggtgtttttcctgtttggcttgcccctattcaagttcaaattattcctatttcacatattcacctggagtattgtttagggattaagtcggaactcaaacaacacgggataagagtacaaattaacgagagtaatcaaaagttagggtacaaaattagggaagcacaggttcaaaaaatcccctatacattagtagtaggagacaatgaaattaaagaaaacggagtaaatgtaagaaagtatggagaggaacaacaaaaaaatgtttcaattgaaagctttaaaaaaaatattttgcagcaaataaagacacgtagtgtctagttgaaagaaagtataaaagtttttaataaatcttcatctaatttgaagctatcttgataaaaaagtattttaaacaagtaaatatcacaaaaaaatgaataaaatgaaaaaaaccctttacaaatataggatatctacctataataaaattgaataatctgattattcaattttatcggaaggaggatataattatggaagaaattcaaaatgtgtctcaagtagaattagaagaaacttgctacgattgggataataagtaaggtggaagaaaagggttaacgattttttcgttatcccttttctccctataaaggatgaggtaaatgactcttttaaaaaaacaatatgaaatgtttaagtgtgtaacagatgagaattatctgaaagaatacaaaaaacagaatcactttgattgggttaattttgatttttttaggaagttacattttaataaacgggcgattaggtttaatcatgtatttcctaaaactaaagaaaaaacaagggaatgggaaaagtttgttaagaacttctgcaatcaacataattataccggtcaaagagttgaagaagatgcagactcttttgtaaactttctttcgaaaaaaaaaggaaacgaaagctatatagctcagctggctaaacacgaattaaatatatacctagttacaattggaaaagggaatggttttgtagatgcattctgttatccaattacatgttttaacataaccagcacagagactaaaaaacataattacttgtatataaaaggaaaacaaggggttagagtattcaagatagaacaaagtgtagcaatatggattgaaaattataagaatttattatgtattaaagaagcaactaatctaacacataattctttaaatactcaagaaaaaaatcagttaaaaattgctatagataactttaaaaaattaggtctgttggacatatggaagagagaaagtattaatgaaaagtctaaacaacattaaaaataaaattgtcatagttggaacagttgatagcctaggtgcagccattgtatggacagggttaccactttatgcatattcgattacgggatcttttttatatacatcatcattattttttacttcagcaatagcccgtatattagcaaccttttttggaggctatttagcagatgtatcatcgagtaaaagaataatgctaagatgtttaagtattaattggtttttttattcactattatttttgggattatcactcggtttaacttggattatattccctatcatgttgatttcacaatgtttcagtaccatatcgatcatgaatcaaaacctttggtttaattcactttgctcaaaagagaccctggcttccgaaataagtggtagaaactcatggtttttgattagtaaaacagttggtttctcattaggaccactcatgtatcattggcttaatgcatactcattaattatcaatctattaactatattgattgcaataacattaatattaacaataaaagatttaggttatgtaaataataaaaagaaaaaagagagcattttttcttcgttcaaagaagtttataaaaatcaattattaaaaaggctaaatataatagaaattttaaatggtttaacttttcctgttttaacaagcttatcgatatatattcttgaaaagaatttaaatgcttcttctcttataatttctttgttttggttgataggaggagtaggagcgattacggctaacttgatgctttcgagacttaaattatttaaattacagtatattcatcaatttataataagttttgttctcgtagttggtggattgttgttaatgacgatagctagctattcttttgtctatttaataggattttctttatttactttaggtacccctataataaataatttattaaggtcaaaagtgtttattttcgccccaagtcatatgaaaggaaaagtaacatcagttataacgtcttcatcagatttaggcactattatagccttatcattgtcttggattgttgttgaaaaattcggggtattaatttttatgtcttttgttattttaacaagtgtaagtcgaatatgcctttttttctacactctacataaagtagaaaataaagttgatgtggagggataattcttgtccaattgtattggtgttgggttgagttttcgtcaaaatttttttaaggatttagatgtaattaagcaggatgttgattttttagagattatttctgaaaggtatttcgataaaaagaatgaagaggaattgaatactattagaaattattttcccttaattccacacggactttctctttcaataggaacttatgaacctttatctaaaaaaaaggaaaaacaaatatccaatttgttggcagaattacaaattaatagctatacagatcatttagcaatgagtagtgtaaaagatatcgaattactcgatttttttccagtaatgtataaagaagaaacttttgagtttttaataaacaaatatgatcaattgaaaaaaggaagattaaaaaatttgtatttagaaaatataacttatacctttaattggcataacaatgatttttcagagttggatttttggtataaattgcttaatgaaacaaacataggtatgttgctagatgtatcaaatttatatataaatagtataaatcataaatacgatccatatgctttttttgataagctacctaaagataaaataaattatttacacgtagctggatttatcagaaataagtatggatttttaatagattctcattctgaacctgttcataaagaagtatggaaactagccgagtatattattaaaaaagctcctgtcaagggggtcatattagaaagagatttaaattatcaaaattatcatgatgtgaaaaatgatataaaaattattaaatcactagtatataaatatcaaactaactaaatattgatgatcttttgaaaaagtcgccagatttagcggcttttttgttgctaaaaaatattgaaacaggaatttaaatgaccactctatttgtaattcttacactcttttcttatttaattttatttttataacctggtgctttcttcttttatgacaccaaggcatgtccattagaataaccaaactagctatactcaatagatacgagtacaggcttgttctcgcgtttagctttatcaaatgcttcttcttttatgggaggtgtaagtcttactttaaagtaagacgacttattgacagccattaatttaattatttttgcggtattgattgctttaacggcgttttttgttgcaacggaatttgcgatcgtaaaagtgcgggcaactaaaattgaccggcttatacttgaagggaaaaaaggagcggtatccgccaaaaaagtagttacccatttagatgaatatttatcggcttgccaactgggcataaccgttacagcgctgggtattggatgggttggagagtcgacattcgaagtgatccttcatccgatctttgcttatttcaatgtgagcgagcaagtcacacatatcttaatctgaaaaaaaggattgaataaacattaagtaatcaacaaaagaagttgaatcaaagacaaactttcctgtgatattttcttgttgatctcttcgcctctctttacctctgcaataaccgttatggtttggagggatttgatggggctggaaagctgaaaatcggcgagttggcggaaggaactaaggtaacgaagagaacaattgattattatacaaagctgggtttgttaatctgctgacgaaaatgcaaaaagagcgaattcacattgctatcttattggatgagtatggaggtacgtcgggtttagtaacagttgaagatatccttgaagaaatcgtgggagaaattagagatgaatttgatgttgatgaaattccggatattcgaaagttaaaggatggtcactttataataaactcaaagctgctaattgaagatgtcaacgatcttttggatatcaatttatctcatgaggaagtggacacaataggcggctggttcatgactcaaaacatggatgcagaagctggttctgaactagaagctgatggttatatttttaaagtgcaaaaaatagatgggcggcagattcattttcttgaagttaaaagagaaaaaaattcaaatcaataatgatttaaaaaaagagagcctgaaacttttcaggttctttttattatggaatacaaccattgaccaatgacaagtcgaatagccgatgctgacaagtaccggcttgttttcgcgctttgctttttcaaaggcttcttcgccccacgggtaccagtcgacggggttgtgtgcatgctggagtaggtatggcgacttctcgttgattaatctgttcgttggcatgggatcacctgctttataaacgaatttttattcattattgtctttacatgatttaatataccaaatatcaaaagaagaggtttctaaggttaacttcttctattttattttatggaaagagaagcagaccaactgttattaaaagagctcagttaattcttaagatttttcgcccctctttcttcaggttttgaatttaaagtatgattataaattattcaaaacaaaggaatgagacaaattggggctatatattgacggagaaatagaaaagcagaagaacccctcgcgccgaagcgtcttgtttgccattttggttgttaatcgttgccgataacgtacttgcatgcggtagtgcacggacgataatgctatgccgaagcgacataccgaatcaatgaaaaaattcaatcaaggcgtcgccgcccaccccaattagaatccctgctgattccgatcggtgacggactgaccgtgtcgcaagtcaagaaataaaagcacatcatctgactagttactgattcggtgactagtttttttaatgcccgcaatgccgccacaatctaaaatcggaatatgataaattcagttcataaaatgttgaaggggacatgcccttagcaaattgacaaaaggttcttttgtagtaaaattcaaactattcataaacgaaaggaaccgccgtgattgaaagcggggacaaattttaaataagaaggtgttgaggtggcggggtattctgaacgaacggttgagagttacatagattctccggatcgattaaagagattgtacaaaagagtattattcatcgtgagtctgtcgcagattttcggcggtgcggggctggctgccgggattacggtaggcgccctgttagcaaagcaaatgcttgggacggatgcgttttcaggagtcccttctgccttatttactttaggatcggcaggagccgctttcggcgtcgggagactttctcagcgttacgggcgccgcacgggcttaaccgccggctttatggtcggcgggatcggcgcaatcggggtcgttgctgcggccgtgatcaacagcatcatattgttgttcgtttccctgcttatttacggagcgggcacagcgacaaacttgcaggcgcggtatgccggcactgacttggctgataaaaagcagcgggctaaagcgatcagcgtcacaatggtgatgacaacatttggagcggttgcgggccccaatttggtggatgtcatggggaaatttgcttcgatcatcggcgttccgccacttgcgggaccgtttattttatcggcggcagcttttattctggcagggcttgtgctttatattttgcttcggccggatccgttggagatcgccaaaaaaatcgaaacctatagacaagaaaataaattagcagacgaatcgaagtctgccggtgcttcggacgatcaaaaggggattacaattggtgccgctgttatggtgcttacccaaattgtgatggttgcgattatgaccatgacgcccgttcatatgcagcaccacggacacagcttgggagatgtcgggatcgtgataggttttcatatcggttcaatgtatcttccgtcacttgtcacagggattcttgttgataaaattggccggacagccataagcatcgcctcaggggtgaccctgctgctcgctggtgcagtggcggcgctggctcccagcgattcgctcgttttattgatcgttgccctttcgctgcttggattgggatggaactttggattaatcagcggaactgcacaaattatcgattcgaccgagccttcaacacgtgcgaaagtgcagggaacgcttgatgttttgatcgcattggcgggggcttccggcggggctctttccggaatggttgtcgctcattcaagctatgccgtgttatccttggcgggcgggctgttatccttggctctgattccagccgtcatttggccgcgaagaaaaacaaatactcaaaaagggtaggaaaaggtctatcggattcggggcctatcggacatcgccgccgggctttcttaatttaaaaacgatgaaatcggggcacctgagatcttcttcaaatgaagggtattttttcagcatctcttttgacggtctcggttcctcgaccgcttctaattgaaagccggctttgatgatcgtattgatatagcttgtcagtgttctgtgaaaaagaaacattttctcctcgccgcccagcggctgctcatatgcgccttcgtaaaaataccgatcaacgttccaatggagcttttggccgtctttggttctttcccatccgctttccggggtgacgaaacaagggtgtaatattgaaaaaataaagcatcctccatcttttaataacctgtgcatttcctgaaacgctttttcatcatttgcgaggtcttggatgaccatattcgatatgatgatatcaaagctttgctcatctaaaaaatgcaagtcctcacaattgccgtgccgataatgaatgtgcaatccgtccggcgttctttccttggcgatctcaagcattcttgtcgaatagtcaaccgccgttacaactgcttcgcgggcggccagcattctgcttaaatatccttctccgcacccggcatccagcactttttgatttttcaccgtttcaatgagagaaaagatgacggggatccaaaagacttctttatgtatatcgccttgttcagtatggtttgcagcatagctatctgcaaaccggttccatctttgaatggcttcttcagtggcagcgtttttctcatatcacttcctccttttgacatgatcataccacaaaccatattacgttttagccaggttaaaggacattcctgttgacaaagcagcctatttgtaattatgatagttacatcaagtgtaacgaaatttgttacagatcaagattaaaacattcaggaggaattcgaatatgaaaatgctagtaacgggggcaaccggaaaattaggatcgaaaattgtggaaaagctgctggaaactgtaccggcggatcagctggcggtcagcgtgcgcaatccggaaaaagcggaagcgctgcgggcgcgcggggtcgatgtgcgccacggggattttgaccgcccggaaacattggaatccgcatttcgaggcattgaccgtctgctgattatctctgccgatggagacaatgagacgagaatccgtcagcacggcaatgcggtagctgccgcagagcgcgccggagttcggtttatcgcttatacgaccattgcgaatgcccgcgaaagcaaaaacttccttgcgccgactcacaaagcaactgaagaagcgattttgcaaacggggattccatactccttcttgcgcaataactggtacttggaaaatgaaatgtcgagtattcaaggcgttttggcgggagcccctgggtgacatcagcagagaatggcaaagtgggctgggcgctgcagcaggattacgcggatgcagcggcgagggttctgtccggcgaatgcgacgaaaacaccgtttacgaactttcaggcaaactattaactcaggaagaaatcgcttcacccttgggaagtattgggcaaagaagttcccgttcagcatgttgacgatgctgcctatcgcgatatcatgaaaaatgcgggtgtgccggattttctgattccgatggttgtcgatatccaaaaaggcattcgtgaaggcacacttgaagtcgaaagcgatgattttgaaaaagtgctcggccgtccgctcacgccaattaaagaaggattggctcaaatcgttgcaagaatctcagaagcgaaataatgatcaataggattcgaaagagtgatgaacagaattacagtgttcatcactctttttttaaaagatagatcaaaaaagactcgccacaatcaccgcacatactttatagcctaagttacttttattaaaataagtaaaatatcgactgaattccagagctaatgatgaaggaataaaaagacaggcatgtgcggctgcttgagaagaaaaactgaaagctgatggcagcgcatgaatttgcagtgtgtattaacttgtaaagagcctcgatagtagcctctgtttggattgcggctcatccatcatcccccgcgacagtttcactattaaaactcacaaatatgcacctgaccgttatttgattttcctttgctgtattaaacctatggccacaagcatgacagtgccgagtaaggcaatcggaagaaaccacccgccaaatccgcttccccagtctaaagcgattgacacggattcaattaatatgagagaaaaaatgattaagcatgcattttttaagcggttgatcaactttcggctgagcaggtagaagtgttcagcgtttgtttcattcaggcgctttggatgattgtgaatctcagggtgcttttctaggaactgcatgaacagaaggataattaatccgattcccggcaatatgaaaagctcccattttgacccccagcgatccacttcaccgagtgcgttgtaatgtgcaggcaccttttcgggagcgatccccagacagcggccaatagaatgatcgatcccaggtaaaagaaatagccaaatgcgttccaaacccgttccccttttgtcttttgaatgttgatcttagaacgtcggctctgttctgcatatgtaaccctccttagttttaaatacggtttgacctatgaaaaagttcgggattttcgccagctggaatggggtatatttgcggtgagtccaggcaatgttaagggaatgtaaatcatcagccggcaatgttaagttattgtaaattttcgatttgaatcgtttacataggctttaatctccatcataatcatagtgtttggtttgtagatttatgtcgaattaggggggcacgactttggaaatagatgtgcagaaattgctttttgaattcattggaggtctcgggatctttcttctcggtattaagtttatgggagaaggacttcaaaaatcagccggagataagctgagagacatattagatcgttttacaagcaaccctctgatgggtgttttggcaggtatgattgtcacggttttaattcaaagcagttccggcacgaccgttatcactgtcggtcttgtcagcgccggctttatgaccctccgccaggcgatcggcgtcattatgggtgcgaacatcggaacgacggccacagcctttattatcggctttgacgttggggcatatgcgcttccgatcatcgccattggttcatttttgctgtttttcttaaagagcaaaaaatttcagaacatcggacaaattctgtttggatttggtgcgcttttctacggcttggaattaatgagcagcgggatgaagccgctccggacggttgaagcttttcatgatttaacagtcagcatgagtgcgaatcctattctcggcgtgctcgtcggcacccttttcaccgttctcgtccaaagctcaagtgcaacgatcgggatcctgcaagggctgtttgccgattcattaatagatctaaacggcgctctgcctgtattattcggagacaatatcggtacgacgattaccgctgtactggcatctcttggcgcctcagtggcagccaaacgggccgcggccgttcacgtattgttcaacctgattggaacagcgattttcctgatcttgctgaagccgttcacagctttgattttaatgcttcaatcctctttagggctggaccctaagatggtgattgcgtttgcccacgggatctttaatacgtcgaatacgctgattcagcttccgtttgtcggcatattggctttgatcgttacgaagctgattccaggcaaagattcggttgtggactataaagcaacacatcttgatccgctgttcattcagcagtctccttcaattgcgctgggacaggcgaaagaagaagtattgcgcatgggtgaatttgcggtaaagggacttgaggaaacaaaagagttttttaatacaaaacaggcaaaacatgcgcaaagcgcttttcaaatagaagatgcgatcaacaatttggacaggaagataaccgattacttgatcgaattgtccgccactacgctttctgaacaagaatctgaagaacatcatatgttaatggatactgtcagagacattgaaagaatcggcgatcactttgaaaacttggttgagcttggtgagtaccagcaatccaacagggtgaaaatttccgaagcggcaatggctgatttaacggaaatgcttgacctgaccatttccactgttaagagtccatcaccgctcttggggaaaataacgaagatgccgcaagacgcgtagtcgaaaaagaaaatcagattgataaaatggaacgcaagcttcgcaaaaagcacattcttcgcttaaacgacggattatgcagcggacaagccggcgtgatcttcgtcgatatcaccagcaacctggaaaggatcggcgaccatgccgtcaatattgctgaagctgttttaggcgaagaaaagcattaaaaaaccgggagtcattcccggttttttattttgtgggccttttttatcaaggtgttacatatttactaaattgcgagaaaaaaggaagagaattcttcttctggagacgtaaatcaagtataatggttttattctttaggaggtattaagatgcataaatacagaagaagaaacacaacggcctttacggttatgtcatatttcacatttttcgcgggagtctttttatttggtatcgggctatacaatgcggacaatctgcagctcaatgaaaaaggctattacatagccgtgatgattttagtggcggtcggcgcgattttgacccagaaagtgacgagagacaatgccgaggacaatgaaatcattgcggagcaggagagaagacagaatttgtctagcggcgagtaagcataaaaaaagcatctttagggatgcttttttttaatttgaaatacttttatatttattttccaaaacgaaatcaatcattccaataatttttgtatggttcgttttttttctaaagtgtaaaaagttttgttctttgtttctttgagatttagtgatcgtgccgaacacccagatggagctcatgataagtaatatcgataacaaagccggaaaataaccttttgaaacgtcgggtaaaatggaattggcttgacccgaacatacagtagttacaatggaggcgaatatggaactggcgagcgaagctttgatcacgtggctgatttttagcgtaggacctgaaaaataaactttcagccggtttaacgtggataaatcttgtttttcgaggtatgccatcagctcttcatcgttttcagctttcgataacaatagagtttcagcggtttgttttgtttcttcgaatagttgtttgtctgtttgcatgtcttggtctccttcttatttagtttgaatgatagagaatcaaagcagaggtgaatgttcctctgctttctaattgaattcctttttaaagcgttcatctaaaatgaaatcaatcatacccgtgattctggaatattccgctcttttttggaagtgcaggattgtttgcatcggtccttttcgcgaggagatcagcatcttgacgatccaaagaaaagagaagatcagatagaacatgaagaagaatgaaaatagccttgaaagaccatggttgagggaggagatctgaccagataaaaaggccgccataatgacagcagtcatactgctaaaaaaaatccctttaatcaaatacgttaatgtaaaacttggatttgaaaaatagatttttagctgatttaatgtaacagattcttgatttgcaaggtatgtaagcagctcttcgtcacttttgtgagactcaagaagtttggctgtatgttcagctttttgaaataattgtttttcgtttctcattggattgtcactcctattcataaaaaacatgagattttattggttcggtatattttttaatgcctttttgtatttttgttgtaaaacataatcaatcatttttacgatacgtgcaaactcggctttcttggaaaagtgtgtaatgaattgaatcggcttttttttcaggatgacaagctgtctaagcacccagaataaacaccccgtaaatatgacagctaatattataatggagatgccggaaatgaaagggaatatcgaatctgcttgaccagaaagaattgcagttatgaacgaagccaatattatactgaaaaatgctgcactaagttttaagggttttggctgttttctgcgtttcaatgaatacttgtttgtctgtgttcaatgttaatgcctccacgatacttgatatatattaaagattagaaaaactgcataaatatattatattatgtatttatgcagttttcattaaataaggaaattaatgagatattagttcgccaaatattgcaaataacacagcagacaacgccgtgccaatagcgatttcagcacgctattacaacagctgcatccccgattgttcttcttttctttcattatgctttcactaatagatctcaaacatatgacataaaaaaatacggaaattgactccttcactaaatgaagcgaagtcaatttccgtatcttgtttatctcaacagccccaagcttcctgtcagccgcgcaacttttttcttatccccgcaaatgccgattccaaaatagcggtaatcggaagctgcggtgctttgaaatgcctcaatatatgcttcatatgtatgaatgctttgcgctacatcggtgaaatcaaccgtcagaatatcgttgaattcgtcggtcagcagcttttgacttaattgatgaagcagctcggcattgccttttaaaatggggattgggattttgacgatacctaaatggtcgattcccgagccgtctgttacagtttctccaatcagatcgggtttgtttttgccgagggccgcccccaggatggcagctgtattggcgattagcccgagcggcaggctttcatcgatgatcagtgcgcattttgtctcttccctcaaatttgttcctccttcagctgcggttttggttttgtttcagaaatataaaggccggccaatgtgagcgctcctccgcaaaaagcaacccatgtcagtttttcttgcagaatgataacggatgccgcaatagtgatgacgggcaccatatagatataagcgctcgtttttaccgctccaagcacaccgaccgaccagttccatgtcacaaagcaaagcgcagatgcgcccgcgcctaagaataggatgttcaaccaattgacgggggaggaaaaagggcttgcgtcgaagcggaaatcaaacaggaacagagcgggaaccatgaatagcaaaccgtacagaaagatccgctgtgtgcattggattgtatggtaaccgaatgtgctgatttttttcatcaaaatcgcatatgccgcccagacgaatgcggaggcagcagcgagaatgtcgccgagcggattcaatttaagcatcatttgtccattaaagaaaatgagcgcaagtccagtgaaagcggcggcgaacccaatgaaaaagcggggctccagcttttcgcccgaaaggagaaaatgcgccaataccgcggtgatcatcggaataaccgcgacgatcatgccggcgtttgaggcgtaggtaagagtaagcgcgatgttttccaacagaaagtaaagcgtcactccgcataaacctgctcccgcaaacagcgcttcttgcctccagctccggaaagtcagcacatgcggatgcaccatgatcagcacaatcaacccgatgagaaaacggtaaaacaatatatctacgggcgggaaatcctcgagcagcacctttgttgagacaaaagtagtaccccagatgatgatcgtgatcacagctgcgaggtgtccggcggtttcgcgtcttgtcttcatcctttgatctcctgcctgtcatattcaaaaattttcatatattgtttcggcgtcagcccgacctgccgcttgaaaaatttcgtcatatggctctgatcactgaagcctgtttggaaagccgcatcgattggttttacgccttcttccaacagcttcttcgcatgattgatacgaacggtttccaagtagctgtagggggaaattcctttctgcttcgtaaacgaccgcaggaggtgatacttgctccagcctgtcagcctgcttaaatgttcaagcgtaatgttttcctggtaatgggattccaaataactgcacaccgctttgacttcgtcggacggttcaggtgcattttcaagaaacgtgacaaagctcctcttttttcaaggctttttctttttgcaatatttgaatgtgtagctccttcaagctggcgttcagctcatggcggaacaagacattctccgtgaaatatgggaggctgtcggccccagtgatctccttcacaaatcctctcataacatcaggcatcacgttaatgcagcggtaatcgagcgcctttccgtcaatctgctcgcaactgtgcgtgtcataaggattgaaaagcacgagagcgccttgattaatgatgtattcttctcccttgcaaagcaaatagcgctgccccttctcaataaaaccaatcacaaaatactcgtggaagtgattcggaaacttctggataatgcctttaaagcggtaggcttcaacatttagatcagggtcgaggaaaagcgtgcgggtttcatttcgcatggcgggcctccttggtgtgatgatgtttaagtttatcatgtttatgggagatttcttgtatgatgttgcttaatgaaaaaaaggatacaatggaagaaaaaaagaggtactgaaagtgaaaaagaaatggattgcatcaattgccttcacgatgatgctgggcatcggaatcacgatttactgtctgttttttgaacatagcaaactgagcgaactgacttcagacggggaatgggagctctcgtattctaaagaaaggggagatcaatattggaatggctatgtttcgaagaaaacgagtgaagatgcggagttaaagagagtcgtgttttttgtgaatggaaaagagacggttgattacgaaaaggatgagcaagaggaaggcggaacacattctgatatagtcaatgttgtctggttaggtgatgccccagaaaaaagtgagcaatttgaagctgtcgtggaaaggaaccagaatggtgaatatcataaggagaggattaaactgacagcaaaaaacgggttataaagattgaaccattgtaacttttggtgtaaaattacactaaaagttacaatggaggttctccatggataaagaatacataaccgaactgatctcatccaaattaagattaatccgggcggaaagcggctatacgcaggagaaaatggcgaacgtgctcgggatgtcgaagaaaacgctcgtgcaaatcgaaaagggcaggtcggctgcgggctgggcgcatgttgtcgcggtatgcgcgctttttcggaacagtgaagtgctgcaggccgtcctcggggatgagccccttgaggtggtggagactgttgctcaccgaagcatcgacagaccaaaagggaagacgcttggcggaaaggtgtggtggcgggacattgagaaaaaaggagagtttcgccttcagcaaaacttgatttctcaccattaccgcatcttggattcgtatgacgacctatggttcagcacgtttgaaaagcaggatgcagttgcgcgtttggacgagctgttaaatgagcaggacggggtggaatgatgaaaaagatagcagaggcatcaaaatcctctgaattggctggtcttgatccccgcaagacaagacacggggaataacactgcgtgtctcatctggggaatcggacgtgagaacagttttcgcccgccttattctcactccagcacatcatcaagcagcttccacatcagctccctccggtttcctgcgcccgtcttcaaaaaaaacgatttcaagtggtcttgaacagtgtaagccgatatatgcaattcgtctccgatggcttttgttgatagtccgcggatgacccggtaagcgatgtctttttcccggtcggacaggctgtaggcttccgctatcagcggaatggtttctgcgggtgaagcaggctcaaatgaaacggcgatctggcctgacggtccaaatccgtctaaacggctcgctttaatggataggcaggaatggcctggaatcgagatgaccgtttttgccggagctgtagtttcagccgctgcgcgcgtgcagacggctcggacgggtctcggcacggcttcgctgccgatgctttcccagccgcgcaagatgttcagccaatggagggccgctcgattgcatgacaagagctgcaggtcttccgacaaaatcagaatgcctccgacatgtttcatgtgaaacacgtctttttttggcagatggtgtctgaattgctgaagatgccggccgataagcggtgcaagagaagcgagcaggctctgatccttttctgtaaacaccggctgtccacttttcctcaggcagtgtgaggtgtatcccaagcactgccccttgctgagcggtttgtgatatcgtttgacatcttgttagaaagtgagatgataaatattagaaaagaatagaaggagtggggaaatatgcagcctgaagatattgtcagaagcggtccaaaccaatacgtttgcagagaggggatcgtgaaagaactgccgtcatttgcgaatgcattcgaacgtcctgtcatcatttcaggggttaaatcgtttaaagcttttacacgttatacgacacctccagccgattggaaagtcgttcagcatacgggctgcagttccctaaataagattaaaaaagcagcagaggaagcagaatcagcagacgtcatcataggaataggcgggggaaccgtcttagatacagcgaaggcagccgccgatttgctgaacattgaagtcatgacgattccgacgatcccgggaacatgtgcggcaagcacgccgttaagcgtcatctatgacgatgaaggtaacttttcgggcgtccaatatcagaagcgctccagctatttgacactggtcgatccgctgctgcttctctcttcaccggtcgcttatgtgaaaagcggaatcggcgatacgcttgcgaaatggtatgaggcagaagcgatcatcagaaatacggccgattcgctttctatcatggttcagacagggctgaggcagtctgtctatattcgggatattttgttgacagaaagcctgaaagccatagagagccttgaaaaaggcgaatcctccccagctttcacaaatgtcctcgaagcggtcattgcgctggcaggcacagtaggcggatatgcgggccgctacggcagaatggccggggcccatgccattcacaacggcttgacgttcatccccgaaacccatcgtgtgctgcacggccaaaaggtagcctacgggatactggtgcagcttgctttagaagggcggacagatgaaatagccgaactgattcccttttatgaagggctcggttttccgagaagacttagcgatttgggcattttagaaaatattgaagcggccaaacggatcatcgccgcccatgccgcgcgtccggatgaatctttatgtttgatgggatcttttcatgaagcggatgtgattgcggcgatagagtcgcttgaataaacccggttttatacgcctttgaactattcaaaggcgtattttatttttagcgacttcttgagaaaaaaaccactcttgtaaacaaggtctttatcactatatttttgtaaaaaagtatcagctgccgccgatataaataaaaactactttgtttggaagaagggggagcaatgtgaaaagcccaagatggaacaatatcacaatcggcggcaaatacggcattattttctttgtgatgttaacagcgtttttaacatccgttttgattacatatggtctgttaaaagatacgagccagacggttcaggatacgaaatcgaaaaatgaaacggccgttcagtcggcaaagctgatgtccctatatcaaaataaatatttgcacattccggagtacatcataaacgcccaggatgaaaagctgaccgattatatgaagtacagccaggaatttgccgatacggccaaaaagctgaaaaaagagctgcattcggatgagcagcttgacatgttcgatcaaatcattgaaaacaatcattcactggatgagtactttttcagcgaaattgttcccaacgtgcagcaaatcaacaccgagaaatttttaacccttcagaaaaaagcgaacaagctcaaagaggagacgatgacgttaggcgaaagcttgaaagaaaacgctgtcaaaaccaatgttgagtcaattggacaagcccaatccaatatgacgaaaaccatttatattttaggcgtctcaattctgatttcggcgattgtgtcggcgggactcctgatcattgtcagccggcagatcaagaaaaatctgaagcgtgttgtggcagcaagcgaagaaattgcaaagggtcatttgaactttgaagcccttgattacaaaggaaaagatgaaatcggccagctttcgcaagcggtgaatcatatgggcggaagcctgcgtgagatgatcgtcgaagtatcagggatcgcagccgaagtcgacaagcaatgtcttacgtttacgagcgtctcggctgatgtcagagaaggaagcgaacagatcgctgtcaccgttgaagaattggcaaacggggccacgaatcaggcaaatgaagcagctaatatttccgagcagacacaggagctcaccgggcaaattcagcacgctcatgaaagcggcgaaacgctggcccggttttcaaaagaagtgcttcacgtgtctgtcgacggcgacaaacagatggctcaatcattggagcaaatgaatgtcatcaatcatgtaatggaagcatccgtagaaaaagtcagtgtgctggaggaacagacacagtcaatccacaagcttgtcgaaatgataacaggtatggccgaacaaacgaatttgctcgcattaaacgcgtccatagaagcggcaagggccggcgacgccggaaaagggtttgccgttgtagccggcgaggtgaaaagactggctgaagaagtgaaaagctctgtcggcagcatcaccgaaatcgtcacggcgattcaaaccgaaacatcttccatggccggtgatttaaaaaccggtttttcagaagttcataaaggaaaaaaccagattgagacttccggccgatacttttcagagattaaaaataaagtgacggatatggctggccgtgtatcggacatttcggaggcattatcgcatttcagacgttcaagcgaggagattaacggctcggtcgagcatatcgcggcgatttccgaagaaagcgcggccggttctgaagaaatttcagcgtccgtacatgagcaaagcggctcgattgaaaagatggacgaaagcgcaaggcttctgggagagatggttgaacggatgaatgtgatgatcaaacggtttaagctctgatgccgatacagaatggggggttttaatgttgtcgatatatgtgaaaagagggctgttggcacttgcgctgttcagtctcctcacagctgttgccgggtgctcattcaattctgctgaaaaaagcgccaaccgtgaagaaaaagtaaagctgattgccgactccgacaaattgtacgtcggttttgccatcgatacgctgaaggaagaacgctggtacaaagataaagaagcgttcgagaaagaagttaaaaacctcgggggggaagtcaagacgcttgccgctaacggaaataaagaagttcagattcagcaggccgagctcttgatcagcgaaggcgtcgacgtgcttgttgttgtaccggcagatgcggatgccgcggcggagatcgtgaaaaaggcgcacagcgccggtgtaaaagtgatttcgtatgaccggctgattcgaaacgcggatgttgattattacgtttcatttgataacgaaaaggtcggggaactgcaggcggaagcgattgtaaaaaaagcgaagaaaggaaacttcgtatatatcggcggatcgtctcttgacaacaatgcggtcttattccggaacggcgccatgaaagtgctcgaaccgttgaagcggcagggtaaagtcaagctcgtgcttgacgaatatacgaaagactggctaccagaagaagcgaaaaagaacatgaaaaaagcattgaacaagacgagagatatcgacgccgtgatcgccgccaatgacggtacggctggcggggtgatcgaggcgcttcaggaggcgggcctggccgggaaaattccggtgtccggacaggacgcggaaattcaaggcgtccgacgaattgtgaacggtacgcagacgatgaccgtttacaaaccgattcccgcgcttgccaaaaaaagcgctgaaatggctgttcaagcggcgaaaggcgaagcgattcaaaccgatacaaccgtcgaaaacggcaaagccaaagtaccggcgattttacttgagccgtatgccgttacgaaaggcaatatcaatgagactgtgatcaaagacggccatctgtccaaaaaagatattaataaataaaacgaagtcagccatccgctacaggatggctgactttgttaaatttccactttcacatcggcgcttttcttaagcttttcgacctgctgtccgagtttttcctgtcttttttgctgtttgagcatatcttggatttgctgtttgacatcgtcaaacgcaggtgtgtttttctgtccgctgtctttttgctgtgcggcaaattgatcataatagtctttgatttctttgtctgtaacctgatctgtcggcagttctttgtcaatatatttctctgttttgatgctgtcggcaatgtcgcttttcagcgtgttcatgtttaagcctgcttttttgaccgcttcctcaaaatcttgctcgtttttatactgctttttgctttcgtccagctgtttttcaatttctttctcagatgctttgtagccttttttgtccgcttcctgcgtaattaatgcctgtccgatcaggctgtcgatcgcctgctttttgatttgctgcgccgcatcttttgaagtcgggtcctgtcctgtttgctgatattgcatttgagcggttgataatacgctgttatagtccttgcctgtgatcttttcatcgtttacgacagccactgtttttgtgtcatcaaccttttgctgatcaagctttttctgcattgcttttatttgcttttcctgatcctgctgcccgctttgtgcggttttcgcttgatcgctggcctgggattgctgatcatcatgatttgaagagcaggcgcccaacacgacagccaataatccgatcatgagagatgatatgctttttttcatgatatatctcctttcttcaaacagaagtgaatcttaaaatgacctttagtgggcattctaaacgatcgtctctgaaaaagaaaccatttggaatcaattttccaaaatgtaatcgaattgaaaggagatcgtaatgtgatgaccgagttccggtttacttgatatgcttcgaatcaaagccgtacacttcaaagtccttcgcaaaaatgtcgtgcaccaattcttttgtttcgtcattgtaaaagctctcaaaagtcggaaacgcccagtcgaaggttgacatagtcaaaacggtgtcagcaaacttcccttttttaatcataatgtctgacagatggtgcggtgattgtgacagctgtgataacggagatttcaataatttgtatttgttttcaatctctctgatttgtgcgctgaattgctcgaggtaaatataattggtgacaaactcttcttctccttcgatatactggggaccaaggtgtcggtcaatggcattgatatccgtcccgagatcttttagatgatgcaaaaattgcgtgaaagaaagccctgtgtttatatcactgttgaacagacaaataaaattcggggagcaaatcgctgccagaaaggaactgactgctctccgaaaagggttgcgtacaaccttgtaagtgtcctttttaccctctcttaaatccgtcagaagatccttcacataattcggcttctgcgtatagatcgcatttctgtagtggtgaacttctccggcgcatcttcgattgacatcttcaagcagaccgttttggaaaaagaaccagcgattcagcgtcgtgcagccgctttttggaatccagaacagaatgatcggaaaatcctcagcataaagaggggtataaaggtaaatcaagcgattcagtctctcatcttcaaacatacagaacacatccacttcttacttggttttgggcgcgcttgagacagcggctgcctttatacacaaaatatgccgccggcaatgaattgatagggcgataatataaaaatattttaaaatgataagaccggcagttaaatccttattgaaccacatatagaaaattaagttatattttaaaaccattttatgatactagagtgagcctgtacaattcatattgatggaattttttgtttcactgcatgctcccccctgaggtaacataaaaatgagagatgcctggggcaaaatagcttgcaggaaaaaggaagggagggtatccatgcagattcgcatgactgaatatcaggttcccgaccccgaatcggggccgtacgggatcacagtatgtgcaaacgggcgcatttggtttactgaacaaaaggggaaccggattggtatgctcacagagtccggggatatcaccgaatatacgattccgacggagagcgcaggcgcctcgattattacgtccgggattgacggcgagctttggtttacagagtataaagcggggaaaatcggcaaaatcacgcctcaagggaaaataaccgagtatgctcttccaccgggtgctgccccgtttggaatcgctgcaggctgtgacgacgccatgtggtatacagatatggccggacatcaaatcggcaggctgtcctcttcaggcgaaataacagaatacaaactgcccaaaccaggagccttcccgtcatttattacaaggggagcagacggcgcgctctggtttacacaaaaccaaagcggctccatcgggcgaataacggcagatggagacatcagcgagtatccgctgccccaagaacaatccggcccggtcgggatcactgccggcccggacggggctttatggtttacagaaataaacgcaaatcaaattgggagaataacggtctcaggaaagatcagcgaataccagcttccgacagcgcatgcacgcccgcacgcgattgccgcaggcggtgacggagcactgtggtttacggaatggggcgcgggtcaaatcggccgcattacagtcgacggggatattacggaatatccaatcccgacggcagattctgaaccgcacgggatagcggccggatcagcccattcgatctggtttgcagaagagtgcggccgtattgggaaaatctctatccaaaattaagaaacgtccagccaactggacgttctttttttattgttattccgttctcgtttccattctgcggttgggcgagccaaggcctttattcatcaagtaaaaatggaaaatgtattcaccgatcgccatagcgacagctgcaaaaaacgcggccaatgcagcggtgttggcagccgttcccatcgcaagagccatcagccaaacgacaagaaaagcgacgcctaaatcggctaaagtggccgtgatgttgttggttttcggcagaataaacaaatcacccagcaaataggatactgcgccaagaacaatcgtgatgaatagggtgttttcaaaactaaaactaaacccgagccctagaacaaggtacagaatcacaatcgtcatgatgcctttgatggcaagggctttcacatgttccataaccattcgctcctttatacgggattttagtttttcttttcctcgtattcagaaaatgaaacatgcaaacttgcattcttaacgggctcagacggattccagctattttttcggtttgttgcataatagatggtatagcataacgccataaacggcacaccgcaaaaaagggcgatcctttggttcggatcaaaggcaatgccaatgcaggatgccaggcatagcagaaaagcggcaatcggtacggccggataaagcggtgtccggtattttaagtcgtctgcggtgtttccctcagccaaaaagcgtctgcggaacatgaactgcgaagccgcaatgctcatccagacagcaacaacggcaaaccctgaaatcgacacaagaacgatgtagacggaatcaggcgcaaacacgctggagagcagcgacagaatgccgccgagcatgctgaagatcagcgcgttcaacgggattccccgtgaagtcagcttttgaaatacggggtgcaaagttttttcttttgacagtgaccagagcatccgggagcatgcatacaagcctgagttggccgcggaaagcagagccgtcagaattacaaagttcatgatgtcggccgcatatggaacaccgatgcggtcaaagacgtcgacaaatgggcttttgatcacaccggcttctttaaccggaatgaggcacgaaagcacgaaaatcgttccgatgaagaaaagcaccagtctccagagtgttgtcttgatcgcttttggaatgttcttttccggttcggcgctttctccggcggcaattccgatcagctccgtacccgaaaacgcaaaattcacggagagcatcgccataaaaattggaaggaagccgtttggaaagagaccgccttctcctgcaaagtttgaaagaagcggtgcagcgtctgcattttgtatcgggatgatgccgaatatcgccgctcctcctaatataataaacaatataatggcaagcactttaatgcttgaaaaccaaaattcggattcggcgaaaaatctcactgagacagcattgagcgcgaaaatcagtgcagcgaataccgcgctccacatccagactgaagtatcggggaaccagcgctgcattaataacccggcagcggtaaattccgaaccgagcgcgacagcccaggtcagccagtatagccaggcgacggtgaatccggtgcccggcccgatgaatctggaggcgtacatatgaaacgatccggtgacaggcatggcgaccgataattcgccgaggcagagcatgacaaggtagacgatcagagccccggccaagtaggctagaatcgttccggcaggaccagcctgtgagatcgtataaccggaacttaagaaaaggcccgtgccgataacgcctcctaaggaaagcatgataaggtgtctcgtttgcatttttctttgaaagttctggcgattggtgtttgactgttccattatacctccagctttctcgcccaggcggcgacggctttgatgtcctcaggcgttgttctgcagcagccgccgatcagctgtgccccttggttataccagctgcgggcgctttctccgaaagaagctttacatgccgcgccatgccatgttttcgtttccgggtcatactgttcaccggaatttggatagacgataatcggtttagctgtatgctttttgatgccgccgatgagcgaagagacatgctccagccgcgtacagtttactcctactgccgcaacctggtcatgctgatcgagccacttcgcgcattcgccggctttcgtaccgtcgctgatatggcgtccgtctttagcgctgaaactgatccacgcatgtgtatccgggaactcttttaataaatgaacgatagcttttgcttctgaaaggcacggtattgtctcacatgccaaaatatcggcgcctgcttcgattaaagcgcccattctccgcctgtgaaaatcggccaattcatcttctgtgacgccataatttccctgatattcggaaccatccgctaaaaaggcgccgtaagggcctactgaagctgctacaaacggtttaggccggccttcgcggttttccggagccgcccagaattcatcgcgtgcttctgcagcaagacggacagactcccggatgaggtggagcgcttcttgttcgctaaggccgcgttttgtgaaaccctcaaccgtcgactgatagctggctgtaatcgcgcaatcggcgcccgcacggaaataatccagatggacttgtttgataagctcggggttttcgatgagaattttcgcagaccacaggctatcgttcaaatcacagccgtaccgttcaagctcggtggccatcgcgccgtcaagtataatgacagaaaattgttgtaaagaagttcggatcggatttgtcatctcattgttgaggctctgtcgttcgagaccccggcctccttttttagagttttttaaaatatatgaaaaatagtttaaaagactcgggaggtttttgtcaatctaccaatcatcagttttcaccagtcacttttgtcgttttctatttagggtaaaaccgtatgccgccgcatacttttttaaaaaaacagataaggggtatcggatcgatgaaaaaactgattatcaatgctgatgattttggatattcaagaggtgtgaactacggaattattgatgcctataagctcggaattttaacatcagcgacctttatgacgaatatgccgggcgctggtcacgcggcccggctggctcgcgaatcgcccggacttgggatcggcgtacatttggtgctgacctgcggaaggccgcttttgtctgaccaccggacgattgtcgattcaaagggaagttttcgcaatctcgcattttatcaaggtgcttttacaatagatgccgatgaagtataccgcgagtggaaaacgcagattgaaacatgcatcaacatgggcttgaaacccgatcatttggacagccaccatcacatcaatgcttatccgggcatctctgacgtatttttgtcgctcgccaaggagtatcgcctgcctgtcagacgtaatatggagagcgccataataacggaaaaaggagtgaaaacgacagactctttctcacctgtccttgaagcggccttaaagggtgaagaagccgtctctgaactgtttgaaaaacataataccgtggaggtcatgacccacccggcatacctcgataaggagcttttgacgaactcttcatatacttatccaagagtcgatgaacttgagtttttaaccgatccggacgttgtcatccgcttgaacaagcttgcggatgtccagcttgtatcatttaggaatttgacataaggagaatgccggaatgaaacatatacttcagctgcttggaaagtctttgctgattccgattaccgttcttccgatcgccgggctgctgctgcggctttctgcggaggatatgctggatataccgctttttcaagcgtcaggcgtgattttgaacaatatggatgtcctgatcgcgatcggcatcgccatgggctttgcccgttcaaaagataaagggattcctgcgctgacaggatatttggcgataaccgtgttaaaagaggggatcggcatcttgaatccggaccttgatatgagcgtcttcggcggggtgctcgccggcctgatggcggctttcatttataatcaatttcaacatgcaagactgccaagcatgttttctttttttggcggagagaagtttccgattacaatgatcgtattggtgacgattccggtggcagggtttttttcggtcgtctggccttacgcagaggcggcgatcgacgcttttagccagtcgcttgttggtcttggcgctttcggtgtttttgtgttcggatttctgaaccggtttttgcttccgttcggacttcaccatgtcatgaatacgtatatatattttgggcttgggcgctatgagacggcatccggagaagcggtgacaggggaaattacacggtttttgaatggagacccgacagccggctactttctcggcgggttttttatcacgatgatgttcggcattccggcgatcgctttggcaatagcgcatgcagccagaacgagaaaaaaagaaacgaaagcactcatgtcttccggagcagccacatcgctgatcaccgggattacggaaccggttgaattcacgtttttatttacttcgcctttattgtattttcttcactcggtctatacgggacttgccggagcggtgctctgtttgctggggattcgtcacggcttctcatggggagcgggcgccatcgattatttgctgaatcttaatttgtcagacggcggattattgatcataccggtgggcgttgcttttttcgcgctctattatgttacgttttactttgtgattataaagcgaaacgttccggtgatcggaagggagcaggaaacacctgaaggagaccggctgcagcagtctatggcggcaggtattctcaagtatatgggcggccgtgagaatgtcgtcacttgtgaaaactgtattacccgtttgcgactgaaattaaaagacacgtcattggcggatgaagcccaattaaagcgattgggggcgcacggtgtgatcataattgatcggcatcatattcaaattgtgattggaacggatgcggggactgtaaaaaaagacttgcagaacttgatcgacgaatctgctccggattaaaaactgaagttgcttttgaggaatctgcgcagcatcgtacgatttttgaacaaataagcttgcacctccagcagcgtgaggctttatgatggatatgaatcgtcagttggaggtgactcttatgaaaaaagatgagtattattcaatcggtgttttctcagaaatgacagggacatccattcggacgctccattattacgatgaaatcggcctgttgaaacctgaaaaagagacgggaaccggccgccgtctctacacagacagagatgcgaaagatttgcagaagatcatatgttttaagtttctggggtacagccttgaacaaattcgcgctttcatgaaggatgcatgcttcgatgctggtctgattgaggcgctgcaggagcagaaaagggtgctggaggagaggaaggagcatattgaaacagggctgaaagcgatcgacaggacgatcggtcttctggaagaggaagaggaaatcgacagttctgttttcatgagcctgctgaacagcatccagacggagaaggagcagcgcgaatggcttgaacagcaggtgtctaaaagttttgccgatgatgtattcggcaaatcagaggaagagatggccaaattggatcaagagtatgttcgtttatctaaggaagccaagcggctcatgggaaaaccggttgatgaccccgaggtgcaggacatggcagaccggtatatgaagacgagtttggagtttgtcggagagggcgtgctgtcggctttaggacagatggagacaatagaatcgcggcagctggcagagaaatttccttcaccatttacaaaagaagaagaagagtggctgcagcgggtgttcgaatattatatgattcacaacgatttctgtcccgaaagcggcggatgaaaaaaggcagttccggcggaatttaaaacacgccggagctttttaatgcaaaagctccggctcaattttcgtcgtttgattatcgagcgaaacatgcagttcatggttttgattaaccgaagcgaaaaagatttcatccattcgttcaagccctttcttcttcagctggtttttgagccagctttctgttacattcaattgctgaaggacagacgtgtacacttttccgtcaacgatgaccggatatgaaaattcgccgctgcttttttgaattcccatatcttcagctgtgatttccattttatttggctttttgtataccgttaaatttccgttcgcctctacaaacgccatttctacgtcgctgacattgaaaacgtctttttcccgaagcatttgcagaatattatccactgaatatttgattcgtttcagattgccgacgataaacgttccgtttttgatgacgatggtcggttcaaatgtaattagacgtcccagcgttcggtatttgatcatgagatttgaagcgagtctttgcaatagggcaatcgcagccaccgcagcggcggtatgcaaatgttcaatcttcggatcggctatgtccgctccgacaacggcacccaatgtaataatgattaaaaaatcaaacacaggcatttctccgattgagcgttttcccatgaacaatgtgacaaccaataaaagcggaaggatggtaatgattcgcccgtagacaaccaaaatttctttcacagtttccattgtctttcttcctttttgtagccttttgccaattcaaggttgacggatgtcattttggagttgagatcatgatatggataggaatcggttatttctggcagccggttggcatcttcctggtttgaaatcacacgacccgccgagacaaatcgttttggggggattgtaacaccgattatttttgctcccggttcgatcaccgtatcctcctggatataggcatcaaaaacaaggctttgcatcccgacaaaaacatttttgtcaattcgaacggggccgtaaatttgacattgcggggcgagtgacactttctcgcctatgtaaatggaatacgattcacggtccttaaaaacggaatgttcagtaacagggctgttgtattcatagtttttcaatccgtgcaagacaactccgtcctggatattgcagtcatggctgatgaagatttttaatcccacgtctcctctgatcgaagagaaaggcccgatgaaaacgttgcgcccgatgaccacactgccgatgaccgaggcgaaatgatggatgtaagaggacgcatcaatgtccggaatatctgcttcttgattaaatgacgccgtgatattggggctgacattatcttgaatcagcaacttttcaagaaacttgccggcgagtgatgaaaccgttaatccaaggatgagtttgctgcttaatttcatatgacctgcctcctttattcaggtagtctgcctaaaaaacgggaatattatttaataaaagcgcggcggcggtctgaaaccaaaaaagaggatatggaggagacaacggctaataaagcaatggagtatgtttcactaatcaattggtgcgggaattttgggaaaaccgatgaaaacgggatcgcccgttttaacaaacacacggaaacgattgccctgaggatctattttaaatgaggagagattcgaatttgaagctaaaaaagatgggcaaatcgtaaagcatgcggtagagaattataaggaagagacaaataccgcagctcctcctgccaaaaaggatagagacactggacatgtcgaaaaaacaggaggcaacccgctgccgaatacaggaaatgccggtctgtatcgtgctttactcattggacccatctttcttattatcggacttgctatgtttgttttaaaccgtaaaaagactcaaaatcaaagtgtgtaaatattccccaaaaagacggcgttacggctgtctttttcgtttgcggaacagcatttcgcccgcggcgcctgcggaaacgccgagcacataagccaataaatcgctccacagaaatccataaccgagaatgagccctccgagcggagcggctctgatattgtcaatccatggagcgtgatacagctggctgcattcaatcataaaacaaaacaccagcgcaatcagcgccgcggaagccgtcttcgcgtttttgaacagaaagcctgcgccgaagaaaatcatcagcgcccacagcgcatcccctaaatatacattcacgatgtccggcagcatatcggccgtctttcttgaagcaagccccgccgccatcgctgcgaatgtcagcgcaagccggcctatccggcttcttttcatattcatggctgaaccccgtttctgccaaagcaggttaagtaaatcttcggagacatgacggatacgagaggaaaaatgttttataccttttggcgtgaagcggttttaaaatgaacgtgaaaaagccgccgtacccggcggcttttcgtgttatatcgcatttttgctttcggatttttgttcggtgccggagtgctcccagcattcgatgccttcatggtttttaatgacatctttataaaagaccgggtctttgcccgctttgcgctgtttcacatagtctttcaaggcggcaaatgccacttttgacagcaggaaaatcgcaatcaggttgacgatgaccatcaggcccatgaacaaatcggcgaggtcccacacaagctggacttttgataccgatccgaagatgaccatcgcaagcacacagatccggtaaatgaagagccatgctttgttcgtgtgcaggaattcgatattcgtctcgccgtagtagtagtttccgatcaaggtgctgaaagaaaacaggaacaccataatggcgagaaagcctgaggcccatgctccgatgtgcgtgctgagcgacgcttgcgtcaactcgattccgctaagccccggctctttatacgcatcggaaaacaaaatgataaaagccgtgcttgaacaaatcaccaaagtgctcgtaaagactcctaaagcctggacaaggccctgtttgacagggtggctcgtagtggctgcggctgcggcattcggcgcgctgcccatcccggcttcattcgagaagaggccgcgtttgatcccgttcatcagggccgcgccgatggctccgcccgccgcttgttcaaggccaaacgcatgaccgataatcaaagagatgacgtccggcagtttcgtaatattcatcagcatgacgaaaacggcgacgccgatatataagacggccaggcatacgacgatatattcggacagcttggcgatccgtttgattcccccgaatgtaatgatgccgaaaacaatcgtgatgataattcccagtgtgagacggtctgtcccgaacgagttttcaaaagcgaccgttattgtattggactggaccgcgttaaaaacgatcccgaaggacaatgtgatcaagacggcaaaaaccgcgcccatccagcgttttttcaagcccttttccatatagtaagcagggccgccgcggaagccgtctttatcctttattttataaatttgcgccagcgtgctttcgacaaagcttgacgccgaaccgatgatggcgatgatccacatccaaaagatagcgccgggtccgcccaaggcaatggcgatcgcaatccccgtaatatttcctgttcctactctcgcggccatgctgatgcaaaaagcctgaaaaggcgaaattccgtttttgtcgggcgttccttcctttaaaacacggaacatgtctttcagcaagcgaacttgaaagaacttagatttaaaagtaaaaaacagtcccgaagcaagaagcataataatcaatagttttgaccaaagaaaatcatttgtgacaccaatgacttcttgaaggaattgctgcatgctttcacctctttttttgtaattttaaaaaatactgagatcccattcacgggctatatgttttaaaagcattccgcccgtcatgctgtttccgtaatcgtcaatcgccggaccatagatgccgatgccgcatccgtgctgaaaaggctgttctcttttcacgctggcgggcaccgcgcacatgattccgccggagacgccgctttttgccggaatgccgacaaaggccgcgaattttcctgatgcattatacattccgcacgtcagcattaaagcttttgtcagccgcgcgacatccttcggaatgacatgttcacggcggaaaggatggtatccgtcatttgcaagaatcatgccgatcaaggcgatgtcttcagtgcttccttccatagagcattgtttcagatagacttcaagcgtttcttcaacgtctgcttcgaggaagccggtttcctttaaataatgggccaatgctctgttccgatgggcggtctgccactctgaccgaaagacttcctcattgatctcaagccgttttccaatcattttttcaatgacgtcatgaagcgactctatttttcccagtgccgattcaccgggaaggatcgacgaaacggtcagcgctccggcgttgatcatcgggttaaacggctttcccggcttgtgcatttcaaggcggatgattgaattgaacgcgtctcccgtcggttctacatcaacacggtctaatacgtaagaaatccctttcgtcaaacacgctgcgataaagctgatcaccttcgagatgctctggagtgtgaatgatacgtccgaatttcctgctttgatcatcgtttgatcagagccgatcacacagatgccgagctggttagagtcgatttttcctaaagcgggaatgtattcggcgttgcgtccgcttgaggaaaaaggacggtaatgttcgaccaaatcttcaaggcgggattgccagaagcgggcgtcatagcgttcttccaatacttcattcatcgaaattcctccaatcctgacctgttaaagcctgcaggtttgctgaaaaaatacgaggctctaaaagcggtgatttgagcatggcggcagaaggcaaaggggtaaaagcctgtgccgcacaagttgttttaaagcctgttctttcctgggaaaaaggggtttggattgcacaagggagtgagttgcggaaaaatataagcgttttcaaatagagaaaatatacattcaatttataatggaacctacataaacctacaaaaagcgacaaaaaaatttaaaaaataagccgattgatttaaaaatcaaatcgactgtgggtaaaatgggagttgcggatattgtgcgattaacgccaaaataaagcaacacgtttgtaatggaggatcagcatgatgggtggaaatcggggaagcgtgatgacaaaagcggcccggcttgttaaaaaagacggctatatcttaatggtgatgatgttaactgtgccgctggcaggagagctgaagttttatccgctgaacgagaccttcagggtcagcttcggggttccgactttcttctttcttttgctgctgctgcggaatgtgccggctgtgctgtccggctttttaacgggggcggcagtcgtcggatttcgtgtgctgcttgatggatttgggccggggcagatcgattggctgtcatccttttactaccattatccgacttttttcttttatttcacatatgcgtttctattctacttggcaaaagtgaaacgatttcaatttcgcccgctctacatcgggtttctcggcttcggaatcgaactgattgccgatggagccgaactggccgttcaatatatgatgttcgagtctaccgtcaccccgggaaaaatccgcgacatgatggcgattgctttttcccacagctttattgtgctgagcttttttaatgtcatgaagctgtatgaaacgcaatcgcgggaaaagcagatccgcgaacaaaatgagcacatgctgatgatcgtttcaaacttatatgaagaaaccgttcatttgaaaaagacgttgaagaatactgaagagattacaaacgagtcctatcagctgtacaggctcttaaatagacagagcgataacaattcctccgtccggcagatcagccagaaagtgctgcgcctcgccggtgaaatccatgaggtcaaaaaagacaatcagcgcattttcgccggactttcaaaattaatttccaaagaaagcttcagagactacatggctgcagaggatctggtccggcttgtgaccggcataaatcgaaagtatgctgaatcgctcgaaaaagacattgactttcattattcgatagacggagaacatccgaaataccatgtgtataccgtattatccgtaattaataatattatggcgaacgcggtggaagcgattcaaaagcagggctccatcagactcagcctctataggcgcggcgatgacatgctggaatgccgcgtggaagatgacggaccgggcattcccgagaaagtcggagatgtggtgtttgagccgggatacacgtcaaaatatgatgaattcggaactccttcaaccggaatcggtctgtcttatgtgaaggaaactgtcgaggagcttggagggagcattcgattccggaatgatgcaagcggtgttgtgtttacgatcagacttccggttcaacaattgattcagaaagggtgaaggcctgtgcgtttttttattgcagatgatgaccgtgctgtgcgatcgattttaaaacaaatcattgaagacgaagatttgggtgaagtggccggagaagcggaagacggctgcgatttggaaggacacgtcctgaatttgcagcaaattgatattttatttgtcgatcttttaatgccgctccgcgacggaattgaaacggttcgtcatttgcacggcgttttctcagggaagatcatcatgatctcccaggtggaatcaaaggaaatgatcggtgaagcctattccctggggatcgaatattatatacataaaccgattaaccgcattgaaatcttgaatgtcattcaaaaagtcaaggagcgcatcgagctggaacggtcgatccatgacatacaatcttcgctgaaccggcttgtgagcctcggcggcggggggaaaaacggctttagggaaaaaagcattcaggaaacgggcgaatttctcctgtctgaactcggaatcgtcggggagagcggatcccaggatttaatcgccatccttcagtatttgtttgatgatgaacagacctcattatatgaaaaggactttccgccgctcaaacagatttttcatcagattgccgtgcaaaagctcggaccggctgcttcacccgcagagatcaacagggaggttaaagcgtctgagcagcggatacggcgggcggtcagccattcgctaaaccattttgcatcactcggtttaacagacttttcaaatccgcggtttgaaagctatgcgtcccggttttttgactttaccgtcatcagcaaaaaaatgaaagaactgcagaaagactctgccgccgtcttgccctccgcccgcgtcaacacgaaaaaattcattcaggttttctttttggaagccaagcggttgagtgaaagcgctggaaaaagaggttaaaaagagcttcctctaaagtgaggaagctcttctgcatgccggttacccagcgtattctcttttcagcagtgaaaacatgtatacgtcaatcagtcttccttttgctttctcgtattctcttaacagtccttccttttgaaaggataacgagttgagaagtttgattgaaggcgtgttttcgggctctaccttcgcttcgattcggttgaggttcaagcttgtaaagccgtagtcgatcagttttttgacagcttcggaagcaaagccttttccccaatgatttcttcctaagtcatagccgatttcagctctgccgttttcctggtcgatcatattaaagccgcatgtcccgatgacttcacccgtttcctttgcaataatcgaaaagcggtttgcctgcccttcaaggcttaaatcattgatcatttggatcatgtcccgcgcttgtgagacgtctgtaaaaggcgcgatattcatatattttgtgacttccgggtctgaccagtattgacagaggacatctgcatcctccaattccatctttctcaaagtcaatctttctgtataaagggtttccatgatcttgcctccaagttccgttttatttaggaaggtgaaagaaccattcatctatctgcgcattattcatgttcataggataaaatgcaaaactgttatcgggaagcggatggataaatcccttttttatccaagatggaaagtgcaatctcggcagcagtgcttccggcagcccgtttttcaccttgaatatgaacagcaaagaaaaaagtattttcggcagtttctacatatccgacaaaccagccggcatgaagttctccgttgataactgaagtcccggttttaccggatagaattctgccatttgattcttctaaacgtatcgaatctttcacagtttgaatattagactgtttaaaatcaaattcgttatcataaaacttttttaacatattaacctgttcaagaggggaaatttgaagagagccatccagccaataattcgccggacctgagaaatcctcatttccataatggatagatttgagatagcgacgcaaatgatcctctccaatttgccggtccagtttttgaaaataccatgttgcggagctgctcatcgcagagaataaatcctggtcttgattccattctttatacggatattgagttccgtcccacgtcatttgagaattgttcttcgtgatgatcccggattccagtgcgagcaatgcgctgaacaccttgtatgtagaagcaggtgcgaatctggcggtgctttctttcctattgtatattgtatactttttcctgttagaatcaaacaggacaaaacctcctgagaagccatcaaaaaaggtgctgtcatcttcgtattctacatttgcaccagataaaaagtgcgtatctctttgcatagtcaatatagatacagaaggagtgccggctagaatgatcccaagaacaagggcgaacactaaggcgcttttcacctttagcaaaggtgatgccgccttgaagttgacaactgtgacaatccgccttttgatatgtttgtatgagctgctgaattcagaagcggctaccaaagatgacgttctttgcttaagtgaagtgaattttaaaatcacctcgccatatttgagatgcaattttttatcaagcgtttttaatacggcaaagtcgcaagaaatctccatctctgtttttgcttcctttgataaataccacacgagaggattaaaccaatagacgattttggacaggcaaagaaaatagttgatgagcatatcttttcgtttacaatggtacagttcatgaagcaaaacacatttcatctcgtcggcagaaaacattgaaatatcctttggcaagataatatatggacggacaaccccaaatgttatgggggattttatcaatggggaacagcctaaaatcactttttgatgaaagcgtatttcctctttacatgtacgaaaaagggttaatagctctttgttgttaaccatttgcaggctcttttttattttgccgatttttcgattgctataaagagtagcgataagcataacagcaatgcccaatatccagactgcgaaaaaggctgaatctatcattttgaaggacgattgttcaatcgacatcgaaaaatcctgcacccagtttgcatgttggccaattgcttccgccgtcttatctgtggaacgggtgtgagatagcgttgagctagctcctcctaaattcagaatccagtcaaaatgattgctttttagataatgaaaggggagaaaaggagcgatcaatgccaaaagagaaatcacgctaagatgatagtgggtgcctacagtgatttgagccttcagcagtttttttatgagtatgatgagagaaaaaaacagagacaatagaatttgactaaccaaaaagggaataaagaaagaactgctcatttcattccttctttctgttcttatgttcttctagtatttgatacaactcattaatttcttcacctgacagctgatcattctccaaaaagtttaataccatcgaattaagagtgccattgtaaaaccggtttaaaaaactgtgacttttcacttctatataatcattttcgtctatatttggcgtataaacgaaaacccggccttctttatggtggtttaatgctccttttttaatgaggcgcagcagcatggtttggatggttttagggctccatgtactggttttggacaactctttaatcacctcattggtattgatcgaagaatgcttccagatgactttcatcacttctaattccgcatcagagatttgaggtatttttttcatttccatcatcctatacttacaaatgtaatactttcattataggtttgccatgttaagaagtcaatttaactggagtgacataaaatgtttttttcctttttttattccatcactcgaagatgatgcccccagccattcatttgtcaccggtttaaacgaggtcatcattctgtcggcattcatggccattcccctcatgaccttttcgttttttattccttccaaaaaaacggttgcatttaaaacttacgtatgtaatacttcaaaagactacacttgtaagatttgatgtttgagttggccgtccgtgttttcaggtgcaaggggttttcacgaatgttgccagccttagttgaaatgcctcttgattagcacagctagtcacgatcaatcaaatattcatacggagggagacgattttgatgaaattatggttcagtactttaaaactgaaaaaagttgcagctgtgttgcttttctcttgcgtcgcacttgcaggatgcggcagcaatcactcgaatgcctcacattctgccgagaaagatgaaaagacggagatgaaagatgattttgcaaaactcgaggagcaatttgatgcaaaactcgggatctttgcattagatactggtacaaaccgaacggtaacgtatcggccggatgagcgcttcgcttttgcatcgacgattaaggctttaaccgtaggcgtgcttttacaacagaaatcaatagaagatctgaaccagagaataacatatacacgtgatgatcttgtaaactacaacccgattacggaaaagcatgttgatacgggaatgacgcttaaagagcttgcggatgcttcgcttcgatatagtgacaatacggcacagaacctcattcttaaacaaattggcggacctgaaagtttgaaaaaggaactgaggaagattggtgatgaggttacaaatcctgaacgattcgaaccggagttaaatgaagtgaatccgggagaaactcaggataccagtacagcaagagcacttgcgacaagccttcaagcttttgctcttgaagataaacttccaagtgaaaaacgcgagcttttaatcgattggatgaaacgaaataccaccggggacgccttaatccgcgccggtgtgccggaaggctgggaagtggctgataaaactggagcgggatcatatggaacccggaacgacattgccatcatttggccgccaaaaggagatcctgtagttctcgcagtattatccagccgggataaaaaggatgccaagtatgatgataagcttattgcagaggcaacaaaagtggtagtgaaagccttaaacatggaaagcaaataaaaaaacattgcaatacattttgttaaaacatcgtcttacataaagtcacttggtgatcaagctcatatcattgtctggcaatggtgtgggcttttttgttttctctctttaaagataatgtgaagaaaaacgggagaatcggtctgcgggaaacgaccgggtttttgtcgaaatcataggcgattggattgatttgcgacaaaattcgacatatatactggcggagtgacttgatcgaccatgtatcgcgtttcttctcctatttgcaatactttacagaacgttaataaattctgcctataatagaacccgatcaatcatttgtatagagaggggtaatacgaatgacacatgaaggaccgctggaggaatggatgaaaaaactgagcgaggaaagcctcaaggacaatacgtttgaccgccgccgctttattcaaggggccggcaaaatagccgggctttcgctcggacttgcgatcgcgcaatcgatgggggcaatggaagtcaatgcagcaccgaggttctccgaatatccgtttacacttggcgttgcatcgggagatccgctttctgacagcgtcgtattgtggacaaggctggcgcccgatccgctaaacgggggcgggatgccaaatgaagctgtatccgtgaaatgggagctcgcagaagacgaacgcttccgccgtgtcgtcaaacggggaaccgaaaaagcaacacctcaccttgcacattcggtacatgccgaggtatccgggctgaaaccgaatcatgtatactattaccgctttaaatgcggcaaccagctgagtcctgtcggcaagacaaagacgcttccggcgcccggggcagatgttgctaaattcacattcgcttttgcttcatgccagcagtacgaacacggctattataccgcctatcagcatatggcaaaggaaaagctcgatcttgtttttcatctcggcgactatatttatgagtacggtccgaatgaatatgtttcgaaaacaggaaatgtcagaacacacagcggtcctgaaatcatgtcactgctcgattaccgaaaccgtcatgcccaataccgttcagatgcaaacctgaaagctgcgcatgccgccttcccgtgggttgtcacatgggacgaccatgaagtggagaacaactatgcgaatgtcatcccggaaaaaggccagtcagttgaagcgtttattaaacggcgcgccgccgcataccaagcttattacgagcatatgccgctccgccgccaatccttgccgaacggtcctgatatgcaattgtaccggaatttttcctacggcaatttagctgacattagcgtgctggatacccgtcagtatcgcgatgaccaggctaacggcgatggcaataagccgccttctgatgaatcgaatgatccgaagcggacgctgcttggagcggagcaggaggcttggctgtttgacaatctgagtcgctccgaggcgcactggaacattatcgcacagcagattttctttgcgcagtggaactttgggacaagcgcggcgccgatttacagcatggattcgtgggacggatatcccgctcagcgcaagcgggtgatcgacttcatcaaatctcaaaaactgaacaacatcgtcgtccttaccggtgatgtgcatgccagctgggcaaataatctgctcgttgattttgacaatccgaaatcggacatctttggcgtggagttcgtcgggacgtcgattacatcgggaggaaacggcgctgataaaagagcggatacggataagattttatcgaacaatcctcatataaagtttttcaatgattaccgcggctatgtgcgctgtacggtcaccccggaagaatggcggacagattaccgcgtcgtcccgtatgtgacagagccgggtgcggcggtttcgacaagagcttcctatgtttatcataaagactacacagggctgaaacggaccgcttccaacattgtgcctggaggcgtgaagaagtcaaacgaagtagaagaagaccgtttcctcgcacatacaagggcccatcagaagcaagtgaagcaaaaggagaaaaaagtaacccagtaatcaatgaaaggatgacagcaaatgctttcaaatatcggtattcctggtctcatcttggttctggtaattgcgctgatcattttcgggccttcaaagctcccggaaatcggccgggcttttggaaaaacgctgaccgaattcaaaagcgcgacaaagtctttagtctctgccgatgacaatgagatcggacaggggtctgatgcgaagaagcaaagcgatccatcggcacgatgatcaatagagcgggcgggtgaacccgtctgttcttttttctgtttaacatgcgaaggggaggaaggcgaaggtgaaaaaaagggaaacacatttgattgcccatcttgaagagctgcgccagcgaatcattaaaacgcttcttacgtttattctgtttctcatcaccggcttcttgtttgttcaggacatctatgactggctgatcagagaccttgatgaaaagcttgctgtactggggccgggggatattctttgggtttatatgatgattgcgggggtgctggcgatcgcagccaccataccggtggctgcttttcagacatggcggtttgtggcgcctgcgctgaccgaccacgaacggaggacggcattattttatattccggggctgttcattttttttattttggggattgtattcggttattttgtactctttccgctcgttcttcagtttttgatcggcctgtccgccggccattttcaaacgatgtttacggcggagcattattttcgctttatgatgaacctcacactgccattcgggtttttgtttgaaatgcccctcatcgtgatgtttttaacgagcctcgggattttaaatccggccaagctcagtaaaatgagaaaaatttcttattttgcgctgattgtcgtatcggttgtgatcacgccgcccgatttcatctcagatgtgctggtgatcgtcccgctccttgtattatacgaattgagcatctctttatcggcatttatctaccggaaaaaaaccgccgcacaacaaggggctgaggcccaaggctgaagacggactgtgtcttcagtctcttttttttttgcctgaaatgaaaaaatcagaaaataatgatattgacaatttgtttatttgtcttacaattaaacaaaaagatgaatggagggatttactaaaacagagacatcgtatttcaacagaatgacaacgctttctcagaaaatgaacgacagggggatgacggagatgagtcaattacggaaggcgccggaaggcatattgggttttccggtggcgcccttcaacagggaaggaaaactggaggaagaagcactttacgaaaacatccgctttttattggatgaagggcttgaggcggtttttatcgcttgcggctcaggagagtttcaatctctcagcacaaaggaatatgagcaaatggtcgaaatcgccgtttcggctgcggacgggaaggtgcctgtttacacaggagtgggcggcaacttaagcaccgctttggaatgggcgcggatttccgaggaaaaaggggccgacggctatctgattctcccgccgtacttgatacacggagagcaggaaggcctctatcaatacacgaaaacaatcattgaaagcacggatttaaacgcaatcatttatcagcgagacaatgcggttttgacgcttgaacagattcagcggctgaccgatctcgagcagcttgtcggacttaaagacggcataggggatatggcgttgaatatcagtttgtcatatacgataggtgacaggctgggctggctcaacggaatgccgatggctgaagtcacgatgccggcctatgctccgattggctttacatcatattcttcggcgatatccaattatattccccatatttccagaatgttttacgaggcattattaaacggcaatgaccggcttgtcaaagagatttatgagcaagtcatcataccgatcaacgagatccgcaaacttcggaaaggctatgccgtgtccttgatcaaagccggcatggaaatcatggggcttcatgtgaaaaacacggcgagaccgccgatcgttccggtggaaaaagaacattgccggcagcctcgaaaacattctgaaaaacgcgatggcgcgttatccgaaaacgaccgctgccctataaacaaaaaggaggaacttgaagatgtctgttgcagctgaaagtaaaacgtatttcaactttatcaacggccgctgggtgaaggctgaatcgggcgggatggaacagagcttgaatccggcagatacacgggatatcgtcgggcttgtgcaaaaatcttcgattgaggatgtagaccgggcagttgaagcggccaagcaggccaaaaaggcgtggagaaagctgtcgggcgcggagcgcggtcaattcctttacaaggccgctgacatcatggaacagcgcctcgatgaaattgccgaatgtgcgacgcgtgaaatgggcaaaacactgcctgaagcaaaaggcgaaacagcgcggggaatcgcgattctcagatactatgccggagaggggctgcggaaaacaggtgatgtgattccgtcgaccgattcatccgcttttatgtacacagacagggtgccgctcggcgtcgtcggcgtcatctcaccgtggaatttccctgttgccatcccgatttggaaaatggcgcctgctcttatttatggaaatacggttgtcattaagccggctacggaaaccgcagtcacctgccttaaggttatatcgtgctttgaagaagcagggattccctcaggcgtggtcaatgcggtgacaggaccgggatcatcggccggccaaaggcttgccgagcacccggatgtgaacggaattacgttcacaggatcgaatcaaacaggaaaaatcatcggccggacggcgtttgaaagaggggcgaagtaccagcttgagatgggcggcaaaaacccggtgatcgtagcggatgacgccgaccttgatattgcggttgaagcggtcatcagcggagcgttcaggtcgacaggccaaaagtgtacagcgacaagccgcgtcatcgtcttaaatggtgtttatgaccgttttaaagaaaagctgcttcaacagacaaaagagattacaatcggcgacagcttaaaagaagatgtctggatggggccgattgcgaacaaacagcagcttgacaactgcctgtcctatattgcaaaaggaaagcaagaaggcgcggacctcattttcggcggtgagaggctggcagatggaaaatacgaaaacggctattatatcaggccggccatttttgacaacgtcacttccggcatgacgattgcccaagaagaaattttcggcccggtcatcgctttaatcaaggcggatacacttgaggaagcgttggagacggcaaatgacgtcaaatttggcctgagcgcctccatttttacgcaaaacattaggcggatgctgtcattcacagatgaaatcgaagcggggctcattcgcgtcaacgccgaaagcgccggtgtcgaactgcaggcgccattcggaggcgttaaacaatcgagctcgcattcacgggaacagggggaggcagccaaagaattttttacagccgtgaaaaccgtatttgtcaaaccgtaagtcagtcgtttcggtacaaatgaataaaggagaagatgctatgaaaaaaaatcgtgcagcctcccccgataccgcggggaaaagaagttctgtccgctggtttgtcgtgtctatgctgtttctcgtcacatccattaattatgccgaccgtgcgacactttcgatcgtcggcgattctgtgcagcatgagcttgggctgagttcggtggcgatggggtatgtcttttccgcatttggctgggcgtatgttgtcggccaaatccccggaggctggctgctcgaccgttttgggtcgaaaatcgtcatcgccgccagcatcttcttttggtcattgtttacccttttgcagggtgcgcttggctttttcgccgcgggaacggccgtaatccttttatttgcgctcagatttctcgtcggtctgtcagaagccccgtccttccccggcaacggccgggtggtggcttcctggtttccaagttctgaacgcggaacagcttcggcgatcttcaactcggcgcagtacttcgcactcgtcattttttcaccgctgatggggtggctcgcccactctttcagctggcatacggtttttgtcattatgggtgcactggggatcgcgatgtcgttcatttggctgaaaacgatttacgaaccgaaaaaacacccgagaataaacgccgccgaactggcgtacatcgaagaaggcggcgcgcttgtctcgatggatgagggaaagaacgcggaaaaaaaagaaaaggagtcgcaatggccttatattaagcagcttttaagaagccggatgctgctcggggtgtatatcgctcaatactgcatcacaacgctgacctatttctttctgacatggtttccggtctatcttgttcaggcgcgcggcatgtcgatccttgaagcgggttttgtcgcatcgcttcctgcaatctgcggatttttaggaggattgctgggcgggttcgtgtcagacttccttttgaaaaagggctgctccataacggttgccagaaaaacgccgatcatcctcggcatgctgatgtcctgctcaatgatcatatgcaactatgcagattcgtcctggctggtcgtttccatcatgtcgcttgcctttttcggaaaaggattcggcgcgctgggctgggcggttgtgtcagatacctcgccaaaggagtgtgccggcttgagcggcggcatcttcaacacctttggaaacattgcgtccatcacgacgcccatcatcatcggatatatcgtgaatgcgacaggctcatttaacggagcgcttgtgtttgtcggagccaacgcgattgccgcggtattaagctatttgtttctcgtcgggccgatcaagcgcatcgaactgcagaaagagaaagaccctgcggacaccactttatccatgtgaaatgtaagcgctttaataagagggaggctaaatcgatatgaatacaaacatccatcagcatgtaaaagaggagaaagcatcgcaaacaccgtctattgccgacatgcgggttatacccgtggcagggcgggacagcatgcttttgaatttgagcggagctcacggcccctttttcacacggaatatcgtgattttaaaggattcatcaggcgctctcggcgtcggcgaagtgccgggcggcgagcggatccgccagacgctggagcaggcgaagccgctcgtcatcgatcagccgctcggcgctgttcaatcgattttgcagtccgtcaggcgccggtttaaagacagggatgccggaggacgcggggtgcagacctttgaccagcggacgacgatacacgctgtgaccgcattggaagcagctttgctcgatttgctcggaaaatttctcggcgtccctgtggcggcgctcttgggggaaggccagcagcgggataaagtgaagatgctcggctatttgttttacatcggggaccgaaagcgcacgacgcttccctatatcagtgaacaagaggcaaatgacgactggttccatctccgccgtgaagaagcgttgactcccgaggcgatcgtccgtcttgcggaggcagcccgagaacgatacggatttcacgattttaaattaaaaggcggcgtcctttccggagaagaagaaatcgaggcggcatccgctttagcgaagcggtttcctaaggcgagaatcacccttgacccgaatggggcgtggtcattggaggaagcgattgcgctttgtaagggaaagcgggatgtacttgcctacgcggaagacccttgcggagcggaagccggatactcaggccgggaaatcatggccgaattccgccgtgcgacaggcattccgacagcgacgaatatgattgcgacagactggcggcaaatggggcatgcgatacagctgcacgccgttgatataccgctggcagatccgcatttttggacgatgcagggatccgtccgcgttgctcaaatgtgccatgaatgggggctgatatggggctctcactccaataaccattttgacgtctcactggccatgttcacccacgttgccgcagcagctccgggcgatatcacggcgattgatacgcattggatatggcaggatggacagcgtctcacaaaacagcctttttcaattgctgacggatatgtccaagttcctgatcagcctgggctcggcattgaaatcgacatggaacgggtggaaaaagcaaatgaactatatgagaaaatgacagcaggcgagcgcaatgatgccgctgccatgcagtttttgattgaaaattggcgtttcgaccctaaacgtccttgtcttgttcgataattgcggaaacagcggtttgagaggcccctagccgacattgtcatacgcgatattttgtcttacaatatgaacaactgaaagggggcccacagtcgtggaagaagatatggaaacattgcaggtcgaatcagtcaatcgcaagactttggcaaaacaggttgttgaacgaatcgtccatttattatcaagcggccagttgaaaccgggggacaaactgccgacggagattgagctcatggaaaagctgaatgtcagcagacccgttctccgcgaagctttaatatcgctcgaaacgctcggaattatcaaaagaaaaacccgggacggcacatattttaatgataaaatcggcattcagccgttttctgtcatgctggctttggcagtcgataatttgccggccattattgaagcgaggatggcgctggagctcgggcttgtcacgatcgccgcagaaaagatcaatgacagtcagctcgaaaggcttcaggaaacgatcgatattatagcaaacagcacggataatcattatggagaagcggataaggaatttcaccggattatcgctttgagcgcgaacaacccggtgcttgaagggatgattcaatcgctcttgatcacacacgccaaaatcgacagccagattccatatagggaaagggaccggactgtcgaatatcatacgaatattttgaaagcccttcaacaaagggacccatatcaagcctatcaccatatgtatgagcatttaaaatttgtacgtgacaaaatactgaatggtcttcgtgatgaaaaaaacaatcattaagttgtttgacagcgctttctaacatgtgccgcggcgggagaagggccgcggaaaggcgctgatcgaaaaggggagttgatcaatccttatgcttgtcaatcaaactgaaaccccgttgtacattaaggtgaacgaaaaagacaatgccgcaatcatcgccaatgccggcggactgccgcaagggacggtgtttccttgcgggcttaagctgcaagagcggattcctcaagggcataaagtggctttaacagacatcacacagggcggtgccgttattcgctacggcgaaattatcggctatgccgtcaaaccgatcgaaaaaggcgggtggatttccgagtcgcatatcatgcttccggaagctccgccgctcgatgaactgcccatcgccaacaaagttccaaaacccgctccccttcttgaggggtatacatttgaaggataccggaatgaagacgggagcgtcggcacgagaaacgtgcttggcattatgacaagcgttcaatgcgtcgcaggcgttctcgattacgcagtgaaacgaattaaagaggaactgctcccaaaatatccgaacgttgacggtgtcgctgcattaaatcatcagtacggctgcggcgtggcgattaatgcgccggaagccaaaatcccgatccgaacgattcaaaatatcgccaggcaccctaatttcggcggtgaagcgatggtgatcggactcggctgcgagaagctccttccgacgaagatagagccggaaggagacgctgaaaacattctttcactgcaggaacggcaagggtttcagcaaatgatacaatcgattatggaaatggccgaagagcgcttaaaaaggctgaatgaacggaagcggatgacatgtcccgcttcagacctggtgatcggcctacagtgcggaggcagcgacgccttttcaggagtgaccgcaaaccctgcgtccggatatgcggccgacttacttgtccgggcaggggccacggttttattttcggaagtcaccgaagtccgcgatgccgttcatctcctaacaccgcgcgctgtcaatgaagaagtcggccgcgccctgattcgggaaatggcttggtatgaccgctatctggaaagaggcgaatcagaccgaagcgccaatccgtcgccgggaaacaaaaaaggcggactggcaaacgtggtcgagaaatcgctcgggtcgatcgcgaagtcgggaagcagcccgatcagtgccgtacttgcgcccggtgaaagggctgtacagaaaggactcatttttgcggcgacacctgcaagcgattttgtatgcggcaccctgcaattggcttctggcatgcatttgcaggtatttacaaccggaaggggaacgccgtacggccttgaaatggctccggttttgaaagtggcgacccggcagtcattatcagaagattggcacgacttgatcgacgtcaatgccggaaggatcgctacaggcgaagcttcaatagaggaagtcggctgggaaatcttccggacgatacttgacgtcgcaagcggaaggaaaacatgggcggaacattggggactctccaatgacttgtgtttattcaacccagcgcctgtgacttgatccgtgctagtgggaaagtagattggtatcggccaaaagatccggagatacaataggtttcaactagaaatatggataatttttgtaaaaaacacacgtttttcaattacaatgagtgtaattgcacgtgtgtttttatgttgaaaaggatgggtgaacaagatgcagcacatattgcttattgaagatgatcattcgatcagtgaaatggtcgatcattatttaacaaaagaaggatttgaggtcgtgcttggcttttgacggagaagagggcgttcgcttgtttcagcaaggcaattatgatgcgattctgctcgacatcatgcttcctaagctgaatggaatggattttctgaaaatgatccgtgaacagagcaaagttccggttttaatgatttccgcaaaagacggggatgtcgataaagcgctggggctgggctttggtgcggatgattatattgccaagccgttttcgatgatcgaactgaccgcaagaataaaagccgccattcggcgggcaacgcaatattccgtcagtgaaccggcaaatcaaaaaatattacgtgttcacgagcttacggttgatatagaaaatgtatccgtacaaaaaaatggtgaaccgcttcagctgacatcgacggaatggaaaatgctgactttgtttgtgacaaaccctaaaaaagtgtttacaaaagaacaaatctatcgttcggtttggaatgatgattattttggcgatcaaaatattattaacgttcatatgaggcgcttgagagaaaagatagaggatgatccttcctccccgcaatatattaaaacgctttggggcatcggctataaattagcagagttttaggatgacaatgttatggattggcattctgataattttggcgtctctcaatatcgttcaatataaaatgaaaagacaacgggatcgaaacttgaagtacatcacggaaaagctcagtgtgatgctaaatgagcatgaggctgatcaaattttattaggaacggctgataaagtactgcgggctctgctcgtgcaaattaacctgtttgttgaggagcatcagcacataacagcccgttttgcaaaaacggagcagtcaatgaaacgaatgctgaccaatatgtcccatgatctgaaaactccgctgaccgtcgtgctcgggtatatcgaggcgatccaaaatgattcagacatggcggaagaggagcgtgaaagactgctggagaagctttatcaaaaaacaggcgaaatcattcagctgatgaattctttctttgacttggccaagctggaatcggaagataagcaaatactgctcactaaaatacatatcaacgaaatatgcagaaaaaacattctccaacactatgatgccgttcaggcaaaaggttttaaagctgtcatcgacatcccggataccccggtttatgcacatggaaatgaagaagcgcttgaccggattttgcaaaaccttttatcaaatgcgattcaatatggtgcagacggaaagctgatcggattgtcccttacatatgatgagacgtggattgtcattacggtatgggaccgtgggaaaggaattagtgagtacgatcagcagcgggtgtttgaaagactgtatacccttgaggaatcgagaaataaagcgttccagggaagcgggctcggtttaacaattacaaaaaggctcattgagaaaatgggagggaacatctctctccaaagcaagccgcatgaacggacagtgttttccattacgttaaaacgaatgacctattagcaaacgtaagaatttcttaagaaacaagaaataaaaaagacagcgtccatcgctacaatagacacatagcagagacaggaaaggagaaacagagttgacttacatcgtacaaacaagcgggcttaccaagacattcaaaggtcaagaagttgtttcaaatgtaagcatgcatatacgaaagggagaaatatacggttttctcggcccgaacggagccggaaaaacgaccatcatgaagatgctgacgagcctcgtgaaaccgacaagcggcgaaatcaatatccttgggcataagctgacaaatcgatcatacgagattctcgggaaaataggcagcatgatcgaatacccgattttttatgaaaatctgacagccaaagaaaatttaaatctgcattgtgagtatatgggatatcacaataaagccaagattcaggaagtgctggacatggtgaatttaaaaaatatcgacagcaaacctgtcaaaacattttccctcggtatgaagcagcgtcttggaatcgcgcgggccattctcaccaaaccctacttgctcatcttggatgagccgattaatggccttgatcccatcggaattaaagaaatcagaaacttatttcaagtattgagcaaagagtatggcatgacattgctcatctcaagccacatcttgaacgaagtagagcaaattgcagatacaatcggagtgattcgggacggcaggcttgttgaagaagtatcgatggaaagcgtaaggggacggaacacagagtacattgaactcgtgacgccgaaccaattgcatgcttgctttgtgcttgaacatgagctgcagattgctaattttaaaatactaaatgataaaacgatccgaatttatgatgccgaagcttctcaaacagccatttctaaagctctgattttgaatgatgtagaaattgaatccatgaataaaaagcatacttcgcttgaggactacttcctcagcttaatcaacggcaatgcggtcaacgcataaggaggcggagaaatttgctgaatttgatgagaattgaaatgaaaaagctgaagctgggatggtatatacgcggagccgtctttgccaatttcatcatttttggttttctgtggatggtgacctgcacagaaggcaaggagacgttccaaacgattgatgaaacttttctattgatcggcacttttgttagagccgtttttatcgtattcggcgctgtgctgatctcaaaattagtgatttcagagtttaaaaacaagacaatactggtgatgttcacgtatccgatcaatcgaaagaaactgctggctgctaaactgctgatcgcaggcgggctgaccttcgttacgatattgatatcaaacgcatgcgttgcagttggtttttttctgctgaactcaatctatgggatcatccccggcgaattaacagcttctatcgcgtctcagcaggctctgaaaatgatcgtttttgcttttggcgccgcaggaacgagtttagtacccatcttttttggaatgagaaagtactccactgcggcaacgatcatctcatctgttgtaatcatcatgccgatcagttccacaggccctggcttttctatttcttcaattgtgtatatacctttatctcttgccgcagtcggtctgtttttttcctttttggctgtaaggcgtattgaaaaaatagatgttttttaacggagttgaagttcaatgctgaatttaattaaattggagtttaaaaaaacaaaattagggtggtattacaaaggtgcagtaattgcaaatctatgtattctcggtttattgtgcctgatcggatcagaggaaaaaacctccctcaagcaaaaatgtcgatggctgatgccgcatccatgctgctagttataggaattttcgtgaggtctgtgtttattgtctttgccggcgtgctgattgccaaactggtcatcggagagtataaaaacagaaccatcacggtcatgtttacatatccagtcagcagaaaaaaactaatggcagcaaaactgctgcttactggcggattgacctttttgacaatgatcgtgtccgaactgattcttgcatttattttctcgcagctcaatgatgtctatcaattcagcccggaaaaattgacgatgcatgacgtagggaatgagattggcagtatgctcatttatgctgcttcctctacaggactgagttttattccattatactttgggatgcgcaaacaatcagttcctgccaccattgtgacatcctgtatcttgaccacgttgatcggtcagcaaagcgatgaatttccacttgcttccatcatttacattccgatttcattggctctagtcggaattgccattgcgttttggtcgatacgaaaaattgaccaggaagacgtattataagatctccgtatatcttgaaggtgcaaattgacggaataccggcatttacctatacttgaagaactgaaacaacaaggaaaacgggtgaacatgtcatggaatttgaaattcgctacatctccttttacgtcatccaggtcgacggcaaggatgagcaggccaacaagcaatataaacattttcagacgctggatacagaggaatttgaaaacagcgagctgaaggatttcttagacggggaattgaaaaaaatcgtcaagcggaaagccgaacgccatccgaaatcggagcaggtgccgacgaaaatcggccgcttcatcacagagccggggcatgagcttgattctaatccgaactacaatctgtttcacaaaacaaaactggcggagacaaaggaagaattcaatgaactgagcgaacagttcgtccgcacatacctcgacacgagcgccgtcaggggaggcgtgtttttagtggcgacagccgtaccgcgcaaatacttcgatgatacatttgtctttgtcatgaagtgcgactttgaaccgaaggtcgctacgatcgccgatgaatcgtcgctgattcgcaaggtcgaaatggcgattacgacgaaaaacatgaaatcgattcagtacccgcacatgcctgaagagggcatgacagaggaaagcgaagtgaaaatccaccaggcctcgcacgcccgctactttgaagacttcttaaaattcgtcgagtacggcgagtcgatgccggaaatcatgaagtcacaagtgatgaacatggtgcaggagcacgtgtacgaagcatttgaagacaaaagcgaagaactccagcagtttgaacacgacctcgaaatctgggaagcgagcgaaaagcgggagattcaggaacgtcttgacacccaccaagtcatcgaagcctcagcccaaatcgttgagcacatgcctgaggcagagctgaaaatgaagctgggagaaaccgagattaaaggattgctggccgagttcggagactcgatccacctcgccaaagtaaacggccgctatgtggcgctcattgaagccgaaacgatttcgtttgaaaagggcagctctccggtcgagttttataaacctgagggtctgcatgaggtgattgagcggatacggaataaaattgacagggaagatgagaaataagaaaaggcatccgtttttttgggatgccttttgatttttcatccagatagatgagactgctaaataggttttcatgtaaattactgtttaataaggttaatataaacataatcaagccgatatagggagtatagaaagaattgaggggaggtgcccaatgcgtctcaatagtcaatacatccgtacacagctgatggtccagaatatattgaaaagaaatgcggctgatacaactttaaaaaatgtctcttccgatatcactgccgttgcgaagaaggccagcagtcaagcagggagagcatcgaaagaaagtttgagtaagctgaactactcaaaggacagtattgtgaatcatgccggagctttcaggcgggcatacgaagcagcaaatgatcgaactgtcacagatacagggaaagaaacgaagattaatgcccaaaacccctatgtgtcagaaagtgacatcaggaaaaaaatcttagatgaaaaatacagcaaaataaatgcaatgaacaaaacgaaacccgaccctttaggctacattaaggataaatacaaaaaccccaattccccttatttcagaaatgacttgtcggcagcagaaagacaggctgcatatgacaatgaaactgagtggctgttcaaaggaaaggcgcaaagctataatatgcaggatgccgcgtttcgaaatgtgacttttaatggggaagtagagacggagaatgagaaagtatatcagcgcagccaagtcaacaaacagcttcaagcgctgctggatcaatatcatattgccattccagcggatgcggcgctcacctttacgattacaccgattgattatcaagtaaaggtaagcggaacagatgatgagcaactcatccatcaaattgaacaaatattgcaatcaggagaaaacagcaaacagttatttctgcatatcatgaaaagcttgagcagcgattcggcacaatattccaaagaagcgcaccaaaaatatcagacggttcgcgagatatatgaggtgacagggtatcacctgaaagatttggaagtggttgatggccgatatgtaacaccttccggccgtgatttattagaagtgtataaagaagagctggagaaggatcccgtcctcaagaaaacggctcatctcgcaatcgctcattatggagcagagctgaacaggcttgcggaagccgaatatgattctgttccggatttcatcttgtctattgactacagcaacgggtcattgcgggatacagggcaaaagaagagctatggaaccggggatacggcttggctaagagaattaaagcgccgaacgggtgtgaatgattagttttaaaagccaggaacgagtttcctttatcagggtgattttcttaataattgaatttttcgttgcgggtcttcccaacacctgttaaaataaggctaacttttaagaacggagggatttcccaaatggcatacatcagattccgattgaactttgtctaactaaatcgtgaacaaagactctgcctgtgtgcagggtaatcgggattagtctgcctgtttttagggagcccttatgcagtaatagagggagaggcgcggattccagcgcctctttttgcctttaaaaatagcatttctgaagcttgccttcagtttattagccatatcttttttccgtttactttccagcacaggcagacgacctgcgctttttttattcaaaaccttcagcaaaggggaaaatcgtatatgacaactgtaaatgagcaaattgaacatacattaaaacttgcggaaaaacacggccttcggctgaaacgaaagcatgcggaaatcaacgagtccggcatggattttcaagtcgtttttgcagaagatgaagcaggtaagagttgggtgttgagaaaaccgcggcgcgacgatgtgattgaaagggcagtgtatgaagggaaagtgctgaagctgctgcaaaaccgtcttcccgcggctgtgccggattggcgcattcatactcccgaactgattgcatatccggagcttccgggtgtgcctgccgcagtcattgacatggacatcaagaattacgtatggaacatggagcatgagcctccggctgaagcgtttaccaggtcattggcgaaaacgctcgcgctattgcacggcatcgatcataaggacgcagaagaagcgggcatgcatgtgatgaatccggatgacgtcaggcagacaaaagcagagcatatggagcggatcaaaagtgagctcggggttagcgccgagctctgggaaagatggcaaaagtggctgtctgacgactcgtattggcctgaacatacggtgtttatccacggcgacttgcaccctccgcatattttgattgaccagcatcagagcataactgggctgttggattggacagaagcaaaaatcgccgacccggctaaagactttctgttataccagacgattttaggagaagccgaaaccgcacggctcatctcttattacgaagaagaaggaggacgcgtctggccgcggatgaaagagcatattaaagaaatgcaggccgcctacggcatcgaaatcggcatgtttgcccttcaaacgaaacaagaagagcacttgaaaatggcgctggacgcgcttggcgtcacacaataaaaaaaggctgtcgatttcgatcgacggcccgttttacatcatcactttttcaatcacagcaaaaaaagcctttttttcttcctctgacaatttgccgaagagcttgtcgatcaaggcctggcggttttccaccatttgtgcggcgatcctcgttccttcttgcgacagttcgatccagacggtgcgccggtcatcgttatttctcgatctgatcacaagaccctctttctccaaatggttcagagctgttgtcgttgctgatggagacagcgcgacctcctgtaaaatttcctttatcgtacatgttccgtgtctgtaaatgatacgcaaaataaaccctttgccgctcgtgatacttttcggaatcgtttcttcgtctaatttctttgaagaccgcaaatatttcgtgaaagcatggtccaatagattcgcttcaatccgatggtgattcatgaaggtttcctcatttccgacatcgtgtagtagatcagcaatttcatactgaccaaacaaacataggtctattttatcataagcgaatgctccgcaaaaaacgattttgtgaattttaaaatgagcggtttaattccttttgttatcagttcataaagataataattctattatgaaatagttttacaatggatatattttgttttagaatgaatttgtgcgtcacataatctcaccaggttttgtgagaaacaatgaaaatttggagatgaaaattttgagtacacttcagcaattaatcaatcatcatatggaaacgtcagatgggttggaagcattgtccggaggagatcgaacgtttacgttcaaagcgtatcaccaacgggtgaaccagctggctcattatctgctggaggagggtgttcaaaaaggagaccacatcgcggttttatgtaaaaataatcatcattttcccgtcattttgctggcgtctcttaaaatcggagcgacagtcgtgccgttaagctggcagctgacatcgtatgaattaaaaggaatcttgaacaactgccggccgaaggtgatgttttatgacttggaatttgccgatatactaacgccgctccgcgaacagcttcagttctgcctgatgattgaagcgggtgcgggaatgaacacgactgaacagtttgagagcttatttaaaaacaggccgctgaaggtggaagctgagcaggtgacagagcatgatttggctttaatgctgttcacctcgggcacgacgggaaacccgaaaggctgcatggtcaaccacggcagtctggccgcatacttgacagaggtgaacgtgaaatcgaagcagctgaaaggcacgcgctttttagcgagccacccgctctatcatatgagctcgctcaaccatgtttttcaggcggcttttgaaggaattgccctttatttcttatgggatcccgaaccgtttgaaatcctgcaggagatcgagaagaaacgcattcatatgatgatggcgtttccttccgtctacacctacatgctggaggaaatgaaaagacatccattcgacctgtcatctgtgaaaatgcttgtttccggcggcaccaaggtgccggcgcggctgattaaggagtacaatgaccatggaatcatgatggtgcaggggtacggcagcacagaagcatggacggtcagcgtatggcggcctgacatgggctgggataaagtcacttcagccggcaagccgattccgcaagtcagcataaaaatcgaagaccctgatacacatgaagagctgccgacgggagaagtcggagaagtcgtcgtcaaaagcccgtatgtttttgaagggtattaccaaaatccttccgccacgcaaaaggtgctgaaagacggctggttctatatgggggactccggcaaactcgatgaagacggatttttatatattaccggccggtataaagacgtcattgtctacggaggcgacaacatttatccggaccaagtggaagaaatcatcgatcaagtgcccggagtagttgaatctgccgtcatcggcgtcccggatgaaatgtacggcgaggttccgagggcgtatgtggtgaaaaatgaaagcgccggcctcaagaaggaggacattatcgcgtattgcaaagagcgcctgtccgactataaaattcctgaaatcgtctttatcgacagccttccgaaaaacaggctcggcaaaatcgtcaaaaaagatctgcgtgaactggcagtcaaagggcagtgagcgcaatgattgaccgaaagcttatccagcattggataagctttttttgctgattccttgcatcagctgccgttttttgtaacgttttccagtgctaaacccactacaacattaggaggtgttgacaattgaaatcgaaatggagtgcaatggtggttattgccggtcttttattgctggccggatgcggtgcactgaaggaggctgatcccccgcgcggcagatcagcgcaaaaaacggaagcctcgttttctgaagctgaacagcgatttgcgctcgccttgtttcaagacatgataaaagaagaagggagccggaaaaacatcttcctctcgccttacagtattcagcaggcacttttgatgacggcaaacggtgccgcgggagacagcagaaaggaactgctcagcactttacatctcagccaggcggatatggcatcgatcaacgggatatcaaaatctgttaatcgttctcttgaaacgctgcctcacggtgaattttcatcagctaattcgatatggaccaaaagggagctgaaagaaagctttcaagacgcgatcaaaggccttggcgacgcctatcagcttcaaattgatcctaatcgggcaacagaggaaatcaacagctgggtcaaaaagaaaacgaaagaccgcatcgatcagatcgttgataaagtctcgtcgaatacgattgcctacatcatcaatgccgtctattttaaagaaagctggaagcacccatttgatcctcacatgacagcggaacagccattttattcagcggacggctccgcaaaaaaacaccccatgatgacgcagacaaaccgctttccttatctggaaaacgaacattttcaagccgtcaagctgccatttcaagacgaaggcctgtcactagccgtttttctgccgaaaaaagcggcaaatctagaacagcttctgactggcatgacgcatgatcaatggcgcgccttgcaaaagggctggacgatgaaacaggtggagctcaagctgccgcgcttctcatttcaaacagactacatgttaaatgaaccgcttaaacgccttggaatgaaaaacgtgtttagcagcgcgaatttttcaaatatgtttaccgggcatggcgccgctcaaattaataaagtcagacataaaacatttatcaaagtggatgaagcgggcactgaagcatccgcggcaacggcggttgaaatcatcgaatcagcccccgtccctgaagtgaccatgactgcagaccacccgttttattttgcgatcgttgatgaagcatccggaatgattctctttttgggcagtgtggcagagccgaaagatgattaaatctggggaaataccattattttataaaaattcattaaacttcctgttttattaccgatattaggaagggagttcctttatggtgatgaataaacaggaggcaaggacaaatgaaaaaaagtttgtttctgttcgtgttcagtttgtttttgatggcgattccagcattttcggcttcggcgaatgtttacgaagatgagtatgaacccaacaattctttcgctgaggcttacgatgtagggttgtggaaatacaagacgatttcggcgacgattcacagcgaaagcgataaagattattacaaattttacgcgacaaagggagaacagcttgccattcacctaaagaacatcccggcaaatacagattatgatctatatttatttaaagatgcttacggctatcccgcagtaggatcttctgaaagaatgggaaaccaaaatgaaatcatccgcttggatgttcccgagacaggccgatacattgcggtcgtcatgtctaaagacggttcatatgacggctggggattttacagacttgaatttatcgacagaatgaagagcggtgcttatacggcgaatttgtctccgtcatccatctcaagcccgggacagggagtcgtttctccggttgccgccgtcaatcttgccaatgcctcggccattcccgaaggagcgactgtgaaaagcgtttctgccgagggaacgatatatccaagtctcggacacacctacagagaagtcctgaacaaggaagaaggcgtttggcacacatcggtttcaggcggcacactgtttccggatctaaagcctgaacttgcgcttcccgtcaaaacgacatggaatgtgagatactattcgctcgcttggagcagttcaacttggagatcgccgcagctgaagatcaattatcaatacgattcaacatacggctggtaaacagatccaaatcccggccgatataaaaagtaatagaatgtaattggcatgaaaggagctcccatgaatattagagacagggtaaaactttcgctttattccgagcagctgatgaagccggccgccgcgaatgtgccggcaaagactaaaggctccaaaaggatgcccgccagccaaacagacactctctccatcagcaaacaggctgaatcagcccaaaaaaatgcaccgtcattacggtcacaaatgaacggcgttcaatttgagatctataatctttatgtggacaggcagcgtttgaacagccagatcgaaggggcgctgcgggagagcggaatttccctttccgaaagcgaacatctgacattgcatgttgacggacataaccggattacagttgaaggcatcgaagacgaacaaaaaagaacccgtatcgaagctgttttaaacgacagcgataaacggttcggtgcgcgtctgttgggccacgcagaactgatcggtgaacaaaacggaacgccgctggataaacaggcttacgaaaaatggcatgtgaatgagtttttgaaaacggtcgccgggctgtctttggctgatgtcagtttggatgaaagaggagagcttgaaggcggaaatgagaagctcacccgagtgattgaatcagccaaagacccgaaaagcgacttggagaagagttttcaaaacattctgaagaagctgaagaatgtcctggcgaaagggccggacaccattctggacaggtcggcttctttcggctatgccggcggaacgcttatcgatctcaatgtatcaaaaggattctccgcgggccagctgaacgagtggctggatgatccgtttcttagagaagtcctgctgaacaatttttaaaagacctggcaaagtgattttgccgggttttttgtttgcataaaaattgcacgaaaaaaatttcaaatttcgcattgaccctcacgttgcgggatactttatagtcaatatcgaagggaggtcagatggatgaaaatgaaagtaaaggaagtggccgatttagtcggcatcagtgtgcgcacactgcatcattatgatgaaatcgggttattagctccgtcggagacaaccgaagccggatatcggctgtattcagatgacgatctggaaaagctgcagcaaatcttatttttcagagagcttgacttccctttaaaaaagattaaaagcattcttgagaacccttcatttgacaagaatgaggcgcttcagctccaccgcaaagcgctgctggagaaaaggagccggcttgaccaaatgattgcgacaatcgataaaacgatccaatttgcgaaaggagaaatcaacatgacaaacgaggaaaaattcgcgggttttgatttcagtcaaaacccgtatgaggaagaagcgcgggaacgctggggagatgaagccgtcgacagatcgaaggcctatatcgaatcgatgtccgaaggtgaacgaaaaaaaatggaacagcaatatgacgccatttacagaaaaatcgccgctctcagagaaggcgcccccgactcagaggaagcacaggcggctataaaggaatggtacgactttctgaacaataacaccggccacagctattcgctggaagctttcaaaggtctaggacaaatgtatgtggctgacaagcgctttacgaaaaacatcgatcaatacggcgccggcttggcgaagttcatgtgcgacgccatgacggtgtttgctgacagaaatcaggaataatcgctggaaaccgcctgataaggttgtgaaatgaccttttaggcggtttttttagattttaatgtgagatattccttttgggcaatagcctgtgctgacttatttgatttgcaggctgattgctgtgtttgatttgtgtcgaatcgtctaatatgctattatatcgttagtcgatatatcgtaagacgatacaaaatgaggaggcaaatgatttgaatacataccttaccgggattttatttgttttgagcggaattcttttattaaatctagcggttttatcagggataaacggtgtattgtgggggctggttcttgggggcagcatcattttcaatctaataggtgttgtactgctcatgagatatataaatgaaaaaagccatacttaataatgaggtgcgaaaagtgatgaaaaaaacggcggaaaactatctaccgcttacgcaggctacatattacatattattgtcattaactcaaccattacacggctacggcattatgcaaagggttgagagcatgagcgagggagaggtcaaactagggcctggcactctttatggtgcattaagcaaactcgaaaagcaggggttgattaaaaaggaaggcgaaaccggcgataatcggagaaagcagtatattttaacgaatgaaggatgggcggttgttgaactcgaatttaaacgtctgtctaaattggtggcgatcagtcaatctatttttcaaaaagagggagatacaagcaatgagtaaaaaaagaaagcgtaaattccgtttttttcttgcctggcaagaccggaaggaagaggactggctgaatgaaatggccaaacaagggtggatgttaaagtcattctttttatttatctatacatttgaaaagacaaaaccaagcaatacagtatatcggctcgactataagacaacatcaaaccttgatcaagaagaatatattcatatttacgaagatgcaggctggaagcatgtgacacagtttttaaattggcattactttgcggctgatccgagtcaagttcaaacaaatgtgatttatacagaccgtgaatctgaagcggaaaaatataatggcttactaaaagtgttatatgctgcacttgccagtgtatttctcagctcgggacttccgattcttatcataggcatcccgggatatttttattggatagcagcattcaatctctttgttttgtgcctgttgatcgtgtgtatattaaaggttcgtagaaaaacaagaatttgacgctgtttgacacccgctaattttcagagtaatatattttttacaaatcatgtacggctaaacgatattgaagaagagcaagtacgtgtcagagcatgggcttaagagagtcggtggctggtgtgaaccgatgccctcctgatgccgaatgggcttctgaatcgcttcgctgaaacgggcagtaggcggagccgggatgttctctccgttatcaagagaagcgtatcgaaagggctgactgtcccctttccgtatgttccgagcgaatcgtttatgcgattaataaaggtggtaccgcgagaccctcgtccttttgtgacgggggttttttgcatttttaaggaggtggtggccatggaggaaggctggccggagtggccgcataatactaaacggaaacggaggtgtgatcgtaaatggtgattgcaacggacgatttggaaacgacatgtccaaattgcaatggaagcggaagagaagagccggagccttgtccaaaatgttcgggaaaaggcgtgattttgacggcgcagggcagcacattgctccattttataaaaaaacatctcaacgaataaaaaggacgggtgtttagagttgagtcgagcagagaagagtacagctgagcagagcggccatattcaacacggtgttcgaaaagcggccggggtcgtttttatggtctttgggacgatgtgttttgcttcaaaatccatttttgtcaaatgggcttatgaacaaggtgcacagccggaagcggtgctgttgtaccggcaattatttgcggcgccgctgttttggctgatttttattgtgtatcgctcaaagcttccggctaagcctgaaaaagcggagatttttaaagcttgtgcggccggattgctttgtttttttctatcgccattgcttgattttatcggccttcacggtgtttctgcaaccgttgaacggatgattgtgatgagctaccccatgttcgtattgatcataaccgcctttgtaaataaaaaaatggtctcgggtaaaacgtttgctgccatcttgcttgtgaatgccgggctgtttttggctgtcggcggatgggatgtgcaagcattggaagcgaacctgtcaggggcttttttgatcctattgtccgctgtcgcttatgcggcctatcttgttgtggcgggaggacttgtccgtcaaatcggagggattcgaatgaatgcctatggaatgtcggcagcaagtcttgcgatggccggttatgcgctgcttcgctcgctgagagaacaaccgggaatcgtgctttcttatcctcccgcaatgtatggtttttttatgatcattgcggcggtgacgacggtcattccttttttattcatgctggaaggcatgaagcggataggagcggaacgaggggccgtcatttccatgatcggccccgtcctcaccatcttcggaggtgttttgtttttaaacgaacgtttaactcccgttcagtggctggggtgcttgctagtgcacctgacggttagtctgctggaataccggaaatagagaaagggattcatatccctttttatttctgtttaaatgaataaaggtggtttactcagtgtcggacgttttcatgacatatgttctagccgcgaaatcgtggaccgcttgtttcgttcctgaaaaaacgacggttaaatacagcagaccgaaaaagatatgcacccatgagacgatgtagcgcacgaaagcctgccaaagcttaatccgtcggcccgtatcatcagaaacgatacgaattctaaaaattgcttttccaatcgtgccctggagctttgtcagcggcatcagaagcggatacaaaacgtataccagcagggcggctgcagcaacttcatgagatccgtcgccgaatatccatgcggatgaaaagtgtaacccgaccgccaatacgcaatcgatcaaccatgcacccgctctaacccaaaaacgagcgtattgcaatatgtataacatcctctctattataaatgaatgataaaaacacaacattaaccattttatagtctttttttctatttttaaataaaccttttggcctcttttataaaattttacttttcagctaaatcatactgattttcattatcggatttccccctcctgaaagttttgataaaataaataagttgtagtataagatacggaggtttaaacgtgggaaaagtaaaaagaaatatgccttgcccctgcggcagcgggctgaaatataaaaaatgctgcggcaaagcagagggagcgtttccggctgtcgcggtgcaagaattgaaacaaatccagaaagacgtcatggaattcgcttttacggaacataaagacacaatcgatcaatttctcaatcagtattcttttctgtcagacctggatcagtctgcgcaaaagatatgtgtttttaacctgggcgtgtggggagtatttgcccgcccgctggcagatggaggattgacgatttttgaagactttttacagaaaaaaggatcttcgattctcagatcgcagacaaaggaagccgttcaatcgtggaaagacctctcccctgcgttgctgcgtgtgaaacatataacagatggcggcattcgctttgaggatgctgtaacgaatgaagagctgaccgtgaggatgaatgtgaaacgggaagggccttttgtaggcgagtacgtgctcggctttccgatcaagatcggaagccataccgagttcttcttgcaattcaccatctatcctgcaaaaatggcggatgctctcaaagacaggctaagcgaggctttgaaccgttttacagaagaaggcgggacgaaagagcagctgatgagagaggatttccatcatgtgttaatgcatctttgccggcaggaagagagtacaccgtctgaacaagtgtccgaagacatcgaatgggccaatgagatggaaaaagaaacagcgctcgtttttgagaaaggtatgcttgacgaaggacattctgaaccatttgtgtcctgggcggtcggcctttggaaatcgtattgtgccaaaaaagcaccggtcatcaaaaaaacagaagcctttgcagctgctttggagtattttatcaatacgatctccaaatcggaaaaatcgatatcccaagcaaagcttgcaaaaaaatacggcgtcagcgcttcgaccgtatcgaatcgttttaaagatattgaagccgtcctgcaggatgaacttgaccatcatcttgagcttatgccatcttaaaaaagctcacacaactgctaaaccttccggggaaccggaaggttttttgcgtttgattctgattaaatcttgagaaagatattttaagatatcggtacgatcagatcaaacaaggagagattatgatgagtacaattctactggaaacaaggcatcttcaaaaaaagttcggaagatcgcaagcggtctcagacgtctcattgtcagttgaaaagaacagtatttacggattgcttggaccgaatggagcaggaaaatcaacgactttaaaacttttaaccggaatcttaaacccaactgccggggatattttgtttgaggggcggcaatggaaaaggtccgtattaaaagacatcggttctttaatagaatccccgcctctgtatgataatttaacagcctacgagaatgccaaggtgcatgccgcattattgggccttccagatgcgagaataacagaggtgcttaaaactgttgatatgcatcataccggaaagaaaaaggcggggcagttttctatggggatgaggcagaggctggggatcgccatcgctcttttaaatcgccctaaactactcatacttgatgagcctactaacggtcttgatccgatcggtatacaagagttgagggaactcatcaggtcatttcccgaacaggggatgacggtcattttatcaagccacattttatcggaagtcgagcagatcgcagaccatatcgggattatcagcggagggtatctcggatatcaggggaaaatcaataagggagacgatcttgagcggctttttatggatgttgtcaaatcaacgcgggagaaagagggcggagaaaagtgatcggatattatgtaaaagcggaaaacctgaagtttaaaagaacattttcgagaaaaatgatcttcattgtgcctttgattaatatttgcttcgcctttttaatgaatccgggattttttgtagcaggtacgtataattggtggtctgtcatcttaatgccggtcatgatcgccttgctttgtgcacaatcacaccagaaagaaaagaaagcgtcgaattataacggcattttttcttctcctgtagatttgcatcagatttggtatgcaaaaataagcgtcattgcgctctattctttagcatctcaagctgtttttttaggattcatggttgggatgcagtttgtcattcctcaattttcgagcattcatttgacagtcattgccgcgaatctgctgctttggctcacgacactatgggagatccccgtctgtttatggatagcgcgaaagtacgggtttatatctgccgttttgttcaatatgctgggcactatcatattgggcatcatgtcggcatcaagccctttttggtggctgaatccttggagctggccgatcagggtcatgtgcccgacaattggcatccatccaaacggtgtgcctcttgagaatggcgatcctttaacgagctgggcagtcgttcctccggctgttgttctatctgttctgttatttgctattttggcgcgtctgactaggcggtctttttctcctgccgttgatcgcaaatcgataaaacgggaggcggtttaatttgttgttatttttcagatgcctggcggctgattttcaaaaaacaaagcgtacgtcttttatttggcttcacttgagtgttccggttatctgtgcgggtgtttttctgctttatttctataacagacagcccgatccatatcaattatatcgcacgtattttgaagccattgcgattgcattgccgcttctgattggaattgtgtgcggaatgacggcttccttagaggagcaggcaggccgttttcaagtgctgttgggcggcacggctcccaaattaacggcttatttaagcaaagtcacgctgcttctgatcatgaacatttttgcggtattcttggctattggactctacttattggggctcagagctctttttcatgtgccgaacctgccaagctccctttttttagaggctggggcatggctggcagccggaagtgtcacactttatttcatatactttttgatcagctgtacattcggaatgggggcttcgattttagcaggcggggcaggccttttgatgacagcgctgatgaacacgggattgggcgatgtcatttggaaatataatccctgggcatggggaatcaggctgacagggtataaggggattgaccgatttgtccaaattgatccgtctctccgctctgttctagatggggaaatcaagcagggggctttcatcatggtgtttgctataatagctgtattcgctctaagcatcatttggtttatccgctgggaaggaagaaaagcttttgaataatgaaaaaagggtggtcagcaagtggcgaaaattttggcagtagatgatgagaaagatattcttgtactcatacaaaatattttgcgccgcgatcagcatcaagttcatacgctaagtcaagttaacaccgaatctctcgacgtgttttcagggtatgatttaattttgcttgatgtgatgatgccggggatggacgggtttgaattatgcgagaaaatccggccgctggtagattgtccgatcctgtttctcaccgctaagacggaggaagaggccatcgttaaaggcctcctgactgggggagacgactatatttcaaaacccttcggcgttcttgagctcagtgcaagagtaaatgcacacctgagaagggaaagaagagagaaatacgagactaaacgggtgatttccggttttttatttcactttgacagcaaagaagtatttattcatgatcaaaagctgaatttaacaaaaaatgaatttaaaatatgtgagctattggctcagcataaaggacgaacctttacaagagaagaaatttatgatcatgtatacgggctggaaggcaatgctttatattcgacgataaccgaatttatccgcacgattcggaaaaaatgcaaagaacacaatagagatccgatcaaaacggtatggggcgtaggatacagatgggaataatccgcaaaaaaaagacactgcgcagagaactgatcaaatatatgctcactttgagcttcagcctgatcgcgatcacggctttatatgttttggtcaatatgataggaatgaatgcagggctgttttatcctgccaactacaatgaaatcgaagctgaaaagcttaagcccaggcttcaatcggctgaacagataacggaagacatgataccggatacaatgctgtacgccatactggacaaaaagtcgaaacaaaagacagcgggaaacatgaaagagacgaatctttcgattgtacggaaaaagatagagagcaggccttatgtcagctttagtcaaaaaggctatatgattatcgaacgcaaagacgagtattgtgtattggagtatcctttgcgcgctgagtttcggtctccactgctgagacggtttctcccgaactatgagctgacaagcatatgcatcatcgttcttcttttaattacggtcgtttttacggtgacaacccgatttgcaaacagattaaaagaacattttcaaactttaaacaccattgccgagcaaattaaaaaacagaatttaaattttactccggagttctcgaatattaaggaatttgatcatgtaatcagttccctgatggacatgaggaatgccctccaagcctccctacgggcgcagtggcatttagagaaaacgaaaaaagaacagatcggcgcattggctcatgatattaaaattccagtgaccatcatcaaaggaaatgcggagttgctgagcttatctccgcaaaatcaagagcagtcggaatatatcagatacatccttgacgcggggcaaaaaatcgaacagtacattgaccaattaatccatctctcaaaaactgaggaagcattacataccgagtacagagaaggcgctgtgaaaacgctagtcgaaagtgttctccatgagactgaagcatatatagggaacaaatcgattgacattgtgttgaaggagcagaaccttgaaggaaaaaaagcagtgtttgacaaacagctgcttcaccgagcgttgatgaacatcatgacgaacgccgcagatcacacaccagaaggcgggagaatcgattttgaagctgtgtgtacggctgatcaattgattttcacaatcactgacagcggaaaagggttttctcaagacggcctgcagaaagctgccgagcttttctatatggaagataaagcccggacatcgaatggtcattacgggatgggacttacctttgcacttcgtgttgttaagcttcatcaaggcgatttggcgattaaaaacagcgaagcaggaggcggacaggtacaagtgaccatccccctctgagaccagatcatcatttccatatctcgtcattctcataatcaaaaaccttccggcatcggccgggaaggttttttacggttctccaagttcctgtttcaaatattggtacagctttgcatcagcctgtttcagcggaaacgccgcggttttgcaaaggatgccgaaggttacgctgatcgggtcatcgtcgataaaccggacaatcgttccgggaggaggaggggaaacgatgcttttcggaatcagggcaacgccgagtcctgcggcaacatagtttttcaaagctgtcatgcttccgatctccatcgtgttcatttggctccccggcagctcttgaaacgcgatttcgactttcttccggtaggtgcaattgttggccgtaatcagcaggcggtgctccctaatatctttcagatgaatgcgttcattgtttccggcggggtgtccctcagggagcagcactacgagttcttcagcataaagcggttcaaaataaagatctgttcccattgccggagtcgaacagacggcaagatccaggcttccttgaaccagccgttcccccaatgccgacgagttggcgatatcaacggaaacccggatcttcggataatccgctaaaaatctccccaaaatctggggcaattcacagctcgcgatcggttcgaccgctccaaggcggatatttcccccttcgccaagcaataagtcggccatatgatgttgaaggtgatctatatccttgacaatatgtctgctttcttcaaaaaaaagcctgccggcttcagtcagacggaatgttttccccctctcgagcaaacgaatgccgaggtcttcctcgagctttttgatttgcattgtgaccgtggactgcgcataattcagttcttcagccgcgcggttaaagcttccgcaagccacgattttatgaaacgtctttaacgttttgaaatccatcccatcacctcaagttcaataaaattgaatgaaaccttcaaatgattcaattatacaaaatgatataaccgttatacactattaaacaatacaaaggaggaatgaatatatgccatttgtcaggatggatcttttaaaaggaagatcaaaggaagagcttcgccggatcagcagatcagttcaccaggcgatgacggaggcgatcgatgttccggaagacgattattttcaggtcatcacccagcacgatgaggaagagttctttttcgatcctagctatatgaacatcaaacggacgaaggatttgatttatattcacatcacaatgaaagagagaccgatcgaaaaaaagctggctctgtaccaacgcattgcagagcgtttgcaaaaaaacgccggcatccgccaagaggacgtcatgatcattgcagccgaaaacgtgaaagagaactggtcgtttgggaatggaacagcacagcttgcatcagttgaaagggagcgttgaaaaatggaaatgaaaaataaaacagcccttgtcacaggaggcggcacagggatcggcagagcggtatcgctctctttggcaaaccgaggggcagcggttgttgtcaactattcgcgttccaaagcggaggctgaagagacggttggaatgattgaaagtcaaggcggccgcgcgctcgcggtgaaagccgatgtttctaagatcagtgaagttcaagacatgtttgatcgggcggtgggcgagttcggtaccgtcgatctgctcgtcaacaatgcaagcatcaccaggcatatcgagcttgatgacttggaaggggcttctgaagaagtctgggatgaactgtatgcggtaaatgtcaaagggatgtttaattgtgcgagagcggcggcaccttttatgaagcgaaataaacaaggcgccatcgtaaatgtcggcagcatcgccgggcttaccggttcaggctcttcgttaccctatgccgtatcaaaagcggcggtccacggtctgacgaaatcattggcgcatgcgcttgctcctgatattagagtcagctgtgtggcaccgggcgcggtatcaacgagatggtgggaggggaatgaagagaaaatgaagcggctcagccaaaagctcccgcttgagcggatagcggaaccggaagatatcgccttgctcatttgtgcgctgctcgaacaagaaacagttacaggccaaatcttaacggctgactgcggtcaaacattatagcgattataagcctattatcctatttctatatgaaaccatttaccttatgataaatcatatcgaaatagaaaaaagagggaagaacgtatgaggcgtttacaatcgttagaagccattgaaaaagtaaaaaacggggattatcatgttttgcgggatgccgaatggctgaagtatctcgttttaactgaagagcaaaatatcaacctggagcggatttcttcgctagagaacatgcctcagaatcccgtttttctttatgttgaacagacgctctctattttggagaaagctgacattcctgagctggaaaaagaaatcattgaagaggttctcatatggagtgaagcggctaagtgcggccagcctcataaaagaaaggaatggcgtgaaaaaggttttcagcttgcgatccataatatcgggtcggcgcagatttatgctgatcgaagacaggcgtacatgccggaacggcaggatattgaagaactcatccatattttgattgtgacgcatggactcgtcggacagtatatccgcggggaaacaaggtatcgccaattcactcctcttatcgattggattgaaacatctgaacttcagcacatcgatatcaggcgggttctatacgtgctgaacaaatgtatcattgaagcggtatcgccggcgctttgggattcgatagaacgagacgtgaaccgggtaatcggccaaatctgcacaggagaaagaaataaagactggccgtttgcggaaaggatcagaaaactgcggggacaagcgctcgattccggtgaagacagcagccggtacgagcggtttttgagggagcattcggcggaagatacgctgagacgcttctttcagcggattgatttatggtatgtggaatccgccttgtcatcattcagttttgaagagtttgtcaaaatctttctgctcgtgcttcgttctgtcaaccctttatcagtcaagcacatcagctttgagccgctgatgaaggacatgtaccgtgattaccagggtgtgaggcatataaatgtttataaaaaacgaattatcgaagcgtgcttaaaagagatgtcgatcagcgatttgctttacggcgaggtgcctgtaaatgaacacgtttcgcttgctgttcagccgtttgatcaggcttctgagattgtcggcgtcacgttttcattttcgcaggcaggactgaagctgattgaattttgccaggaagcggagaaatcgcctttatatgaacgggcgatcgtgctgctttatgatttttttgagtttcgcaaggattcgtttgaccggctgcaaaatgaagcggcttatctgtctgatatgaacggtgctgaagattataaaaagaagattgccgattatgccgttggagaaagaatgctcgacatcggagccggaggcggcgtgatgcttgatttgctgacagaccagcatccagaagcagaggtcatcggaatcgacctttccgtcaatgtcattgaggagctccaaaaaagaaaagtgcgcgaacataagccctggcatgtgaaacaggctgatgcattggacctgcctgagtactttgagcaggaaagcgtcgacaccatcgtattctcatcgatattgcacgaattgttttcatacattccgtatgaagggaaaaaatttaatcatctcgtcattgcccaagcgttaaaaagctcctttgacattctgaagccgggaggcagaatcatcatcagggacggaatcatgaccgaaaacaaagaggaaacgcggcggatacggtttaaagacccggatggaatggatttcttgaagcggtatgtccatgattttaaagggagaaaggtgcaaatgcttgaggctgagaaggacgcggctgtactgtttgtgaatgatgcaatggaattcctctatacatatacatggggagaagaagcctatccgcatgaagtgcaggagcagttcggctattttacgccgtctgaattccgccgctgtatcgagaaagaattaggggaacgtgcgaacattctggtgttcgaacactatgtgcaggaaggatatgaagaacacctttaccctaaaatcgagctgacagaccggctcggccggcgtgtgccgctgccggacagcacttgttttattgtaattgaaaaaaagcacctctagggtgctttttttagttgttgcttttaaggaagcttgagaagtattgttcggtcttgtaattatcagcatcaattttccatttgtcattttttgatttttcaagtttgacttcaacggttttctcacttgaagtcgcctctgcttttttgatttcttcactcatgatgtcaatcgcaggattgatcaattcatctctggacatgaagtctttgccgctgtctttcacatagtcttccagtcttttcttcactttcttttggacatctgtattatcgattggcgtaacggttgcctcaacagttgcttcatcgcctgaaattgattttgtaactgctttgacttgagatttttcttgataggcgttttggatggcgctgatcagtttattcaatttctttttatccacatcttcttcatcataatatcctaaagagcgaacgatagatttttgagcgccttcaaggtaatcggtaacgacttcacgtttgttttcgtcgaccagtttatcaaagttattattgtctttgccgaaaatcgttacgtctgtgtaagctagcaaagcttttgccggatcttcaagttttttggccgttttcagtaattcgtcgctgccgccgtcgatctcgaatttgacaggatcggctttattttcaccgtacatgtcaggtgtgtattcaagctgaaactttttgcctttttcaacgatgtaatagatatttccgtcgacttctttgtcagaattcagcgtcgaagagcgaagccttttgtttctttcatcatatacgctgacgtccgacatttttgagtcgccttcgtaaaggctgaattggcttttatcaaccattaatggttctttccctgtatttttcacggaaacattgatctttagtataagttcattttcgtgcaggtttgttgatgaatcatcaggaagcgtatattcggagcttaggattttaacttctgcattatctgcttttttcgtatcttctttctctccgctcgcgcttttgctgcctccgcaggctgttgacacgactgctacaatcatcaaaagcatcatcagaaaaaactttttacttcgcatggtctgtctccttttttattatttttttcaatgttatgtaaatgaaaagaatgaggcggccagggcataaaggcccttcatcgggacaaatcttactcaagtcccggtcatttcatttatctaacagtgaaaatttgattataattcttcctttttccttagtttctttaaaaaaacagaaacaacatcactcattttaaggtttgaagaatcattaataaataggtgttaaatactaattttggtcaatgatttgcaggattaggcatgttttcaaactttggatagtaagaagagactaaaactaatgacatgcacttcggtgcatttaattgaggtttatccattttttactttagatcctggtcagatcaggttaaaaatataagtattttgtttaggagacgcccttatgttggtgaatttcaaatttgggccatagtgaataaaaagtcccgttttcgggtttccttaacctgagcttaaaatttagtagatcaattgtcttagaaacggcggttttgatggtgtaaggcttttctatagtcagagagatggaggcatattattgggggaatgcagccgggggcaccggctgcatattgtggaccggatgtttacttaataccaattatcatagcgataacaatcgcagcggcgccgatgataatccagcctgcgatcagcttccagacaaacttgacccagcgttcataagggacgcctgcgattgacagtgaagccagcaatacgccggaggtcgggatgattgagttggtgatcccatctccgtattgataagcgaatacggcaatctgacgttcgaatcccaataaatcggccagaggcgccataagcggcatcgttgtggctgcctgtccgcttccggatggaataaacgtgttaatcgcgatttgtacggcgaacatgccgatggcgctgatttcattcggaagcgagctgattgctgaagcaaggctgttgatgatcgtatcgataatatgtccgttttccaatacgatgacgatggcacgggcgaagccgacgatcagcgctccgtatacaacctgtttcatgccgtcgacaaacgaatggaaggtgttgttgatgccgcgtcctcccgcaagaccggcggcaaagccgatgatgagaaagccggccgacagctcgcttaaaaaccatccccattgaaaaacaccgaacatattgatgccgaagcccaatgctgtaatcagcaggacgaggccgtgtcttccggtgaaggaaagatcagcgtgtcctgcggctgtctcttcatttatctctgtttcgcttccatacatcaaaccggtattcgggtgcgctttgacttgttgagcataacgcatgacataaaaaatggagaaaccgagcatggcggcataaacggccagtctataaccgaaggcgctaaacaccgggacttccgcaattgtctgtgcaattccgactgtgaacggattcaacatgccgccggtgaaccctgcagccgcgcctagagaaatcatcgccagccctgtcattgaatcatagccaagcgctctcgcaacagcgattccgatcggaataaaaataatcgtctcttcagacaaaccgatcgttgcgcctccgatggaaaagacgaacatggtgacggggatcaggaggaagccgcgtttcttcaagcgctgcacgagcacatggacaccggcgcgaatcataccggtctgatggatgatgccaaaagctccgcctattaaaaagatataaaaaataatatccgccgattgaatcatgccctccggtatggctttaaacatctcgaaaaaaccgaccggacctgcgtcagtctgcttgtagctcccttgtacgataaccgtttggccgtcttcttcaacccgcttaaattctcctgatggaatgaagtatgaagccagtgcagctaaaatgataatgaaaaaaatcaaagcataagtatgtgggaagtgcagttttgttttctgtggggtgccattgctcattccgttcgtctcctttataatgtattaatattcagataattatatatttaaacattttgaggatatgagctttactttgtcaaccctggaaaaaactttcggtaatcgagaagggagaaccgttatgaaaaaacaaattgagaaagagatcgaaaatattcgtgaagagctgctgcatatcagccagtatataggcaatcatcctgaactggggcacgaagaattcaaagcttcaaagattctgtccgaggagctgaaaaaacacggttttcaggtggaattaggcacatgcggccttgcgacggcgtttacggccgagtttgacagcggccgtcccggtccttccattggatttatggctgaatatgatgcattgcctgaccttggccatgcctgcgggcacaatttgatcggcacgatggcggtcggcgccgcaatcggcgtcagcaaagtgattgcatcgtgcggaggaaaagtgtatgtttacggaactcctgcggaggagacgaaaggcggaaaagtaaccatggccgaacaaggggtttttgatcacttggacgccgctatgatggttcatccgtattgcaggcatgaaaaaagcgggacatcgctggcgatggatgcgatccaattcgaattcttcggaaaggcttcgcatgcggcgggagcacctcacgaaggaatcaatgcgctcgatgccgtcattcagacattcaacggcattaatgcgctcagacagcacattctccctgatgcccggattcacgggattattccggagggagggaaagcggcgaatgttgtgccggattacgcggttgcccagttttacgtcagaggaacggaacgcgcttatgtcaatgaactgctcgataaagtgaaaaattgtgcaaaagcggccgcacttgcgaccggagcccggcttgagagctctttttatgagctgtcttacgatgatttgaaaacaaatgaaacgctgtcagacgcttttacacaaaacatgatcgagttgggcgtcgatccggattcgattcatgaaaaagcggacggaggaggttcggttgatatggggaatgtcagccagatcgcgccttccattcatccttatgtgcaaatttgcgatgagccgtatgcgtgccacacacccgagtttcgtgaagcggccatgagcagccgggggttcgaaggcttgatgctcggcgcaaaatctatggcattcaccgcatatgatgtgctcatcaatgaagagctgctgaaaaaaataaaggaagaattcaaccttttaaaggcgctggcctaaacggatgatccgaaaacgatcaagtcctgttttgatgaatattgacgagaagccgccggggagcccggcggcttcagcgtgtcgacaaaccctcgcattcgttgtcaggcctgcgcgccggtgcctaggaattacaaacattggctgttctagactgcaaggattgcgtttcacgctgaaaagatgacaaaatcccaaaactaacagtcgtttacaggtcgagcgataagcggatcatatcgatgcagcgcatgccgttttcgtatatcggcttctcgtaatgtctcaggaaaaagttccggtcgatgccggtgattctaaatccgcatttttgatagagcgccagctgaccgatgcttgaattcccggttccgatttcaatcgtcttaaatccttgagctttcgctgtttcaatcgcatgcataaccaattgtctgccgattccttttccctgcagatcttctttgacggcgatattgacgagctctgccgtttcaggcctcgtcggcagcagcacatagacaccggcaatccggcggtcgatttcggctgtatagcactgtccccgttcgaggtaatcgttaaccagtttttcggaagggtctgccgtcaacagcaaatcaagcggcggctcatgttctggatgcaatctccgaatgttcatttcactcatctccttttgatctaaacagaaatcgttgaaatccccaaaaggctcatgcacaatagtaagcacaagcgaacagtaaagtgaggtactgatatgaatatatctgactatgtaaagcatgacgcggttgctttatctaagcttatcaaacatggggaagtaacggtcaacgaattaatcgacgctgctttttcccgtcttgaagaagtcaatccagaactgaatgcagtcattcggacaagaaaagagcaggtcaaaattgaatccaaacagcttgacatcagacaccagccgtttgccggggtgccgattcttttaaaggacatttcccaagcgttgaaaggggagcctctcacagccggcgccaagctgctttcatcttataaaccaaagcgcgattcgaatttcgtcgcgaaattgcgcggcgccggttttttatttctcggacagacgaatacacccgaatacggattaaaaaatatttctgagcctgaattgtatgggccgtcgcgaaatccttggaacactgattattcacccgggggttcaagcggcggttctgcggctgcggtggcggccggaatcgttccacttgcaggggcaagcgacgggggaggctccatccggataccggcttcctttaccggactattcggtctgaaaccgacccggggcagaacgcctgtaggaccgggcgccggacggcagtggcagggggcatcgatcgattttgtgctgtcccgtacggtcagggacagcgcggcgctcctggatattctgcaaaccattcagcctgaagccgcttttcaaacgcctttatttccaggtcagtatgaagaggatatgaaaaaagggctggagcgccctttgaaaatcgcattatctgtagaatcacccgtcggaacgcctgtcagcgatgaagccaaacaagccgtccgccgcaccgttcgatggctggaagcgcagggacaccatgtcgaagagcagacgaacggcgttgacggaatccggttaatggagaactactacttaatgaacagcggtgaaatttccgcgatgattcttggaatggaaaaaacgcttggaagagcgatcactgttcaggacgttgaaattgtcacatgggtgctgaatgaagcaggcaaaaaagtgtcggcagccgaatttacagcaagccttgcttcctgggatcgagcagctgcacaaatggcggcgtttcatgagacctatgatctgtatgtgaccccggcaacggcttaccccgctccaaaggtcggcgagctcacccataccgaaaaagaagccgaagcgctcctgaaagtaagtgagctggaaaaaatcgagcagcagtcgctgatttatcaaatgtttttgaaaagcttgacatatacaccattcacacagcttgccaacttaaccggacagcctgcaatgagcgtcccggtccatctgacaaatgaaggtttgccgctgggtgttcaagtgacggctccgaaaggaaaggaacattggctgctgcgcaccgcccatttattagagcaatcagacttatggatcggaatgaaaggaaatccaatgctcggcagtctgtaaccgtataagagaggaccgcccgttaatcaggccggtcttcttttttatcgtacagtttttcaagctcgtcaaccaatgttccgacatacgtcacagcccggcggatcggctggtctgtcgacatgtcgacaccggcgtgtttcaacaagtccagcggcttcatggtaccgcctgcttttaaaacgttcagccatctgtctacggcagggcggccttcttctttgatctgttgcgagacgatcgtcgatgctgtcagcccggcagaataggtgtaagggtataaccccatgtaatagtgtggctgacgcatccatgttaagcttgctccttcatcaaccttaactccgctgccccagaattcggagagcacggcgctagtttgctcagacagtacggaagcggtaagtgcgtgcccctgttcggcgagctcatagactctccgctgatattccccctcaagcagatgggtgacgaaattgtggtaatacgtgcccatcagctggttgatgacccagcgcttcattttcggatcatttgttttggaaaacaaatgctgagcgagaagcatttcgttcattgtagaaggcgcttcaatgaaatatagagacggtctgacattcatgatgcgctgctctcggttggcaaagtaaaaatggccggcatgaccgagttcatgggcaagggtaaaggcatcccgcatcgtatccgtccatgtcatcaaaatgaaaggatgcgctccgtacggacttgaacaaaacgcgcccgttgatttgccgatattgtcagcgagatcaacccaccgctcagtcaaggcggtttccatgacttccgtgtactccggccccatcacttgtaaagcgtccaagatcatccggccggcctgttcgtaagtcgtctttggactgaagtcgtgatcgagcggagcctgcaaatcgcagaagcgcatttcgtcgaggtctaatacgcgttttttcaaggcggcatacttgcgcatatgaggtgcaagttcgtttttaatcacatcaagctggttgcggtacatttcgagcgtgacgctttgcggctgaagaagcatatgggtgacggattcatatccgcgcagccttgacatgctgacctgttttttgacctctgtttcatagatggcggcgatggtgtttttgtatgtttgcagggtattggtaaaggagtcgaatgcggttctgcgaatatgcgtatcaggagagaacatgtattttccttcatataacgcgaacgaattggcgagtgtattgccgtttcggtcctgaatcggggaaaattgcatatccgcaagcttcgccatcccgaaaattttgtacggggcatcatgtatttcgcctaaaacggctagcgcttcctctgtttcgggagcaagtttatacggcttgagttccattatctccgtcagcattttgctgaaaggctccagtcctttctcgttttttatgtacgtctccacttgattttcggggaattcaagaatttccgattggataaatgaaagcccggcgtttatttttgcttgcagcgcggccatccttgaagcatcagcttggttgacggggtttgtcaaatcttcggactttctgaggtgagtataggcggcggcccggactaggcgcttcagcagtatctcccgcagcgataaacaatccagcaatacgccggctccttcatgcagccttcctttaaatgagccgatggatgcgagatcttcctcaattttcacaagtgcgtcttcccaagtttcataagaagaaaataaatcagtaagattccaagtcagttcctccggcacctcacagcgctttggtcttttttctgccactttttccaatgtgcagcctccccttgaaaatatttcgtgtttctaattaattatataaaagacggcagcataatgaaataaaaaacgacggcttctaaagaaaccgtcgcaaaccgtctgcttattgagcattgcgatttcgaccgcccatgcttctcatgacgaggctgacgatgaagatcaaaatgatcgccccgatcaaggccggtatgatattaaacccgccgaccaccggaccccagcgccccaaaatcatcgagccgagccatgaaccgataaatcccgcaataatatttccaatgattcctccgggtacatcacgtctgataatgaggccggccagccagcccaaaattccgccaatgatcaatgaccaaataaaaccaaacattgaacagtacctccttgttttttagacattttaagccttatacctatcttttggaattcgtgaataaatatacaaattttttctaaatgaaaccatttgggcgaacaaacgtatgaaatacggacaccatgaaccgtcataagactcttaaatcaagtgaggagagtaagatgaaacagtcattaaaggcattaaaaggctttcgggcattcgccgaagaaaaaatgaaagagtggaacgttcctggagccgcggttgcagtcattaaggaagacgagatcatcatggcggaagggtttggattcagggataaagaacggaaattaaaggtcaacccggaaacggtatttgcgatcggttccgcctccaaggcatttacaacggcggcgatggcggtattggctgatgaagggaaaatggagtgggataagccggtaagggaatatctccctgagtttaagatgcacgatccggtagcaactgaacggatgactccccgtgatcttgcgtgccatcgttctggtctcccaagacacgaaatgatgtggtacaattcctccttttcaagggaggagcttttcagacggatccgctaccttgagccgaatcaggattttcgatcaaagtggcagtatcagaacctgatgtatatgacggctggttatcttgctggaagaatagcggggacgacatgggaggatcttgttcatgagcggcttttcaaacctttgcatatgacatccagcagcttttcggtcgaagatatgcaaaagctttccgattttgcctttccatatcaagagaacaacggaacggttgaaaaaataccttttcgtaatatcgatgcgatcgggccggctgggtcgattaattccaatgccgtggatatggcaaattggctgcttcttcagcttggcagcgagaaattcaacggggttttatcagatggaagccttcatgaactgcatacgccttgcatttcctgcgactccattattaaagcgaaggagcttccggtctgcagctatggactcggctggtttgtggaaccgtaccgcggtcgccatatgattcatcatggcggaaatatcgacggcttttcatcgcttgtcgctttcatgccttatgaaaagatcggcattgtcattttgacaaatatgaacggcagctttcttccaaatgttctggcgtacaacatttttgaccgcttgcttggattggaagagatcgattggagcggccggctgaaaggcgaagcggaaaaaataatgaaagccgctttaggagtggatcgaaccgcggatcttaccaaaattgaaggaacgaatccttctcatgccctgaaggactacacaggtgtatatgagcatcccggctacggcgaaatcaaaatagagcttaaagacggcgtgttacaggcgctcttcaattcgtttgtgatgcctttgaagcattatcattacaatatattcgagatgaaaatgccgctcacggagatggcgatgctcgcatcattcgacaccgatatacacggacatatcagccgcctttccataccgtttgaaatggcggaaggcgctagagaaatcgaatttgtcaggaagccggatcagcaattgtacgaccctgaatttcttgcttctttaacagggaagtatgcattgggagacggaacagatgtcgttgtgtctctcagaaacaaccggacgctctgggtttcattgcccggtcagcctgattacgaacttgaaccttaccgtgagttgacatttcaaataaaaaatctgccgggattcagcgtccgatttgaagccggcgattccggacaggtaacaggtttgcgcttcatccagccgaatggagaatttcctgctgtccggaaatagcagcaaaggacatatttcgatttatttcccgagaaatatacaggtgtgagccagtctggtcacttctggacggcttccagtaataaatccgccagatgaacggctctcactcggtctgtaagtcctgctcgttcaatgccgagcttcatttgcagcagacatccgggattagccgtaacgatcgtagcggcccgggtcgctgctgctgcttccattttagtatcgagaattttcatcgacatttcggattcgacaatgttataaatgccggctgatccacagcagctttcggcatttttcatttccttgaattcaatgcccttgatgctgcgaataaggcgtctcggctcagcggacgttttcatgacatttcgcaaatggcacgaatcttggtatgtgacgatttgctccggcagttcaagggattgctgatcgaagttcagttccaacaagacggaagaaaagtctttcaattttcctgtgaaagatgctgcccgttcccgccattcggagtcatctttcaggagatgatcatattcctttaaaaaagctccgcatccgcctgcatttgttatgataaagtccgcgtttgaatcctcgaatgcctgaatatttcgttttgcgagcaggatggcctcagacttttcgctgctgtgtccgtggagggcgccgcagcaggtctgctgttcgggaattatgatctcgcagccagccagccgcagcagctcaatggttgccatattcgtatccaaaaacagcgtatccatgagacagcctgagaaaaaggcggcccgtttttttctctccccgatcgcagggagcaggtgcggccgttttttcagctgtttcatattaggaaccttcggcaaaaccgcctccatcttcgcgaggtggtccggcaaaagccggagcaagccggatttgcgaatcacgttttgcatgccggaacgctgatacaagccgagcattccggtcagcgccctgattctgtttggatgggggaaaagccctttgaatactgcgcggcgaagcactttaaccggaaaggcgtgctttttgttctgctgaataatatctctcgcttcttcaagcaagcgtccgtagtttacgcctgacggacaaacaggttcacacgcgcggcagccgaggcaaagctcgagtgaccgttcgacatcctcatcaggctcgatcgtcccatcgacgaccgctttcatgagcgcgatgcgtccgcgcggagaatggctttcttgaaaaccggattcgatgtaggtggggcatgacggcagacagaagccgcagcgcatgcaattcagcagctcttcctcatccattctttgtttaaactgctgttcaatgacctttctttcgtcagctgtcgtcatcttgtcaccaccactcgcttgcgggagtctttcgcaaatatcttcccgggattcatgatgttgtttggatccaatgcctgttttaccgccttcatggcggcgattcccgcattgcccagcttcagttccaaatagggggctttcatttcgccgaccccatgttctccggtaattgttcctcccagttcaaccgcttttttaaagatgtcttcaaaagcctgttcgacccgtttcatttcttcactgtttctgacatctgtcgtacaggtcggatgaaggttgccgtcgcctgcgtgcccgaatgtacaaatcgatatttggtgcttttcggcgatcgaattaatcgcttttaccatttcagcaatttcagaacgcggtaccgtagcatcctccagaatggtcgtcggctttaaccgcgctaaagccgaaagggcggtgcggcgggcctcccgaagattttccgcttcagcttctgtttgcgcagtttgaacggacacagcatttccttttttgcaaatctcttcaatcacggcgatatcacggcgaactgcatcttcggtgccgtcctgttcgatcaggagaaccgctttggcatggacgggaaggccgattttcgcgaagtcttcgatcacctgaatcgtaggttggtcgagaaattcgagtgtcgtcggaatgattttatgtgcaatgatatttgaaacagtttgtgctgcagagtcgatatcttgatagagagcgaggacggttttttttgtttcgggtgccgggatgagttttaatgttgcttcagtgatgacgccgagcgttccttcagaaccgacgaacagacgcgtcaaatcatagccggcaacatctttggccagcttgccgccggtgcggatgatgtccccgtttgcaagaacgatttccagcgccatgacataatcgcgggtcactccgtatttcaagccgcggaggccgcctgagttttcgttaatattcccgccgattgtcgagatcttcattgagctcggatcgggcggataaaataatcctttttcttcagcggcgtgaattaagtcaagtgtgatcacaccgggctggacggttatcgttaaattttcttcatcgatttctaaaatttgattcatatgcttaaacaggaggacaatccccccttcagtcgggcatgtgccggcacataggtttgtacctgaacctctcggcacaatcggaatgcggtgcgtgttgcagattttcacgattcgcgatacttcttccttgctgcgcggggcaatgaccgcgtcaggcatcgattgaaactgtggtgtcgcatcataggaatagacgagccgtccggcgttcgaatcgtcataattggcagagccgacaatctcaatcagcttggatctcacttgtgaggaaatcatgtatgatcacatcctttaccaattattatacaaaatcaaacgctttcaaaaaatcattcttttaaacttcaaatataaaaaagaacccgttttcaaaggaaacgaggttctttgcggaaagcatcaggttgcaaggctgattgcttgattaagcacttttgccccgtccatcattccataagccatttggtcaatgacggccacgggtgtatgatacggcttggcacgctctgtcatttgcccttttaaataccggacctgcggaccaatcagtatcacatcaatttcatccagatcgcttggcaaatctgcctcagcatacgcattaatttccgccttcaatgaacggttttccgcttcttcccgcattttttttaccaatatactcgtagacattccggctgaacatacaagtgcgatcttcatttttctcttcctttcccaagctcttgatataaatcaatcatttctttcgccaaatcttttacagttatggctgtcattaaatggtcctgagcatggattaataatagattgggtgaaaggcctgcgccctgtgcttctttttgcaggaggcgggtttgtgcctgatgcgcttggttcagctccgattctgcttcttgtatcttttgataaccggtttcgcattcgtgatgtttcacaagctgcaacgcttccattgcagaagaacgcgcatttccggcgtgaaggatgatttcaaatgagacctgttccaattgaagtgtatctgccataacattcactccttatttattcattttctgtctggtgcaaggcggaacgttgagccgcttttataaacgggaggtagagcagggtggccagcaccaggttgaagatttgcaaaaagacccctcggactgatcctccggtgacaagatatccgctgacaatcggaggcgtcgtccacggaaggatcgccacagttttcgggacgagaccggaagccaaagcgatatatgatgtaatcgtcaaaattaatggaatcaagataaacggaatgaacatgatcgggtttaatacaataggaaggccgaacagaacgggttcattgatgttaaaaaggccgggtgcgagagacacctttcctatcgttttgtagtgcttcgatttcacggcaattaaaatggcggcaagcagagccaatgttgttcccgatccccccataaatacgtaagaatcgaagaaaggctttgtcacaatatacggcacttcaaaagcgctcattccttgcgagaataagtgctgattttcctgaatgagcgggaggtagacggattccatgatcggcccgaggatgtttgttccatgcaatccaaagaaccagagcaaatgattcaagaaagtaaaaatcaaggctgacccaaccgtgttggaaaggccttgaagcggctcttgaatcgtgctgaaaacaagctcatggatgctttgccccgaaaagtgaacgatcagagcgttacatagcccggcagtggataagatgacggcagccggcaatagagcattcaaggattttgtgacgccgtcaggcactccttcaggcattttgattttcaatttctcatttttggaaaacagccggaagacttctgtcgacagcaaagccacgattaagccgacgaacagaccttgggctcccagccaagtcattgagaagccaaagtcttcagtggtcggtgtaagcacggcgaatgcgccaaccccgattaatgcggcagacagaccatctgtgtgatatgactcggccagcttgaagctgacagccgcaacggctaaaaggctcaacagagcaaaagagccattccatatcgctccgccgacagccgtccatccctcgccgaaaagaccggtcataaagttttgaaacgccggtattggaaaattattgaccaggatggcgagggaaccgatgatgataagaggcataatggcgatgaatccgtcgcgtattgcaatcaggtgcctttgggaaccgatccttccggcgatcggcatgatgtttgattcgatgaatgccatcattttattttgtttcatgtgcacggacctcctcaaaaaattgcgggagataacgtttatgagcctcgagcatttcatcgagcaccttttgagctttgtgatcagaagagaccaatggattggtgatcatggctaagtatgccgtatcgtagtcgccggtgaccgcagcttcaatcactaattgttcaaattttttcatcaagatgatcggcccgctgatggcatcgggcagttttccgacggtcaggggaatcggtccgctttttgtaatgacactgttgacttcgatcaccgcatcatctggaaggtctggtatgcttcctttattcagtgtgttcacggtctgaatatccattgaatgatgataaagcgagttcattaatgagcaggctgattcactatagtaagctccgccgcggctttccagttctttaggcttttcatggatcttggcgtctttgtatctctcaaacagctgccgctccacttccatgacggtttctgcgcgcgtccctttgttattgtacgcttcgatatcttttgcgagcgcatcttcatgttgataatagtactgatgataagggctcggaagcattcgcaaagaccgcaaaaattggcgattccacggcagcgccgcaatattggaaggcgagtagccgaagtgatcattcaacagaagctcaatcgtctcttctgtccggtcgatcccgtcgatccaaactctttttccgaaaacaaaatgattgatgcccgcgaattcaatcatgacgaggtttacatccacgccgaaaatttctgcgatgctatttttcatgttgtaaggaatattgcataccccgacgaccttttgatgaggtccgtgcttcagcaaagcttccgtcacgatgcccgccggattggtaaagttaatcagccatgcttcgggacaaatctcatgaatatcgcgggcgatatccagcataaagggaattgtgcgcaaagctttaaacatgccgcccgccccgtttgtttcctggccgatcaggccgtggctgagcggaattttttcgtctaaagctctcgccttcagtccgccgactctgatttgaaccgttacgaaatcggcgcctttcaatgcttttgcccgatctattgtatggctcagttcgatgggaacccccgcatgtctgatcattcgcttcgcgagttctgagacgatgcgaagcttttctttgccctcctcgatatcaaccagtacaatctcattcactggaaattgatgatgccgtttgatgatgccttcaatgatttctggtgtgtagctggaacctccgcctataacaactactttcagcgccataatccccctccttaactctcttttatgaaagcgcttcacacaattgaaacttaacatgttataacaaatttgtccatacatatttgttataacaaattgttttttgggggaactttttgtgttattctataattacgaactcaccccaaaggagaaaatgtatggcgaaacaaccacagctccacagtcaaattaaacaagatattgtagataagattgaaagcggttattatccgccgggcagcctgttgccgacggagtccgagttttgcaaaatttatgatgtcagccggacgacgctgcggaccgcgctgaatcatttgcttatggaaggggctatttaccgaaagcagggaaaagggacatttgtcgccaaaggaaaagtaaagcagatcttaagctccagcagcctccgctatgcagaacaattgaaggctcaaggctttaaaccgaaaatcaaggttgttgatttgcaaaaaataaagccgtccgaaaaactccaaacccgtctcggaatcgacgctgaacaaatggtctatcaagtaaaaagaatccgctatgcagacgatgaagaaatccagtttgaaacagcctatatcagaacggatctcgtacccgaagtaacggaagaaatggcgaatatctcactttaccagtgcatcagcaggcagggaaacaacattaaaagaacagaggagcaaatcaagattgtgatttctgatgaggagattgcacaccatttaaatattacacaaggcacgccttgcttccagatatcgacgcaaacatttttggcgtctgaagaggttgtcgagtattctatggcctattttcgcggtgaccgcgttgagttcttcattgaacgcgattatggacaaagggggaaatgaaagcgtgaaatctctaatcataaatgcagatgattttggattttcaaggggagtcaaccttggcattattgaagctttccagcacggggtcctcacatcgactaccctcatggtcaatatgcaagaagcggatcatgccgtcgaactcgcacggcaaaatccagaactcggagtcgggatccacttgacattgacggccgggcgtccgattcttggcggactgcatacgataacagatgaagaagggaattttcgcaagcttttgtattaccaaggttttttcgacattgatcttgaggaagtatatcgagagtggaaagcgcaaatagagaaggctttgtcctgcggtttaaatccgacacatatcgacagccatcatcatattcatacatacggaaatctccctgaggtgtttgtagaggttgcgaaagagtatgatctgccttgcagaaaggtcaatcatgaccatccttcactgtggaagggtgtaaggtctaacgatgcttttgagctgaaagtcgaccgattgaaggatctatcgagcttctttaatgattatcaagacgcagctgtgattgaagtgatgtgccatccggcttatgtcgataaatgtctgcttgaaaaatcgtccttccattatcctcgggcatatgaactttcactgctgacggaaccttctctcaaagccgctttacaacactgtccggatattcgcctcacgtcttacgccggtctatgaaagagatgccgcttctattccttggcttaataagatgtgaaatggggtaggaagcggcggttgtttagtcaaatacttcatatttacagtttggaaaattctgattaatataaatttgtcataacaaatttatgcattcttcatcattggaaagtcttcttttacacttaaatgtatagacgtctatacgtgtttcaccctctgcacaaccagctttttcaaacgccaaagttttgatgaaatgatgttgtcaatctcacttatgtaagcgttttcccttgttgtcttcaatgtatctgctgctattagatgacaaggaaaaatataaaaccagcaaaaaaggcggtgaggaaaaagagagttctagtttcatagcttgccaaaaaattgcttgtaaaggagatgaaaatcgtgttgatcaacaaaagcaaaaagtttttcgttttttctttcatttttgttatgatgctgagcctctcatttgtgaatggggaagttgcaaaagccgattccggaaaaaactataaaatcatcggctactatccatcatggggtgcttatggaagggattttcaagtttgggatatggacgtttcgaaagtcagccacattaattatgcctttgctgatatttgctgggagggaaggcatggaaaccctgatccgacaggccccaatcctcaaacgtggtcatgccaggatgaaaacggagtgatcgacgcgccaaatggaacaatcgtgatgggcgatccctggattgacgcacaaaagtcaaatcccggggatgtctgggatgaaccgatccgcggcaactttaaacaattgttgaagctgaaaaagagccaccctcatttgaaaacgttcatatcggtcggggggtggacttggtctaaccgcttttcagatgtcgcggcagatcctgcggcaagggagaatttcgccgcttcggccgttgagtttttaaggaaatacgggtttgacggggtcgatcttgactgggaatatccggtcagcggaggattgccggggaacagcacacgtccggaagataaaagaaactacacgctgctcctgcaagaggtgcgcaaaaaacttgacgctgcagaagcaaaagacggcaaggaatacttgctgacgatcgcatccggcgcaagtcccgattatgtaagcaacactgagctcgataaaatcgctcaaaccgtggattggattaacattatgacctatgactttaatggcggatggcaaagcataagcgcccataatgcaccgctgttctatgatccaaaagcgaaagaagcaggcgttccaaacgctgagacctacaatattgaaaacactgtgaaacgctacaaggaagccggtgtcaagggtgacaaattagtgcttggaacaccgttctacggaaggggctggagcggttgtgaaccaggggggcacggagaatatcagaaatgcggaccggctaaagaagggacatgggaaaagggcgtattcgatttttcagatcttgaaaggaactatgtgaatcaaaacggctataaaaggtattggaacgatcaagcaaaagtgccgtttttgtataatgcggaaaatggcaatttcatcacttatgatgatgaacaatcattcggccacaaaacggattttattaaagcaaacggattaagcggagcaatgttctgggatttcagcggcgattccaatcggacgcttctcaataaattggcagccgatttagattttgcaccggacggaggcaatccggagccgccttcatcggcacctgtgaatgtgcgtgtaaccggaaaaactgctacaagtgtcagcctggcgtgggatgcgccgagcagcggagcaaacattgcggaatatgtcgtgtcatttgaaaaccggtcgatatctgtaaaagaaacatcagcggaaataggcggcttgaagccgggtacggcctactcatttactgtttcagcaaaggatgcggatggaaagctccatgccggaccaacggtagaggtcacgacgaattctgaccaagcctgttcatatgacgaatggaaagagacgagcgcatacacaggcggagagcgggttgcatttaacggaaaagtgtatgaagcgaaatggtggacgaaaggcgaccggcctgatcaatccggtgaatggggcgtatggcggctgatcggaggctgcgaataagagaaagtcaaatggatagaaaacgataaagagagatttggggaacagcttctcacgtctctctttatggacaaaggagtctgagtaaacatgaagaaagccgcttcatcttttttatcttgtatgctgctcctcgcgctttttatcccgaaccggcagatttccgcagagacttcaagcgaaagaccggactgccgtccggaagggctatgggactcgggcgttgaacatgtgccgtattgcgatgtatacgacaaggacggccgtgaaaagctggccaatcagttagaccggagaatcatcggttactttacgagctggcgtacgggaaaaggaaatcaagatcgttatttagtaagcgatatcccctggaagtacttgagccacattaattatgcgtttgcccacatcggggaagatcatcggatttcagtcggagaagaggcagatgagaacaacccgtccatcgggatgacttggccggagcatcccgatgtaaaaatggatcaaaccttgccgtataaggggcattttaaccttatccatcaatataaagatagatacccggatgtgaaggttttggccgctgtcggcggttgggccgaaaccggcggctatgtcgacaaggacggaaagcgaattccaagcggcggcttttactcgatgacaacgaatggagatggatctgtaaaccacaagggtattcacacctttgcggaatcggtcgttgcgtttctcagaaaatatgagatcgatggaatcgatattgactatgagtaccctacatcgatgcaggatgcagggaatccggcagattggaacatcgccaatccgcggcgcaacgggttaaataaaagctttgaggcattgatgaaaacattaagagaaaagcttgatcaagcgtccgctgaagatggaaagtactacatgctgaccattgcagcaccatcctcggcatatttactgagggggatggaaacgtttaagccgcttcgatatgtcgattatgtcaatatcatgtcctacgatcttcatggagcctggaatgagtttgtcggaccgaacgcttctttattcgataacggcgaagatgccgaactcaagcagtccaacatttatactacgccggaatacgaagggatcggatatttaaatacggactgggcttaccattattttagaggggcagtagaatcgggacgaatcaatatcggtgtgccttattatacgagaggctggaaaaatgtgaccggcggagcaaatgggctgtggggaagagccaaaagcgcagattgccctcagggactcaggcaatgcggtgacggagcaaccggaatcgataatatttggcacgataaagatgagcaggggaatgaaattggagcaggggcaaacccgatgtggcacgccaaaaaccttgaaaagggcattgctggttcttatctggaaaggtatggattgagcaaggctgatttgacaggcgtttataaaaggcattatgacgcagggctggcagcgccttggctttggaatccagaaaagaaagtatttctatcgacagaggatgaggaatcgatcaaaacgaaggcggattatgtcattgataaaggaatcgggggtgtcatgttttgggatttgagcggtgattatgactggtatcccgaacgaaacggcagtaaaggagaatacggtatcggcaataccttaacgagaacgatgtatcataaattctcggatacaacaccatacgataatcgactcagcacatcacctttgcctgatgaatcactagatgcagaagtagagttgacgaactttccgttaggagatcaaaattacccgatccacccggtgatgaagctgatcaacaacagcgatgtcacgattacgggaggttcttttatcgaatttgatgcgccgacatccacttcccctcggtttagaagctggagcggcgatcatgttgaagtgatttctaaagggcatacgggaccgaacattggcggactgacagtagatttccaccgcatcagagtgactctatcaatctggaaaaccattaaacctggtgaggaagcggagtttcagcttgtctattatttgccgatcagcggtccttcaaatttcacgatatcaatagatggcaaaaagtacaggcttaaaggaaattaagtatacggccgttagatgtgacagcccgttccaaaaggaagcgggctgtcttcgtgtattattgtgcgctgtttttccagttggtcaaattgtcgaacacctcttttgtaatccgggtgcctctgttgtacgaggagccgccgtatactccatttgtgtgtacggcaagcgagcacggaccgctgcagttcgttctggagctgctttgttcgaataccggtgaaccgctttgtcctccgtacgtgtccattgcgtactgcaatttatacgtttcggagatggcaatcggtcctgaatgctgccattgtgtgcctgctgttttatcgcctgggtagccgctgatggtaacagttgtcccaacaagtgatgaagtagtgtacgagtatccgaagtatccgacagtattgccgatcggttcgcttagttcgattgcgccgtaatcgtaattggtgtttccgcttctccatcctgacggaataaagtagcgcgtcgatttaactgagccgtaaggatagcttgtcccgttccgtcccggcgaaacagtggctgtaccggcaaatgaaccgcttgatgtgtcatagatgcagtgtccggctgttgcgacggttttcggaccgatcatccatccggtgcatgaaccgatgctgcttgaaatatgaacgatcgctctgtacggatatgcggttgtgttggtgacccttgtccgatcatcagaaccaatcaccgatttaatgctgtaaggagctttggcgggtgactttttttccgctttttcctttgtttcattcactttgccggtgcctgtaaacgcttttgaatacaagccgtattgatcgctcttaatgtttgggtcataagtaaccgatgtttccgctttgtatgaaggatcgcttgaaacaggagtatgaggcgatggcgcggcttgggccgggtgcatacctaaagaataaatagaaataccaatgagacctgtgatcaaacctcgtttaacactctttttactaaccaaatcatatcacttccttattttgttgtaagtacaagttagatattaacaaaataattctgaattttccatatgtttaaaaaagatcatactaaaggtgtgtattaacattttgtttgatcatatattgataccgggtaatgtacatggagaaaagaaattgaggggtgtttaggttgtatagtgatttaaaaggaaaaacagcaattgtgaccggctcttcaaaaggtataggcaaggcggttgcagaacggtttggaaaagaaaagatgaatgtggttgtcaattatcacagcgatcccggaggcgcacgggaagccgtcgacaatattcaagcagcgggcggaaacgcccttgcgatagaagctgacgtgtcttccgaagaggacgtgaaaaagctgattaattcagcagttgaacactttggttcacttgatgttatggtcaataattcaggatttaacggcgcgggcgcctttccgcacgaacttgagcttgatgagtggcagaaagtgatcgacgttaatttaaccggtgcgtttctctgcgcacgcgaagccttaaaatatatggcggaccgccgcatgaaaggaagcatactcaatatatccagcgttcatcagcaaattccgagaccgaaaaatgttcactactccgcttcaaaaggcggaatgaagctgttaacagaaacgcttgccctagactatgcggacaaaggaatccgcgtcaatgcgattgcgccgggaacgattgcgaccgaaagcaatgaagacttggagggaagccgcaagtcggaacagctgaaaaagatacccatgaacgaatttggcgagcctgaacaagtggcttccgcagcggcatggcttgtgtcgcaagaagccgcctatgtaacgggcgcgactttattcgttgacggcggcatgacgctgtatccatcacagctggaatagcaaaggccgttttttcagctcccgttctgccctttattgaatggcggaatgggggcttttttaattgtgttaccttttattttatagtaaaagaaacgagtttaatatataccgtgcatcgcgctgatcaggttgctattacaactttcaataaaaggagattatgatgcaaaacaatatcgttcacattgccttcggcgagtctgccggcggcagtataaacatgatgctcaaacagtcgggaggaacccatgaaaagagtctgatcgttctgcctgaattattttccatcggaccgcttcaaaagctggaagccaaagaaggcagggtcaatcgttatgaatggttgaaaacatatctgaatgaccgatttcacgagtctggaaagagatacagccgttttgaagtggcggtttctgcattgtccggcattcctgagcaagcctctgtctttatatggacaggagatcatgcacacgaacagactggactgaggtttgtacaccatatcctccgacaaatgaacctggctgttttccatttgaatacgacgaagttcttcccccatacccggagttctggtgaattgaatgatgaaaacctgagattcatttatgaacaaggggatcaggcggctgtgacagccgctgaaggacggcgccttgcagaggaatggacagcgctgtctcagcagacaagcgtgttgcgggtatgggaagacggtagaatcaaaagcgtgaaggaggatttttttgattcgttcataatcgaaaaactggctcagcttcaaaaaaaccgttcagccaacacctttatcaactgtctcagcttgatcggcgaagtcattggccatctggaggagaacatcggagatgaatttatcgagtaccgcattttagagctgatccgcaaaggtatttttgagatgaaaggcacaacaaaaggaatgagatattttaatgtcaggttaaaaaatgtcatgtaagttcaccagttaaatccaattatctcaattttcatgaaacgattgatagtatatttcgtatacataaggagaagaaaatgaaagagaggtagacaggatttggttcgtgaacagttaaaacaaaaagcgcaatccatcagtaaggttcccccacattatcagctcatgatcgaagattacggagagaagtacgaaaaagagaggcgggtttttttcgcttggcaggacattgaagagccggagcgggacatatcggtggagttagatcatcaaggccgcttaatcagtttgacaaaagagtatgaaccggtggtggaggaagctcttcctgatgaaaggctgctgcaaatcgcccttcagtttacagaacagcattacccgaatgcgccttatgaatttgttttccatgaaaagaaggtaacagaacaattcgttcgttttacgtatgttcagactgtccttgatcttccgctgccgcagacgggcttttatgtccgggtcgccaagaacggagaggtgattgagtttcgctataacggcgggacgagctctttctccattccaaagcagatagctgataagcaatcggtaacagccgattatcttgaacatgttcaattcgaattggcggttgaaaaaatccgcagtgaactttatgaagggggagatgatctcccgcatcttatttacgaagcagacttgccgtttttcagctatcccgccgatatcacggaaaaacgccagatgaagcctgcggctgatgacgaggaagaagaagacacattgccgctccctgtgctgcctgaggctgaccgtcatgctgatatcgatgacatgatcggctttaccccttcgatgcgaaaaatccgcgaaaccgatttgggagagtcaattggaacagtgtggcgcctgggagacgaccctgagccgagagatcggagtatagccggctactttgaaacatggaaccaaaatacgttgaaaatcgtgaaagacaaaaactcggggaagctcaaaggaatcgcttcttttatcaaatcggaaggaccccctgtcttgagcggggaagactgcttgaaacgggcgctgcaatttttgtacaggctttatcccgacgctgatcggctttttcgaatgcatccggcggaaaatgacggggacaggtcaaacgcattttttcaatttgatcttcaatacaaaggggtgccgttaaggcttggctctgccaatatcagcatcaatcggacaaccggcagggtcgtcggttatcacggcccggaaatcgagccggaaacgctgatcgatctgagtccttcgccatccatttcagaggaggaagcgaaagccgtttttgcagcggcatttgatgtgaagctgcagtgggaaagggactacagtcgggaaaaggatgacttctacaggcttgtctaccggccggtatacccttactttatcgatgcccatgacggaaaggcgtttatgagcaaaaacatataataaacggcggctggctggggtggaaaagcccccggccgccgcctcttgtaagatcaaatatcgtcctcggctccagtggagatcggatggtctgggtagctgatccaatcgctccagctgccggcatacagcttcacattttcaaatccggcttcttttaagccgagtacattcgggcaggctgatacgcccgatccgcaatagacgacgatttcactgcccgggtccaaagcagcgtaatgctgtctgagctgttctttgcttttccataatccgccttcggttagattgcctttccaaaaaaagtttttagcgccgggaatatggccggcccgatgatcgagaggctcggtttccccggtgtatcttgaaggatcgcgcgcatcgatcagaatggagccttctctgccgattcgcttcagtacttctttggcatcgagcagttcgttttctctgagcgccggcttaaattcgcgctcgctaggacgaggatcctcggcgttcacctcgtagcccgctttgatccagttggacagtcccccatccatgatatagacgctgtcatgcccgagatagtgaagctgccaccaaaagcgcgctgcaaacatgccgccgctgtcatcataaacaacgacatctgtttgccggtcaatgccgatttttccaagcttcgcggccagaaggtcagggtcttgaagcgggtgtctgccgccgtgctcttccgggttgcgcgacagatcttcttttaaatcaatgaaaacggctccgggcacatggcctttcgtatacgcttttcggccttcgtccggttttgtcaaatgaaacctcacgtcgacaataactgtttggtccgttttttccattaatcgtttgtatacccattcagggctttttaatactgacaattcacgatccctccgttcccctttgttttttctcgggttctgataatagaagaatagctttctttcatgggcaatatcaaagataaatcccgaaatcgtcatcacctaaatgaaacagaatatgataaaggtgacgacatcatgggggtgactaaaaatggcagtcgttcaggcttcttctaaagatatcagtcttttggcaagacttttgagagcggaggctgaaggcgagggcgtgcaaggtatgcttatggtcggaaatgtcggaatcaatcgcatcagggcaaactgttccgactttgtgggacttcgcaccattccgcaaatgatccatcagccgcatgcctttgaagccgtgacgcacggttatttctatcaaagggcgcgggaaagcgaaaggcgtttggcacgcagggcggtcaacggggagcggctttggccggcaaagttcagtttgtggtatttcagaccggcgggggcgtgtcccgcacagtggtacaatcagccgcatgtcggccgctttaaatcgcattgtttttacgagccgacagcggaagagtgtgagaatgtctataatacgttctaacaaaaacatcccttttcaacggtttttgaaaagggatgtttttcgttcaaaataattctgccagtctttcgtaagactgcttcttatcttcaaaccggtagacgttagttaaaatcataaactcatctgtttgatatcgttcagaaagctcgagcagttttcttttgactgtttgaggagacccgatcaccatacggctgcggttttgggcaagcttctttttatcggcagctgtgtaagcggccgatttcgcctcttcaatgcttgggacaaggctgtccagccctttttcaacccggagaagccataaatcttggctcaagcagagctcctcggctttttcatcggactccgcacaaacgacgaaaacggcggccaatgattgggggcgtttaaagaaaggggaaggccgaaagctttcacggtatgattgaaaggcgttctttcctctcgcgggagagatgaaatggccgaatacgtatcccgctcccatgctaccggccaattttgcgctgttttctcccaggcctaaaagccacacctccgggggcgaatccgtcaaaggggaggctttaattccgaagtaatcatgtccggaaggcacggaatcagtcagaaagctaaccaagtcttgtaactgtctcgggaattcgtgcaggcttttatgaaccccgtctgtcagcgccagcctcgttttagttgtgcctcccggagagcggccgatccccaggtcaattctcccgggataaagggcttcaagctgccgaaagttttcagccactttaaagggactgtattggggcagcagaacgccgcccgaaccgacgcgaatattcgccgtctttgccgcaatgtgtgcgatcatgatttctggagcggtgctggcaagcccccgtgtgctgtgatgctcggcaaaccaataccttttgtacccccattgatccgcaagttccgccagctctgcagaatgctttagagctgaatgcgcatccgagccttttgatataggaacctggtcaagaatgctgagctgcatcaattgtcaccggccttcctttcgttttcttgttcagtaagacaagcatatgaaaaacagcagatagggtcaaatcgaagagaatacgagagacaaaacatgattagtcaaaacatgacaccgttgaaacaaaaacgaaatataaatgtaatataaattggcgcctattgtcgaaaatagatggtataataacgtctgtacattagaaacggatatataaatcataggtcataagattcattttttaataatgttcaatcgaatttacataatgaaaaaacaagaatacataaaggaaagaggagtagaaagtgaagaaaaaggtttatacttttggtttagcgtcgattctcggaacagctagtctatttaccccctttatgaacaacacggcatcggcagaaacatctcagcaaaaacaagaaattcagcaaaagcgttctgaagtgaattcaggcatcgagagcaagcggaaagaaatcgccaagctgcaagacgagcagaaaaagcttgaaggtaaaatccaagagcttgataaaaaagcacttgaaacaagcaacaaaatcgaagacaaagaaaaagaaaacaaaaaaacgaaaaaagaagtggaagctctgaaaaaagaaatcaaagaaaccgaaaaacggattgaagagcgttcaaaagtgattaaaaatcgcgtgcgcagcctgcaggaaaacggcggatcccaaaactatttgaatgtccttctgggcgcacaaagcttcggagattttatcactcgtgcaactgctgtttcaacaattgttgatgcggacaaagacctgcttgacgagcaggagaaagataaaaacaagcttgaaaaagcaatgtctgatttaaatacaaaactggacgaaatccaaaaaacactagccgatttaaaaacgcttaaatcggatcttgataaacagctgaaagaacaggcaaacctttctaagcagctgcaaacgaagcaagcggcagcagaatcagaactgagcgatctgaaaaaagaagcgggctctctgacaaaagaagaagccgctcttgaacaaaagcttaaagaagaaagagctgcggcggctgcagcagcaaaagcgaaagaagaatctgcgacggctgaaaagtctgattcaggatcttcatcaagctcaaattcaggttcagtcagcaaatctgacggatcgtccaacagcggttcttcaagcagcaagaaaagcagcagcccgtcaagaaactactcttccggttctgttgtaagcagcaatggaaacgcgattgaagctgccatcagcacaggttcaagcattgtcggcagatctccgtacaaatggggaggcggacgttcacaagctgatatcgacaaccgccgcttcgactgctcatcattcgtacgctgggcttatgcatcagcaggcgtagagcttggattcggtgcgacaacaagcacgcttgtcggcaagggacgagctgtcagcgcgtctgaaatgaagcgcggagacttggtcttctttgacacatacaaaacgaacggccacgtgggcatttatcttggcaatggcacattcctgaacgataacagctcacgcggggtatccgtcgattctatgagcaacccgtactggaagaaagctttcaacggagttgtaagacgggtcgttgaataaaatattatactgagacaaacgccgttcccgatcgggagcggcgtttttattttacagcggcaagtcgcgctttttaaaaatgagaatgctgagtgcgaaggcggcaaaaccgactgcggcgagaacaagagacacttgagcgatgtcggtgcttccgttcacaatatcgcccggtctgaataaagagaaaaccgacaggctcctcagccattctgttttttcgcttaatttgcctagcaagtcgaagctgaagaataagaacgtgatgcctccggaaagtccgagggctcttttttcatcatttgaaatggccgaaaagaggaacgaaatgccgccgactgcaaagaagagcagaaagccaagcaggttcagaacgaggaaccttgacacattaaaatcgtaatcaccgcccagcatcaaatggtagccggccagtccggccgctgtcgtcacggccataatgatcaaaagacctgtcgttaagacggctgcttgggtgaaagccacttttccgcgcgttgtcggcgcagacagaatataggccattgacccttgatccacccgctttgccaaaagctttgtcgacagcatgacagagaagatcgataagatcacgataaagattaatccgtaatattctccagatataaaatcttcaagattcccaagtccgttttcaaacccaaaagcattgagaaagccttccggcatcgatttgatcattttctcaatatcctccgcattgcccgcgatgcttggataaatgcccagtatcaaaaggatataaaatgcggagcctaccccgtagctcatgattcctttcatgtttgttctcagcatttgtttatacagggagaggttcattgcgctgtcccctttctgttatagtagttcataaaaatttcttccaagctttgtgatgaagcatcaatgtgccgaatgtgatatttggcggtttctttaataaattgatcatggttccctaaaacggccactttgacgcggttgtccgtccgggactcaatttgcagacttgaattcatgaaggcgggaatgtcgcccgtgttttcaaatgtgacttcaaatacttttcgctgcatcgactgcagttcatgaatatccttgacggcaatgatgatgccgtcttttataatggctgctctgtcacaggttctttcgatttccggaaagctgtgggaagacattaaaaacgtcgttcctttcgctttttcttcgaggacgatttcaataaatactttttgcatcagcggatcgaggcctgatgtcggttcatcaagaataatcacttcggggctgtgcataaaggcggcgacaatcccgaccttttgcttcattccttttgacatttttctgatcggagtatgaacatcgaactggagccgttcaataagatcattgcgcttggctgtatcttttaagccgtgcatgtctgccatgaaatcgagaaattgttttcccgtcattccttcgataaatgcaatctctccggggagatagccgatatgccgctgaatatcgccctgctgcttcaaaacatccattccgtttactttaatgtcgccttgatcaggcttcataaaccccatgatatgtcggatggtcgtcgattttccggctccgttcggccctaaaaacccaaaaacttcacctttttgaacatgaaaagaaagatcaaagatacctttgccattggaaaacttcttcgtgagccgttcaactgtaagcatgtggaacctccgtaatgaaaataatgaaattttaataattataaattacataatttattttaagttcttatgaacttttttgtcaatgaaaattaatgaaatatatttatgttataatttcattaagaaagataagtaaggatggttatatgaacggatttgaaaaaagggctttgctgattaaggagaagatcaaaaagacggctttggatatgctcaaaacatgggagccaaagcgcatccggataaccgatatcgcaaaagaggcaaacgtttcgcaggtgacgatttataattactttggaagcaaagaagcgctcctgaaagaggtttttaaagattatatcgatcagtccatcagcgagtttgaagaatatatgaacaaagatatttctgttaaagaaaaaattgaattgatgattttgcaaaaaagggcagccaataatcaaaaattcgctttaacggtcatcaaagaggtgatgatcgaagacagtgaaattatggattatgtgaagcagcaatacgatgaaaaaatcattccccttatgctccaaatgattgaagaaggtcatcggacaggcgaaatctcttccaaaatcaccgcggaaagctttctcatctttatgaatatgatcattgaacattcaaaaacattgggtaaagcctttgaaaaaaacaggaagtttacagaggaaatgctgcacattttcttctatggcttgtgcggcagaccgtagtgataaatttgacatctctgtcatttctgtgaacgcttgaaacaatttccttgcttttccgtatataaggcagatacaaaaaacgaaaggatttactaaacgatgaagcactcctttttcttttttatgttcattgccttttttctcgtcactggtttttctgaagcaggcaaatccttttcgatcgagcgggctgatatacgcgcaacagtaaaagaaaacggcgatttaagtgtagaggaagtttacagatacgattttaaaggttcttttgaaggggcgacaagatcgttcagcgaagaaaccgcgagccgcctgaagaattttaaagcctatctccttcccgaccaccggagaaaaggcggtcaagccatcccgttaaagacaaagaaggaagacgggacttattttgcttattcggcatcaaaggatgaaacgaaaaatgtgatgtttcgctatgtgatcgaagatgccgcacaaaagtttgaagatacgtcgattttgatccattcattttaccaaaaggcaaataccgatttcggccgcgtaaagattgaagtgcgcctgcctgattcggtaaaggcacgggatattcatgcgtttttgcgtgaaaaaggaaacggaaagattacgaaggtgaacgattcatcggtcacctatgagacaggactctatcgcgcaggcacgggctccgagctgaggatatattttccgcaaagcgccttgaaggaggcggtccggcacccttcttaccagacaaaggatgagctgctgaaggaggagagagacgaggcgaaacgctacgctgagcgggatgaacgaattgccggcgctgaaaggatgattttgattttttcggggattgtggggttcatggtcatcatggctgtcatgctttcgtttttgaagaagagacgccgcgccatgctttcgtttgaagaactcgagtcctttgatcccgtgcttgtcgcatttctttacaaaaaaggccgtttcacagaccgcgatctcctggccggcctgctttcgctttatcagcggggattggtcactatgcagaaggtgcaggctgaagagaggtttctcgacgatcctaaggcgcctgatgacacatatgaatttgaattctccggaagcaaggcagatttgccaaagcctgatcagctcttaatcgaaaaactttttgagcagacgggcagcgatacctatatgttcaggctggattccctcagcgggccgactgaggaggaatgcaagcacaaggagcagctgggaaaatatgaacgaaagaggatcattcttcaaaacgtggttcaaaaatggacggaaagcgtcagacaagcgcctgaattcagggaactgtttcaagaaaaccgctggctgagaatgctgtcgctttcactgctttcagtccataccgggctcctgctctttattctgtatgcagatgtggtacatcaggccggattcatggcggcttgcgtcatatttggttttgcactgtcggcaggcattgttcttgcgaagtcaaagctgtatacgattctgtttttggccggattgtttttggcgtctgtttttaccgacagcgttcataccattttgtattacggcatatgcgtcgggctgtctattttattaattgccttcattccggccgtgaaagaaagcaggtatgcctccatctgccgaagatcgattctttcctggaggaaccatctgagaaaagaagatttgttctcagggagaagcctgtcacaaaacgaaaaaacgatgatctttgcaattgtgcttgaagtggaggatgaatctgccgtgtggctcaatcaatcagcaaacaggcttgattacgcttcccctgtactgggtatggctgcagccggctgtttgcattatccgttttacagctggcagctgccggattcgcagcagcacgccggtgcatatgatgcaggcggttccggagcgggcggaggcgacggggcaggagctttttaagttgaaaggggctgtcgcaacgacagccccttcagattatttcagttccccgcattcgctgttcagcagttttggttccgcgggtgacaggttgatgtccgtacgcttttgccaagccgaacaccggcatgttatggtaaaaagcctcatagcgcccttttggaaccgaatacgtttcatgatagatgccgacagcgcctgatgcggctgttttctgataaaaacggcgccaagccgccatatgtttatcaccctttgcatatgctgtcaaatcttcgaaagaacgccaatattgaataagacaaatcgtcctgaaattgatgaatgattccattgctaaaaagccgaggtttttgttttgataaagctcctttatcatagggggcatggcggtaaaaaccggccaccatttatgaacagcatgccacttgtttactctcatcccgatcacaaatacaacgacttcatcttcaggggcggccgtaaaaggcttgttgatgatcgttttacccattggtcccttcctttccattcagccgattgattgtggcctcacaccattcaattccggccgaggtggtgcgttttccataatccaacgtgaaaagccagtactctctgtcctttgaatgggagctgcacgaaagaattgactgctcgattgctttatatgcttcaagccgttcttcaagcttttgttggtactccttcactttcaaagcggttttctcccgcgattcttccttgctgaaaaacagcttcagcaaaaactcgtttttttctgaagcgatgtcattgatcggttcttcaagccagctctgcagcgctttttgaccttcagcggtaatcatgtactcttttctgtcctgctttttgtccgagagcgccggagaagccgcggcccagcctgcttccgttaattgacgcagtgcgggataaatttgcccgtagctgattttccaaaaatgattcaaactttggtcgatcattcgtttcatttcgtaacccgttcggtagccggccgtaatcaatccaagcagcgcgtaagtcgtgtgatttctttttgtcatacaaaccgcctttctatatctatttgatatatatcttttagatacatcatatcaaaggcgctgacttcgtgcaatcgctactattgttgtcgataatttgaccgggatgaaaatgtgataaaaaaatatcgaaaaaccgcgaaacttttctctgaatctttccgtatatatagttaagcaggttaaataatgattcattggtcttgtatttgtaaagatatgaatcacgctggcgtgataattggatctttcaaactcttattctcatccagcactgtgatctttaaggttatgattcaacggaggagtgaacagtttggctatttctttagagaaaggtcagcggattgatttaacaaaaggaaaagcggggctttcgaagattttagtcggtctcggctgggatccggtagcgtccggaagcggcggtttttttggaaagctgtttgggggaggaaccccgaatattgattgtgacgcatccgtgctgatgctggaaaacggaagagtcacagagaacaagaacgtcatttatttcggaaacttgaggagcagatgcggcagcatcgaacataccggagataatctgacaggcgaaggcagcggagatgatgaacaaatcattgtagatttgcaaaaagttccttcgcatattcataagcttgtctttgtcgtgaatatatacgattgcgtgaaacgaagccagcatttcggaatgatcgaaaatgcctttatacgcatcgtcaacatgaatgatcgcagtgagatggtcaagtacaatctgcgggacgattattctgggcggacaagcctgattgcgggcgaaatttaccgtgacggcgccgagtggaaattcaccgctgtcggagaaggcacaaacgatacgagcattacggaaatcgttaaacgctacgcctgacattcatataagaaatggggagatcaacatggcaatttcattagcaaaaggacaaaaaatcgatttaacaaaaacaaatcccggattgtcgaaagttgtcgtcggccttggctgggatgtcaatcaatatgacggcggtgctgattttgacctggatgctagcgtgttcctgctcaacgcagaaggcaagtgctcttctgaaaaggactttattttctataatcagaccgagggcgcaggcggagctgtcatacatacaggcgacaatcggacaggggaaggcgaaggagacgatgagcaggtaaaaatcaatttgaatgcagtgccggccgatattcaaaagatttcttttgtgattacgattcatgaagcggaggctcgccgccaaaatttcggacaggtgtcaaatgcttacgttcgcgtgatcaatgaagactcgaacgaagagttaatccgctatgatctgggtgaagatttctcgattgaaacagcgctgatcacgggagagctgtaccgccacggaggggaatggaagttctcagcgatcggctcaggctatcaaggcgggctggcgaggatcgccaccgatttcggcctgcaggtcggctgattttgaagatccggacagcaggcgccggatggcgtccgttggtccggctgacattttcttaaggaggtagtatcgatggcgattcaattatctaaaggacaaaggatcgatttaacgaaaacgaaccccggtttgacgaaagcgctgatcggtttaggctgggatacaaacaaatataccggcggcgccgattttgacttggacgcgtcggcttttcttgtcgatcagaacgatcgatgcatcaatgatcacgacttcgttttttacaacaacctcgagcatccaagcggcgccgtgattcatacgggcgacaaccggacaggagaaggtgaaggcgatgacgagcaaatcatcgtcgatttctcaaaaatccccgctcatgttgaaaagatcggcatcacggtgacgattcacgaggcggaaagccgcagccagaactttggacaagtctcaaatgcgtttgtccggctcgtagatgaatcaacaaatgaagagctgcttcgctttgacttgggagaggatttttcaattgagacagcggttgttgtttgcgaattgtaccgtcacggaggagattggaaattcaatgccatcggcagcgggttttccggcggattggcatcgctttgccgcaactacggcctgcaagtctagttttgccggctgagtcacctttgcgtgattcagtcttgctttttcatcattaggaggtaacgaaagtggatttatttcatcatattatgtcaatttacgcctcatttttcgattgggaaatgtgggtggaagtattaacggaccctgtttcctgggggctgatcggctcgctggtcgtgctggaggggcttttatctgcggataacgccctcgttctcgccgtcatggtgaagcaccttccggaaaaacaacgcaaaaaagcgttgacatacggtttaatcggggcctacttctttagatttctattcattggactcggtatgatcctgattaaattctggtggatcaaactgctcggagccgcatatctggcatggctcgtcatcaagcacttcttcatcggtgagggcgatgatgaagcaaacgccatcaaaaaagacagctggatggtacgcgttttcggggtcttctgggcgactgtcatttcggtagagctcatggaccttgcattttcggtcgacagcatcctggcggcatttgccgtatctgaaaaggtatgggtgcttctgatcggcggcatgctcggcatcttgatgatgagaaccgttgcgaaattcttcttgacgctgattgacaaagtgcctgaacttgaaacaacggcctttgttttaatcggaatcatcgcactgaaaatggctgcgagtgtatggcatattgaaatgccgcacagcgtcttctttatcattctgattattgcttttgccgcaacatttatcattcactatatgaacaagcaaaaagctgtaaaagagcaaacggcggcttcaaaggaagaataacaaactgcaaaacataaaggggggagtagatctgctccgccctttttttacatcaaaggggtgtatgattcctattcaaagaaggtgacccatgtgcaatactttgattttttatccgcctctcaaaaagaagatgtctttttcaaactgccgggtacggttacaaaggactctccgaagcgcattctcgagtatgcgcttggagctgcgctctatgttccggggaaccgaaaagatatagcagatgtcatcatcaataacaagtatccagaactgtgctcggtcgttttttgccttgaagattcgatcggcgattgtgaggttctacaggctgaaaacaatcttgtcagtcaggccgatatgatttatcaggcgcaaaaactgcagaacatcaacagcgatgtgctgccgctgatgtttatccgagtgcgggaacctgagcagatgctcgaattgggcaacaagctcggccgcgcgcttcacttgtttgccggattcgtatttccgaagttttcgatgttgaatgcagagcactaccttgatactttaacgaagctgtcgcaagaatccggcattgtgctatacggaatgccgatctttgagacacctgatctgctggcgatggaaacgagggcaaaggcgctgcaggaattaaaatcaacgcttggcttttatcaggatatcattctgaatatcagaatcggggcgactgatttgtgcggtctctacggcttaagaagaaaaccggaaacgccgatttacgacattttggtcatctctgatttcatcaaagatatcgtcaattatttcggcttgcaattcgtgatttcggggcctgtctgggagtactttggagatgcttcgcgaacggttccgccttttgcgccgaattgggctgaggcgggggaatcttcgcttgtgatcaatcggtatatggacggattgatcaatgaaacgcttcttgacctggccaacggcattcacggaaaaagcgtgattcatccgtcacaaataaaagcggtccaaagcctgcatgttatatcaatggaggattatctggatgccttaagcatcgtcgaaagtgccgacggcacccgcggcgttgtaaaaagttctttctcaaataaaatgatcgaaatcaagccgtaccttagctgggccaaaaaaatattattaaaggctgaaatctacggggtatatcatgaaaaccgcagctatacggatatacttagagcgtccaaaccgttttcaaaccttggatcgttcgggagttagtctgggacgggtgattggaaatgggcaaaacgtttaaaagatcagtgcttctactgtaaaagagccgcactaccaccatgatctcaaaggcagacattgtgaatttctcaggagaaaacaaatgaaattttaggatgaacagccatgatgaaaatagtcgatctcacgagcagcgagattctcagttcccagcaggcatgtgaagagtgggggattgattcgtctacgctccgaaagagagcgcatgattttcctgcgggaacaatcagaaagttcgggacaacctatgccgtgacaagagcgggcatgtgtgccgtatttggacgtaagagcgacactgactcagaagaaaggggagacggctgagcgctatgaatcaagagattaatattcaaaacgccctggtcaatgatgatgaatggaagcagatcatcaagaagccgctcccggagagaaccccgtatgaaaaaaacagtcatttgacgataagccgtctggcgggacggattcttggaactccgcacgatgaaacggattactacatatatctccatgagctgtatgcgtccggtgatgtgcatgtgttaagcgagacgcttgataagaccatttctccggaaaggtttcaggccatacagcggatccatatggtgaaccagaaagaaaaaggactttccgtcaatcggtttgccgcttttcttgacggggagcagctgattcctaagcaccctgatcccgctatgcaccggcatttaaggaaggcgcttatcgaagtgctgcagctgtttcagtcctttcatgaaaaaggattgaacgatccggattttcgccgggtcctccttgaccttgtcaaatggatgggcaaccatttggagaagtggctgaaaggggccgactgcgaaacggcgatgccgaaagtggtttggtacggggacaccaccaaaagccaacggtattttttatactatttgatgcttgtcggatgcgatgtgctgctgtttcatccggagggaaaagacgaatttcgccagcttgatcccgagcaaaagctttcttttgtcttcacatacccggacacgtctgcattagagccgttcccgactgaaaagccccagcgcaaagcaacggtggcgtaccgttccgcgaaggagctggatactgtcctgcacaatgaggattcgctaatgtacaaaccttggcagttcagggagcatactccggcctctgtgactttgaagacaacatatgatgaactgtttttaattgcgaaggaacgagcctttatcagacctaattttcaggcgtctaaatcaacggttaacattccgaatttattcgcgatggtcatgggcgtctccagcaatgaaaaagagtactgggaccgtctgcagacactgacggagtataaggagtcgcatacgatccggcgcttcccgtttacaaaggaagagacgtcgaattatcaattccattacagcgatgcgcttgatcaaacggggatgatcgatccaggccgtttaatggagagcaatatatggcgctacaagcatctgcctgagggagtacagcgaggcattgcccaagcggtttccaggatgtgcaaaagcccgaagatgctggctttgaacaatgaaaagacagccgatgtacagctgtatttgtttacccaagcggtacagcttccggcagcgctattgaatatgattcagacatttgactattcacagaccgtgccgaagctgatcttgtatcacacggaacagacggggacactcacccggtcggacgcggccgccttgcttttgttaaatgaaatcggcattgacattatcatctataatccgccgggccataagtgtattgaccactatatcgacaggcagcactttgatacccattggcttgatgaaatgtccttcaaccaggagtttaaagagccgtcaatcgtccggaagttcatcaataaaatcttttaaggagggggccattctgatggcaaatccaaatgaaacaagcatcgtcaatattagcaaagaggaagagatcacggttgaaaaagcggaggacatccgtgcgaaactccgccaggagccggatgtgcaagctctggcccgacaaattgacgtgaaaaaccaagtggagcttttagaattcggtaaggagcccgctcttgaaatatccaagttctctgaccgcattctttccatgatgagaacgaacagtgtgacagattcaggcgcgatgttgacgcagctcggaaaaatcatggaccgctttgacaagaatgactttgaagaacaaaaaggcttgctctctaaattatttaagcgcggcaacagcatgatcgagaaaatatttaaaaaatatcaaacgctcggcggtgaaatcgaaaaaatcaatgtcgaaatttcaaaatataaagatgaaatgacaaaatcgaccgtgacgcttgatgaaatgtatgaaagcaaccttaaatactatgtggagctggaaaaatacgtcgtagccggccagatgaaaatagaagaattgcagcggctcatccccgaatatgaagcgaaagcggccagcggaaaccagatggcgcagatggagcttgatacgcttcgaaacggcattcaagcgctggaagaacgggtgtatgatctcgatatggcgcggatggtcgcaattcaaacggcgccgcaaatccgcctgctccagcgcggcaacacaaagctgatcggaaaaatcaactcggcattcatcattacgattccgattttcaaaaacggcatcatccaggccgttaccgccaagcgccaaaaacttgtcgccgattcaatgagcgaactcgaccgccgcaccaacgaaatgctgaagcgcaacgcggaaaatatttcaagccagtccgtcgaaatcgccagaatgtccggaagaccgagcatcgatattgaaacgatcgaacaatcttggaatacgattgtcaaaggcatgcaggagacgaagcagattgaagatgagaacaaacgcctgcgcgaagaaggggcaaaacgcatattggaacttcaggacaatatgaaaaaagccgctttaaacggttaaaaaggataaagaagaagccgcccccagatcagctggcggcggcttcaaatatacaaaaaatcaccgccatgataggcggttttttatgttatgctagagaaagagaatcgcatggtaaaaaatatataaacatgaaagatgtggaagtatatggccgctttatggctggcattcggcggcggtttcctgtcgtttatttctccttgctgcctgcctttgtatccatcatttatttcctacatcaccgggatttcggtcggcgatttgaaaaaccggcatgcaaagcatatcaaacaatcggtgatgattcacgcagcggcttttttggccggtttttctgtgattttttacatattgggtttctctgccagctcggttggtctgctgtttttgcaataccataacttaatccgcatgctgggcgggatatttttcgtcgtcatgggactgttcttactcggcgttttccggccggcttttatgatgaaggagcggcgcttttcgattagaaagggaaaaataggcctgctgaattcaatgctggtcggaatgatttttgcggcgggctggacgccgtgcatcgggcctatattcggaacgatcgcatacgcaaattttcagaaccctgattttgggagcgcattcatgatgatcaccgcatattctttaggctttgccattccttttttgctcatggcgttttttatcggaaacatcaggccgcttatgaaatattcgaatatgctcatgaagatcggaggcgcgctgatgatcgtcatcggcatcctgctttatacggacaacatgatatggattaacatctggtattcgaatttgacgaatctcttttgaaaaacttccgcatgctgcattatgtgagtaagattgtgaaaaacagcaaaatcgcgttaaataaactatggatgatcatcgcaggtataatcgatcgtgttttttcgtatgtccaggcaaacacgagccctgttccaaagttaacggccagggtgttgtatgtggggatatgagcgatcataaagagggcgctgcttgcaacaagtgcccatacaaccccgaattcagcgcggaaccagcggtaaagaaaaccgcggtaaaacaattcttcgtagatgggagaaacgatgcaggcagaagcgaaagacattgcaatgctcaaccatgaaggatcggcagtgatcgtttttgtttttgtattttcgtagcctgcgccgaaccaaatcaggatttccataacggcaaacgtcatcacgattaaaaaaaccgtccatcccgctatttgaatcaagtatgcaggggcgaaccgggagattccgatttcccgccaagacagacggtccggctttaaggcgatatagtacaagcttagaataaaaacggccgccattgcgatactcatcaacatggctgaaagcatgccttcgcctaaaagcagatccaaagcattctttaataaatattcaatgaaaatcggcacggctgcaaatgcgatcaaaaacaagcagaccagctgctttttgttccaaggatttttccattccatcacaaaaccctcctgtttttaagataaaatcattttaaatggtgacgtaacgtaatcttcaagcaatattttaggagggagatatggtgaaagaggaactgacaaccgggcgggtggcgaagatgatggggatatccgtaaggacgctccgctactacgatcaaatcggtttattaaaaccgggctctacactgccgaatgggcgaaggcaatattcgaaggaagatttgttagagctcgaaaaaattatgatcttgaaatctgctcaattttcattggagcatatcaagacgttaatgaatcaattggatacaattagtatcatcgaaatgcataaaaggcgccttaattcggagatcgaacagctgacgaagagcctggagcatacaaatactttgctgaacatgtatcaaatcgaaggaagcttgagctgggaagaccttctcaagctcgtcagacagccccggcataaaccatggaaggaatcattctctgaagaggaggctgagattttagcagaaaggcttccgaaggcggagagtgacgatttcatcacaaagcaatggctctctatcatcaagcggattaagctgtgtttaaaacaagaggtgccgcctgaatctgaatggggaaagcaaattgcggaggatatcatatgcctgtctgatcattcgtttaagggacatgaggatttagccgatcgattctgggaggttcgcaagtctgaggagccaaacgggctttatccgcttgacagcgggattatggaatttgcggagagagcgattgaatctgcatttcatgattcaggaggatcagggtgatgatgagcatccaattgtcatgatcgggccggataaccaaaagatcaaacaggatatgccgcatagaaaaccgcccgaaaagaatcgagcggctaccccttaaattcggattgatttctcctcggctttccactgttttttccatccggcctgagcaaacaaaagcagaccgagcgctaaaaatgcaataacggtaaaggttaggaacccgcttgaatacgtacctgtaatttgcttcagcgttccgaggatattcggaaggaagaatccgccgattccccccgcagcgccgacgatccccgtcaccatcccgatctcttgttgaaatcgctgcggtacaaactggaatatcgcgccgttccccattccgaggcagcccatgccgataaataatgcggctgtgacaacgcctagagacgggagcatactgaccgagaacatgcacagagccactccgataaagaggaattgaagcaaacgcacgccgccgattttatcggcaatcaatccgccgacagggcggaggcagcttccggatgcaacgacaagcgtgacaaattcgccggctcttaccgccggaacggcatactgggatgcaaaaaagtagcttaaaaagttggacaggccgacaaaacccccgaatgtcacgctgtagagaaggcaaaaataccaagtgtccctttctttgaaaacggcaaaatagtctttgagcggtttaggagccggctgattcggaggttctttagccataaggaaatagctgaataacacgagggttaaaggaatcagcgccagtcccatgacgccgttccagcccacttgctccgcaaggcgagggccgaatagcgtagcaagcagtgttccgctgtttcccgccccggcgatccccatggcaagaccttgcaagtgcggcggataccagcggctcgccataggaagggaagcggaaaagcttgcgcctgccacaccgagtaaaattccgatgatatacagctcggcgaccgatgaaccgaactgccatccccataacaacggaatcatcgtcaccagcattccgccaacagccgtctttttcggtccgaaacggtcggttaaaatgccgagcgcaatccggaaaaacgatccggccaaagtaggtatggcgacaatcaatccgacctgtgaaggcgataaatcaaaatcagccgtaacataaacaccaagcgcccccagcaacacccaaatcataaagctgacatcgaaatataaaaaagatgacaacaaggaaggcgcgtgtccgctcttcctcaaatccgccaatttcaattgcaacactccccatccgatagattctagaatttatcatgacaaaatcgaatagggttggcagtatttttgtaagctttactaacaaactaaaagattgaatatttaaaatgttagtttggacagcactatagcaggcgataattgaatcatgctgaagaatagtggtgttatgagcgctgaaaatgggaaaccttatattgatataggcccgatgcacttgcagataaaaccgtcttttgcaacgcgtttatcaatttttctttagacataaggcatatttttaccagaaaatgtacaaatttaaggaagaaatacgtggagacacaaaatagacataaataaaattgaaaaagtatgtgaagtattgcacaatatgaatgtgaagaatttcacaaacagcttagtttaaaacaaacggcaaaggaatgatgagtcatgagaaaccaaaaagtcaatcgtacagttttgatcggtgcgggttttgttggaagcagctatgcatttacgttaattaaccaaggtatcacagacgaacttgtgatcattgatttaaataaagacaaagcaatgggcgatgttatggatctcaaccacggtaaagcatttgctccgcatcctgtgaaaacatggtacggcacatatgatgactgcaaagaagctgatattgtctgcgtatgcgccggagcgaaccaaaagccgggtgaaacccgccttgatctagtcgaaaagaacttgaaaatttttaaaggaatcatcggagaagtcatggccagcggttttgacggcatcttcctcgtcgctacaaaccctgtcgacatcttgacttatgcgacttggaaattcagcggccttccaaaagaacgcgtcatcggaagcggcacaacgcttgacactgcccgtttccgctacttgctcagcgagtatttcggtgtcgctgcccacaatgcgcacggctatatcattggtgaacacggagatacggagctgcctgtctggagccatgcgaatatcggcggagttcccgtcagcgacttgctgaaaagaaatgagaaatacaaagcggaagatctagatgaactgtttgacaatgtaaaaaacgccgcttaccacattattgagaaaaaaggcgcgacatactacggagttgccatgagcctcgcacgtattacgaaagcgatttatcgaaatgaagaagcaattttgaccgtgagcgctcatcttgatggtgaatttggagaaaatgatgtttatatcggagttccggcggttgtcggccgatgcggagcgagggaaattgttgagctcgatctgaacgaaaaggaaaaacaacaattcaagcatagcgcaggtgtgttaaaagcaattttaaaaccgcattttgaactgcaggcgtaactgaacaccatgaagatactaacatcatgaagattgcgagatgatgaaaatgtggcagcagatatacgatccgtttggaaatctgtttatcagcgcttttgccgccatactgccgattcttttctttcttcttgcactgaccgtgttgaagatgaaaggaatcattgcgtcatttttgacgctggcggtcagctttattgtagcggtgttcttctttcacatgccggctgcgaaagctgtctccgccgttttacttggaattgctaacggcctttggccgatcggatatattgtcctgatggctgtatggctttacaaaatttctgtcaaaaccggaaagtttaaagtgatcagagcgagcattgccggaatttcgtccgaccagcggcttcagctattgctgatcgggttcagttttaacgcctttttggaaggtgcggcaggcttcggtgtgccgattgcgatcagcgccgttcttcttgtcgagcttggttttaaacctttgaaagcggcatccctatgtttaatagcgaatgcggcatccggagcctttggagccatcggaattccggttatcacaggagcgcagatgggaggcttaacaccggttgagctttccagaacgctcgctttgatgctgccggtcatcgctttctttgtcccgttcctgctcgttttcatattggacgggtttaaaggaataagggaaacgctgccggctcttctcgtattaagcggaagctatacggcggtgcagactttaacaatgattagtttggggccggagcttgccgacattttggccgctttaatcagcatgggagcgctggcgctgtttttgaaaaagtggcagccgcgccacatatacagggaaaccgggaatgaacatgtgcccgctgaaaaatatcgtgcagcagacattatgaacgcttggtcaccgttttatattttgaccgccgtcattgcggtgtggagcctgcccggttttaaggggctttttcaggaaggcggattcctgaagcaaacgacaattttattcaacatgccttttcttcaccgggaagtgctgaaaacgccgccgatatctccggaacaggcaccgcttgatgctgtgatgaagcttgacttcatttcagcgacgggtacggcgatcctgatcgcggtgatcatcacgattgtgatgagccgaaacatcagtttccgcggaggactttccagtctgaaagagacggtcaaggaactgtggcttcccgttctcaccatttgctttgtgatgggttttgcaaacttggccaattatgccggattgagttcaaccatcggactggcgctcgccaaagcgggggatatctttccgttcgtcagtcccgtattgggctggatcggtgtctttatcacaggttcagtcgtcagcaacaacgcattattcggccacctgcaagcagtcaccggagcgcaaatcgggacaagttcggctttgctgcttgccgcaaataccgcgggaggcgtgatggccaagctgatctcaccgcagtcgattgcgattgcaacagccgcggttaaagagacagggcaggaatcaaagcttttcagccaaaccgttaaatacagcctggttctgcttttcatcatttgcatttggacgtttgcgctatcaaagcttggcatataaagaagagccttttcccattgcgggaaaaggctttttaagctgcttgttctatcatgtcctctttttgaatacattgtacaagttatccgcggaagggggacgcgatatgttgaacatcttcctgagctatgtgtttttgggtttgtcattggccgcaccagtcggacctgtgaatgccgcgcagatcgacagaggcatgaaaggcggattctttcatgcctggctgtttggccttggcgctgtaacggcggatgtcctatatatggctttaatctactttggagttgcgcaatttttgacagcgccattcttaaaaacgtttttatggctgtttggtttttttgttttgacctatacggggatcgagagcctggtcaaggcgaaggaagtatcgctgatgagaggtgcgggagagaaagggtcataccgcaaatcttttttgtcggggctggtaatctccctttcaaacccgctgagcatcatgttctggctcggcatttacggaagcattttggcgaaaacggtagaggcgtacgaatcataccagctgctgatctgcagttcaggcattttaatcggactttttctgtgggacttggccatgtcttttctagccgggacattcagaacatttttaagcccgcggatgatccagggaacgacttggctcgcgggcatcagtctgatcgtatttggatgctacttcggctatcagggaattctcgaactgctgcaggcggggcgctgatcatgtctgcccgtttttctcttcctgatccgcccacttttttttcatgagcatcgtcacagcagcaataacggcaagaaagagaaggctcacaaaaaaaccgggtctgctgtttttttcaaataacgtacccgaaacggcgaacaaaatcaggacgagcgctgtgacaatctggacattccctttcattttcggttttgtgagctttttgctggaaagcaggataaacatccagttatagagcagcatcaagctggcggccgtcgtcatgtgttcataaagctgcttcggcaaaatgagcgacaagacgatggaagcagcgagaacgagcactgtcaggccgagtgccggccacgatactttcgccttttcttttttggcaaagcaggccggtgcatccccgtttttcgccattgttcccatcagtgtggtgacggcgaacagggaagcggtcagcgttgaaaaaccggcaataataaaaatgccgttgaaaatatccatgatcaaatcgagatgaaagtcttttaatgacgtaataaacgggctgttctgttcggtgaatgttccgcgtggtacaaggagcatggccagcccgatcgatacgacgtagaccacagcaagggttatgagcatcaggctgcctgactttgatgaatccttcgggtcttttaagtgaatcgccatcagacccatgacttcgattcctccataagcgtaaaatgtataaatcaaccccgtccacaatcccataaagccgaaaggaaacaattcgtgaacccggtcagggaactgcacttcaggcgtttttccaggcagcagcccgcacaatgccaagacagcgatgatgataaacattaaaatggccgccgttttcaacacggccaatatgttttccgttttttcaaagctgctgcgccctgtgaaaatgacgatcaatccgagaatcgcataaatagaggcgaacacccacagcggaatctcgttaaaccaatggcgcgtaaacagggaaatcgctgtcaactggctcccgatgatcagcatttccgatgaccagtagacccagccattgctaaaccccgcccaattgccgaaggcctctctggcgtaagaacaaaaagacccttcaacaggatgatctgccgttaatttcgccagctgctgaaaaacaagaaaagtgccaagggcagcaagaagaaaggcggctaatacggaaaagccgcttttcttaatcgcgatgcttgagccgaggaaaaaccccgttccaattgtgcagccgaccccgatcatggacagctgccaccattttaaatctccttttttcgcttgtcgtttcatcgtttcaacccctctaatcttcttgttattttgccagggggctccgtttttattcgcaaagggggaggttctttgcgcacctcaatattcactttgaaatgagacatatgctatagttaaagacataatcattacggttcattcagtcaaaaggaggagtgacggatgactttacaagaaaaaatcatgcaggaactgaatgtaaagccttctatcgaaccgaaacaggaaattgaaaaaagggtcggttttttaaaaagctatttgaaaaaaacgggtgccaaaggctttgttttaggcatcagcggaggacaggactccacattggcgggcaggctggcccagctggctgttgaagaattgagggaagaaggcattcaggcggaatttattgcggtccgcttgccttacggtgttcagcaggatgaagatgacgcccagctggcgctgaaatttatccagccggacaagtcttttgcttttgacattgcttcaactgtaggttcatttgctgctcaatatcagtcagtcacgggagaggcgcttgccgattttcacaaaggcaatgtaaaagcgagagtccggatgatcacccaatatgcgatcggaggtcaaaatcagctgctggtaattgggacagatcatgctgcagaagctgttaccggattttttacgaaatacggagacgggggcgcagaccttttgccgcttacaggactgacaaagcgccagggcagaagcctgctggaagagctgggagcgccggagcggctttatacgaagtccccgaccgccgatttgcttgatgaaaaacctcagcaatccgatgaaacagagctcggcctgacatatgataacatcgacgactaccttgaaggaaaagccgtctccagcgaggtggcagaggccatcgaaaaacgctacaaggcatccgagcacaaacgccaagtccctgcttcaatgtttgacgactggtggaaataagctaaaaagaggctgaagtcagcctctttttttattaacaggcaccctatatcattacagatggaattgtcatatacttaagatatttgattcctttatgcagggaggagtagaagctggaaatgaatgccgcaataagagataagaatattgtgctgatcgggtttatgggcgtcggaaaaacaaccatcggccagcttgtgtcaaagaaattaggccgtgactttatcgatatcgaccacgagatcgaaaaagactttcaaatgaccattccggagatgtttcagcaaaaaggggaagcgtttttcagacagacggaaaaagaatatatttttcagatgtgcgaacatacaatgggcaacatcgtatccttagggggcggcgcttttcagcaggaggaaatcagaaagaagtgcctcgaacactgctttgtcatctttcttgatttaagatgggagaattggaagcagcggatggatctcttgattgaaaacaggccggttcttcataaccgcacaattgaagaaatgaaacagctgttcaatgaaagaaagagcatttatgcatttcaccatttaaaagtggaaaccgataaccggtctgccgaagaaacggccgactatattgtggagatgctaaagcttggtcaatcttaaacaaacgtttaattaagctaaatataccggaataagcaaagagccaatggtctgtctgatcattggctctttccgttatccgcagatgaatgccggatttttcggccttgtttgaccgtttgtccgtttgatacagtataggggatcaggatgggcatcacgttacaccccgccaccaatttttccctggataaggtttttccgcccctaaggctttaaaaaagtcgcttattgccggcccggacactataatgtaaataatagaaacgatagactggcggtgtacttatcatgaaacagcgaattgaagaagaactgaaaaacattgaagcaacatatggcgtcaaaatcctctatgccgttgaatctggcagcagggcatggggccttccttcacaggacagcgattacgacgtcagatttatttatgtccatcaaaaagactggtatctgtcaattgatgcaaagcgcgatgtgattgaactgccgattgacgattctctcgatatcagcggctgggagctgacaaaagcgttaaggctgttccggaaatcaaatcctccgcttctcgaatggctctcttcgggaaccgtttattatgaagcctattcgctggcagaaaaaatgaggcggctcaaaagccgcgccttttctccagtctcctgtatgtaccattatctcaatatggcgtcgggaaatttccgagactacctgacgcgtgaagaagtgaaaatcaaaaaatatttttatgtactccgcccgattctggcttgccagtggatcgaaagccgccggacggttcctccgattgaatttcaggttttgcttgacgaacttacggaagacggaccgctgaaaacagaaatccatcagctgcttgaaaggaaaaagaaaggggaggagttcaatcttgaacctcaaaaccccattctccacgaatttattgagcgtgaacttgagcggcttcagacagttgccaaagcatataaaacggatcatgaagatctgacgcaggagcttgaccgtctgtttagagaaacgctagacgaggtgtgggcataaaatgatattccctttaagtattcttaaagggttttttctttgtatccatagggaaatggtttagtataacagaaagcgttttcagaaaaagcggggcggaacggcagcaaggccattcgccaaaaacgcattctgttctttaccgaagtttcttcctgattctattgttgtataccatccaagttttaggaagaaagtttctgaaaaaatcccaccagatgtaaaacattgtggaaaaaccacaaaaatcgtcagcttttttgttttttcgaaatattgtgaatcgacccttggctcttataaaattaagaatataaagaaatatttcatgagatggcggggtgtgataatggaagtgataacaagagactttttcctattcttatctaaaagcagcatcctgaatcgcctggcgagaaattgggggagttccgtcgcgaccggaaaaattatcggaggaaaagattttgaagcttcaattccgattattaaggggcttaacgaacaagggctgactgtgacagtcgatcacttgggcgaatttgtgaacagcagggaagtcgcaagggagcgcacgcaggaatgcattcgggccattcagctgattgctcaggaacagcttaattcacatgtttcattaaagatgacgtcattgggactcgatattgaccttgaccttgtcagggataatatgaacagtattctggaatgtgccgagcagcaccaagtgatggtcacaatcgatatggaggatgaagtgcgctgccaaaagacgcttgacctctttaaggagttcaggcagaaatacgagtatgtcagcaccgtcctgcaggcttatttgtaccggaccgaacaggatttggaggagctcaattcattaaatccgtttttccgtcttgtgaagggagcttataaagaatcgccgaaagtggctttccctgacaaaaaggatgtggatgagaattacaaaaagctcattaaaaagcagctgctgagcggccattacacagctatcgcaactcatgacgacaagatgattgatttcgccaaagaaattgcgaatgagcatcaaatcggcaaagaccgcttcgaatttcaaatgctgtacgggatgcgcagcaaaactcagctggaactggtgaaggaaggctacaatatgcgcgtgtatcttccttacggagacgactggtacggatactttatgagacggcttgctgagcggcctgccaacatcgcttttgcgtttaaaggcatgacgaagaaataaaacgataaaaaggggagattagcatgacaacaccttacaaacacgaaccatttacaaatttcgggatcgaagaaaaccggaaggcattcgaaaaagctctggaaacggtaaataacgaatggctgggtcagtcctatcctcttgttatcgatggagaaaggtatgaaacggaaaacaagatcgtatcgatcaaccctgcaaacaaagaagaagttgtaggcacggtatccaaggctactcaggatcatgcggaaaaggccattcaggcggctgcgaaagcgtttgaaacttggagatacacagatcctgaagaaagagcggctgttttattccgcgcggttgccaaagtgcgccgcaaaaagcatgagttctctgcgcttttagtcaaagaagcaggaaaaccttggaatgaagcggatgcggatacggcagaagcgatcgattttatggaatactatgcgcggcaaatgattgagcttgcgaaaggaaagccggttaacagccgtgaaggcgaacgaaatcaatatgtgtacacaccgactggtgttacggttgttattccgccttggaacttcctgttcgcgatcatggccggaacgacagttgcgccgatcgtgacaggaaacacagttgtactgaagcctgcaagcgcagcgcctgtcattgccgcaaagtttgttgaagtgcttgaagaaagcggacttccaaaaggagtagtcaacttcgtccctggaagcggagctgaagtcggggattatttggtggaccatccgaaaacaagcatcattacgtttaccggttcaagggaagtcggaacgcgcatttttgagcgtgcagcgaaggttcagcctggtcagacccacttaaaacaagtgatcgctgagatgggcggaaaagatacggtcgtcgttgatgaagactgtgatattgaattggctgcacaatcaattttcacatctgccttcggctttgcaggccaaaaatgttcagcaggttcacgggctgtcgtgcatgaaaaggtatatgacgaagtattgaagcgcgtgattgaaattacggagtccaagaaagtcggagagcccgacagcgcggacgtttacatgggacctgtcatcgatcaggcatcctttaacaaaatcatggactatatcgaaatcggaaaagaagaaggccgcttagtcagcggaggaaaaggcgatgattcaaaaggctacttcatcgaaccgacgatctttgccgatttagatccgaaagcccggttaatgcaggaagaaattttcggacctgttgttgctttctcaaaagtaagcagctttgatgaggcgctggaagttgccaacaacaccgaatacggcctgacaggcgcggtcattactaaaaaccgcgatcatatcaacagggcaaaacaagaattccatgtcggaaatctgtatttcaaccgcaactgtacaggggcgatcgtcggctaccatccgtttggcggtttcaaaatgtcgggaaccgactctaaagcgggcggacctgattatcttgcgcttcacatgcaggcgaaaacgatcagcgaaatgttttaaggtgtaagaaaaggggttaaacagggggacgaaggcagcctattataggctgccttcaaaaaaagagaaattagtctaaaaatttagataaacggcatcttggggggagattcttattcagaacgtacaattgatcatttccatcgtgatttacatggtagggatgctttatattgggtattacgcttacaaacggacagcaaacctctcagactatatgcttggcggacgaacgctcgggcctgctgtcacggcgctcagcgccggcgcatcagacatgagcggctggcttttgatggggctgccgggcgccatgtttgcaacaggcctgagcggttcgtggattgtcatcggactcgtactcggcgcttgggcgaactggatatttgtagcgccgcgtctaaggtcatacaccgaagtagcgggcaattcaatcactatccctgcatttttagaaaaccgttttcatgacaaatcaaagatcctgcgaatattttccggagtcgtcattattaccttttttacgttttatgtatcatctggaatggtttccgggggcgttttatttaacagcatatttaatttggattaccatgcagggctgtggatcatttcaggcgttgtcgtggcctacacgcttttcggcgggtttttggcagtcagctggacggactttgtccaaggcatcattatgtttgtcgcgttaattcttgttccgattgtgacggtcattcagacgggaggacctggagaagccttcagcgagatccagtcgatcgatccaaacctcctcaatatttttaaaggtacgagcgtcctcggcatcatctccttgttctcatggggcctcggctattttggacagcctcatattatcgtgcgctttatggcgatatcctccatcaaggaaacgaagaaagcgcgccggatcggcatgggttggatgatcttttcaagtgcgggcgcactgctgaccggattgctcggtattgcgtattactcgaagaacgggcttcacttggatgatccggagaccatcttcattcaattgggtaacatcctgtttcaccctctaatcacaggatttttaatctcggcgattttggcagcggttatgagtacaatttcctcccagctgcttgtgacatcaagttctctaactgaagatttatacaaaacactatttaagcgctctgcatctgataaagaactcgtctttttcggacggctttcggttttggcggtttccattgtcggactctgtctcgcctggacaaaaaacaatacgattctcggtcttgtcagctatgcttgggcgggtttcggagcgtcgttcggccccgtggtcatcttaagtttgttttggaagaggatgacaaaatggggggcgcttgccggaatggttgccggagcgcttaccgtcatcatttgggcggaagccgggctttccgatgttctttatgaaatgattccgggctttgccgccagcttgctgtttgtgtttgtcgtcagtctattgacgtcaaaaccggagcagcaggtgcttgatgaattcgagcaatacaaacaaacgctgtaacgatgacggagatggggaaccattctccgtctctctttttataggccttctcccccttctaacaggggattgatcccatttttttaaaagtcgcatataagtctatacaagagtgtaaaggagaagtatgattaagttaaaaacgagtaggagaaaggatatggaagagctattagaacaagttgtttctctttcaaacattaatgagatcattgactttatcagcggggagctgaaaaagccggtcatactggaaagcgcagattttttcttattagcttacaactcctattatattaaccattttgatgcagcaaaccagcaaacgattttctccaaaaaatgtccgctgccgatctttgaaaagttcgtcgaagaaggcattattgatcaattgaaaacgattccgactccttttcgggtaaaacagattgaagaaatcggcttaaaccagcgggttgtcgtcagcgccaagcataaagacgaaataatgggctatatctgggtgcaggagattgaagacaacctgtctgatgaagagcttgatttcttatatcaagcttcctttcatgtcgggaagatcatttataagaaaaaacgcctcaaacaagaaaaagaagaacaggcggaagagctttacaaaaaggcaattaacgatcagtttcaaacggaaaaagagctgaaggccgccgccgataaagcgaacgtcgtcctgccggccgtgtttaccgtcatggtgcttcaagtcgttgacggggaggatgaactgctcgaagatctaaaggaaacgatccggtcttatttaaacctgaaagacaacatcagtcacgtactggaggatcattcgaatatcgcaatcattgtcggcagtgtgtcgcgcaagcgttccgcgctggccgctgcctcagaactgatcaaccgtctgttgacccatctgcgctcgcaaatgctgccccttattttgatcggggtcggcaatgagtacagcagcctgctctccctcggcaaaagctacagagaggcgctccaagtgacgaaagcagcggagatcacgggaagccaagaacacattccctatgaatatcaaaagctcgggcttttcaaatatcttgaccaaatcgccgcaaaaaacgatcatctgcaatatgtaaacccggaccttcagctgctgaaagaaaaagataaagaaagccacaccgaatttttaagaacgcttgaaatctatctcgtcaacaattgcaaggtcaagccatccgcagaacagctgtttatccaccaaaacacgctcaactaccgaattaaacaaatattggaaatgacatcgattgatctcaatgattttaatacaagatgtcagttgtttatcgatttaatgctgatgaagaaagcaggctacaaatcgtaaacagaaaaagaaaagccggtacatgaagtgccggcttttaatatgtccgataaacgtaaggatctttcggctcttttattgcagaccaatccttcactttcagcacgggaattgtagatttgaaaggctgatagtattcggaagacagcgttccttttacatgaagccactggtcgtctttaatatccatattttcagggaactcgaccagcatgccatagacgccggagtcggcgatgcaatgaatgatgccgaagcggaggacaaacagctgtttgtcactgatcgcttcccctttaaaagcaaagccgtcgaattcgagcgttcggtcaaggaattctcccggataatgatagatcgtttccatgcccttcaaaaaatcatcatcttttaatgtaatatgctgtttttctttatactttttcagcgctttattcatcaattcatcatacccatcctggccgtagtagatgcttgtgtcggggcgcaggtactgggtttgggcataatgctccggctgttcgatcgctttgaacgagaagcccttcgacttgacgatattggaatcaagcgtcgctgccggcagaaaaagtccggtgcataaagggaagaagaacacgaaataaatgaacattctttgcagaaaaggcttatctttttcatgatcgtggtcatggccgcatccgcattcatggttacatcctttttcatccgagcttttcatataaatgtagaattgcacagctgtcaaaatggccagaagaataatagcgatgtatgaaaggtaagcgtatttcatattaatatattttgtcagattgccggatgcatgaagatgaaaaaagaaaaacgtaaacaacattaaaatgaatgtgcgaaacatgttctcacccctttaccaacagtgatccggctaagacaataacggcgatgtaggggattaagacaaacacaaagcgctttttgaagatgccgagcatcatcagcagatttttgatgtccaccatcgctccgaatacgagaaaggcgatgagggagccgagggaaaacgtactgctgaaagaagaagcgataaaagcgtcgacctctgaacaaagggacagcacaaatgacagccccatcataacgagggaggaagatacatcattctgcccgatcgccaaaagagtcgatgttttaatatacgtctgcatcgctgctgcgacaaatgcgccgatgatcaaatattttccgactgagaaaaactcgtcaactgcatggcggagcgtcccgccgagcttttgcaggaaagactggctctcatggacatggtggtgatgtccgtgcgtcccgttttcgatcagctgattccctttaaattgataagagatgatcagcccggcaatgagagacaccgcaatcgccaacccgccccggtagaacacgacatcccatttgtttccgaaagcgatgaatgtcgagaataatacaatcggattgatgatcggggccgtcagcatgaaggcgaccgccgcatgaagcggcactccctttaaaagcagcctgcgggcaatcggaacgatgccgcactcgcaagccggaaacaataccccggcaaatgttcctgacaaaacggcgagaaatcggtttttcggaatgattttcgccatcatctcctccgtcacaaacatttgaatcaaacctgatataaaaaccccgatcaagacgaacggaatcgcttctattaatatactgataaatattgagttcagctgcagaaaggattgtgaagccacaaaaaaacctccgcgcaaatccatatttttagtttcaatctagcattataacataaattgaaaaaagcggttttgtgtggcgggggtcagataatgggaggcgcatgagtaacagaatcaatacacagccttgaaagggaatgttatgataagaatattcaaaaaatgaaaagaagaggggaaagaaaagatgcagcagccttatgatatgccgcttgaacagctttatcagtataaacctgaacggacggcaccggccgattttaaagagttctggaagggttcattggaggaattggcaaatgaaaaagcgggaccgcagcttgaaccgcatgaatatccggctgacggggtaaaagtctactggcttacatacagaagcatcgggggagcgcgaattaaaggctggtacgcagtacccgaccgccaagggcctcatcctgcgatcgtcaaataccacggctataacgcaagctatgacggagacattcacgatattgtcaattgggctcttcacggctatgcggcattcggtatgctggtccgcggacagaacagcagtgaagatacagagatctctcatcacggacatgtacccggctggatgacaaaaggaatcctcgatccgaaaacatattactacagaggggtctatttagatgccgtacgagcagtcgaagtggtcagcggttttgctgaagtcgatgaaaagcggatcggggtgatcggggcaagccaaggaggcgggctggccgtcgcggtttcggcgctgtccgatattccaaaagcagccgtgtcagaatacccttatttaagcaattttcaacgagcgatcgatacagcgatcgaccagccatatctcgaaatcaactcctttttcagaagaaacaccagtccggatattgagcaggcggccatgcataccctgtcttatttcgatgtcatgaaccttgcccaattggtcaaagcgaccgtactcatgtcgatcggactggttgacaccatcactccgccatccaccgtctttgcggcttacaatcacttggaaacggataaagaaataaaagtgtaccgttattttggacacgaatacatcccgccgttccaaaccgaaaagctggcgtttctgagaaagcatctgaaataaataaaagcgaacacccggtgaagccgggtttttttatgtcttgatttaagaatatatcgtattataagatgtaattagagagggtgatgaaagtgaatacggaacaaaccatagaagtgatgaatcagaactggacggatatttactaccatctgcacatgaaacatgatgatcaattgtctcaccaagcggttcggatgcttcagcatatcgaaaaaaaccgctttgtgaccattggccatttagcaagattgttggatgtctctcataatacggcatcagaacatgtgaaaagactaatacaaaaagggcttgtacagaaaaacagggacagcagcgatgaacgcaaagtctacgtcacgttaacgcctgaaggtgaagaagcagtgaaacggcatacgagacttaatccgaaaaaactgcaaaaggtgctggagcaattaaatgaggaagaagtcgaaatggttaaaacagcattttccttgttaagccgggaggcaaaatcatgtttttaatagtaaaaatcggggttatctgcaatattgattgccattataaccgagattgcacgaaaatcgcctgaaatgggcggaatgattgcggctttgccgcttgtcagtctgctgagtttattttggctgagtgtacaaggggaatctttaaagcatttaagccaatttgcgaaaggcgtgctatgggggtttccagccacagcggttcttcttttgatcgtggttttgagtttaaaagcatcattcccggttatcatttctgttgtatttggaatatgcggatggggcgggtgtttaatgctgcaaaaggctctcatccatgcaatattcgggtgaaaggcgggttgtcctttggtataaggagctgcctgtgctgccgcacaagcagcctaagaaggtccggcggggggatggaacggaataacattccggtccgagtctaccacgtataaagcctggagtagtaaatcatcctcgccggaaaaggagcgtcccggtatgctccgtccggcgggatggatgtcgacagaaatcggaaataattgctcccgagtatttttaagtttatcggataagtctggacggtttcaggagcgagttcgtaggagaatgcttgagctttagtttgactgatcatgaactcttgatattctccattttgaaagtaatataaatagccctttaaacgatgcgcttcctggttgaccaaagagatatacagaccttctcggccggatttttcaacggggtttcctgctttgtcagacaggtaaatcaatcccgtttgagatgcgcttccgctgtatatttgacagttaacgggttcaatataagcagggtgtgccggcagccggtcaggatgcggagcatgtgaaatcaattcaaaatagtagggcgctacatagtcggcatcccgattccatttgcaatcgcactcagcctttggatcgaacatgaaggtctgggtgatgatataaacgatatgtctgcccgcgggcacatgctggagcctgatgttgatttccttggacgaatgagcgggaacgatgaatggaaaggtttgcgagggccggtcatttccttcaaagaagacggatatatgaattcggtcttcctcattcgcatggttgcagtagacgtatgaggcttggaaatggccagatgaatcggtttgatagcttactttgtttctgtcgatcgtataaaggttttctgcgtgaaaatgagttgatctgaggaaatgaataataccgcctccgtttcacagtatagtaagccgccggagtacccggcagcttcatattattttttgatataaacctctgtccgcttttccaggaaatcctggagcaaagcgatccccgagcaaatggcccagtaaatcaaggcaactaaaatgtacatcgtcatatagtcgaattcccgtccgccgacgatttttgcctgctgaaacaattcaggcacggtgatcatggcggccagggaagacgctttaacgagatcaagcatcacgttcgcaagaggcgggagcgcaatcctaaccgattgagggacaatcacgtggcgcatcgtctgccagtaggagaatccgaccgattttgcagcgtcccactgccctctgtcaacggacgacagggccgagcggataatctcggcaatgtatgcggcgctgttgatgctgaagccgattaaggcagcagccaaagccgtaaattggattccgatataaggaaaaccgaaataaaggataaatagtatgacaaggatcggaacgcctctcataaacgagatatagattcttgccggccaacgaagcaaagcgagcccggacatgcgcccaagcgcgatgaaaaaaccgagaattaaaccggcaaacatgctcgcaaaagaaatgaaaagcgtattccatatgccttgcatcacataaggaaacgatttcgcagccaattctgcattaaaaatatactcccattgaatagagcccaatttaaatccctctatttattcacatcgacatcgatatagtcgatatcctgctttttcgaaacatcggcaccgccgaaaaactttttcgaaatctttttgattgtgccgtccttcagcatttcatcaatcgttttgtcgaattgttttttaagttcagtgtttccttttttcatgatcatgccttgctgatgcggatagtatttaagatcgggatgaattgtcagatccagatcaggcattgcggcgagcgcgagcttttgaaggtagtagtcgtttaagatgacgtcggttcttccattcgctacatcctttaaaaattgatcatttgtcgcgttgtcgtaaatgacttcctctgctccgtatttgcgtgcgatatccatgtaaactgtcgtagctgcaccagcggctttctttccttttaagtcctcaagcgtgtggatgcctgataagtcttttttgcggacgatagccgttccgaatgaatatttataaggcgtagagaacaaaaacttttctttgcggtcgtctgtcatcgtaatatcgttggcggcagcgtctacttgtccgctccccaccgcagtcagcatgccgtcaaagcccatttctttaaattcgacatccaggtcgagccgttcagccgcttcacggatgacttcaacttcgtagccggtcagcttgtccttgccggaatcagtgtcatgatatgaagtggggtaaagggttcctgaagtcgctaccacgatcttccctttttcctttatctcatcccaggccgtttttttgttttcagccttattttgagctgtgctgcatgcagctgttataagagcaagcgccaacacagttatcaacaatgtaatgcgcttatacgtatgcaatttattcacttaaaacaatcctcctattcctttagtcaagtaaaccatagcactgaagtagggattaggcaataagataattagtattgggaaaaaataaaatgattgattgtgcaacctgctttactttttaaggtgaaagatggaatcataaaggtattggcaaattgaaacataaggaggataagaaagatgaaaaatattttaatcatcaacgggcatgaagcctatccccatgcaagaggacagctcaatcacactatttttacagcgatggcggacaagctgagcgaaaaatatgaagtgaaaaaaacagtggtggcagacggctatcaaatcccggaggaacacgagaaattcaagtgggctgatgccgttatttatcagacgcctgtttactggttcagcgttcctgctttatttaaaaaatatattgatgaaatttatgagtacgggcttttttatcaagggtctgaagactacggaagaggcggactgtttaccgataaaaagtatatgttttcaaccacatggaacgcgccgaaggatgtattctccaaggcggggacattcttcgaaggtaaaagccttgatgaagcgctgtttcatttgcacaaaatgcaggaattcatcggcatgaagcctttaaaaacattctctgtccatgatgtaatcagcaatccgcaagtggatcaatatttagctgatctggacgcccatttaaaagaagtattttcgatttaagtaaagaggtttgtgcacaagcgcagacctctttttttcgttaccctccaagaaaacgtgatacagttgagtaaaagcaaagcagggggtgtccgcatgtttttaaaaaagctgactttacttcgggaaggagttccttcttatgcaaaatatccattttcaattcctgctattcaacatttaaaagaactgacgtttcaaaaaaacgtaacattttttgtcggggaaaacggatcgggcaaatcgacgctgcttgaagcaatcgcagataaatgcgaatttaacacagccggcgggggaagaaataacacatatgaagtgtacggctccggatcggctcttggagactatatcagattgtcgtggcttcccaaagtaacaaacggcttttttctgcgcgctgaatctttctatcattttgccactcatattgatgaagtggatatcacgggatttcgaagctacggaggcagatctcttcacgagcagtcgcacggcgaatcttttttatcgcttttcaagcatcgttttaaagaaaaggggatttatcttctagatgagcctgaagcggccttatctccggcaagacagctggcattcttgaaaatcattcatgatttgacgaaatccagccaggctcagtttatcatcgcttcccactcccccattttattagggtatccggaagccgaaatctttagttttgatggtgaacaaatcgctgaagtgaactatgaggatacggatcattacactttaaccaagtattttcttcagcaccgggaaaagcttttggcggagctgtttttagatgacgtttgatctgaaacgcgtttcataggatatgataaggagcatccggatcaaaatatgaaacaggagttgagctatatgattcatcagcgactacgcccatttccagatcatttcctatggggatcagcatctgcagcctaccagatcgaaggagcctggaatgaagacggcaaggggctttcggtttgggatgtgttcacaaagattcccggaaaaacgtttaaaggaagcaatggagacattgcggtcgaccattaccaccgttttaaagaagatgttgctttaatggctgagatggggttaaaagcataccgcttttcagtcagctggccgaggatttttccgcagggcaggggagaagccaatgaatcgggtttgagattttacgatgacttgattaatgagctccttgctcatgatattgaacctgttttgacgctttatcattgggatcttccccaggctttaatggatgaatacggcggctttgaatccagaagaattatagaggatttcaatgcgtattgcgttacgctctataagcggtatggaggcagggttaaatattgggtgtcccttaacgagcaaaattacaactttaatcacggctttatcacagcgatgcatcccccgggtgtgaaggatagaaaacgcttctatgaggctaaccatattgcatttctagcgaatgcaaaggcaatcgattcttttcgccggtatgttcccgatggaaaaatcggaccgagttttgcttattcgcctgcatatcccctctccagccgtccggatgatatcctcgccttcgagaatgccgaggaatttacaaactattggtggcttgatatgtactgccggggaacatatccggacatccctttaaagtatctgaaggaaaaaggctgggcgccgacaattgaagatggggatatggagcttttagcaaaaggaaaacccgattttgtcggtgtgaattattatcaaaccatcacatatgaaatgaatcctcttgacggggtatcggaaggaaagatgaatacgaccggccaaaagggaagcaatcaggaaacaggcatgccgggtttatacaaaacaaaaaggaaccctcatcttgagacatcgaattgggattgggccattgacccgatcggtctaagaatcggacttcgcaggatttccagccgctatgggcttccgcttttcataacggaaaacgggctgggggaattcgataaggttgaaaatgacggcacgattcatgatgactacagaattgcctacttgcgtgcgcaccttgaacaatgcagacaggctttaaacgacggagtcgatttaatcggctactgcagctggtcatttacagatttattgagctggctgaacggctaccagaaaagatacggtttcgtttatattaaccgtgatgaagagaatgtaaaggacttgaagagaattaaaaaagacagcttttactggtaccaaaacgtcattcagacaaacggggaagagctttaggaggggcgccggatgaaaccggcgcctttatccgttgttcaagcctgtttaaaatcgagaagataggtgatctgtgcagtgccgctgtgatcaggcattattgtatagcatgtcagctgataggcgccttgcggaatatcgcatgtcaatttcttggataggacgcttgcaatttctaccccgtcataaagcacttcgaaaggaacggtgacgcgcctgttgaaggagggcacctgtttttgggcattcaaacggacttctactgaagatgccgtgttttcgagagcttcaaacgagaccgcgtgctctcccgttgtatatcctcttttaatatcctcgtctgtccaatccataacgggcggctttccgcctttctgataaacggtaaactgatggtatgacatcgtcatttcttgtgcttcccactttttgatcaaagaccgtacccccagtgttaattaatcttgaaaagtactttcgtcccgtccggataatcgcttacctgattgcccacccaagatcctgctccacggttatcagacgggctgatatactcgacagaagcacctgttccgccttcttcgcacatggccatcggccactcgtcgcggtcatagcctgatttggaaggaacatctttcaatgaatcctttcggcgttcggcggctccgtccctgtcgatcgtacagatttcggagtgcccttttttgatagcctttcgaatgtgtgcgcctgtttcaggatagcggtccgaaggaaaaatcagcacttcatcgtagtttgagccgttttgccggcccgaaggctggtgttctgaagtgaaaaagtcgccagatacaataccgatgatcacgacggcgacggcgagcaaggtgatcagcaaagatttaatcttgtccattcttgttgtcctgctttcttatgttaaatcattcggccgcagtggaccggaagtaaatacaactttattatcgtaaaaatgatttgagaaataaaggggagattaataagtttttcctcttgaaatgctgagtttccgtctatcaaatcgctttttttaaaattttgccggtcgtttagaaagttttagaggttcaaaatttaaatttttcatatgaaagaaaaactttcaggccccctttatcaagcctttctgcgcgaatgatatgaaatacaagacagaaaaggagctgatcgagttgcttcgcaagctattgaaggcacttcaaaacggcaaaaaccgacgatacagcagcagcgattacggacggaaatcatacaaaaagtacagcagcagcgattataaaagaaaagggtacggtcatcgccattacaaaagaaagcacaagaaatttttcggcagcagctaaatcacgtgaaaacattgataagatggctgtttgaccgcccgctcaaaaaaggaaccgtcttggaggggagatatcgaatcaaccgtgtgctcgggatgggcaactacggcatcacatatcttgccgaagaacttggaagatccggtttccgcgtcatcaagcagcagagaaaaacaaaagcatggacatcagccggccggcggtctttcaaccgcgaggctgaaattttgcgggaattggatctgcctgccgcgccccgtctatatgaggtgcttcgagcggccggcgagcggtttatcgtaatggagtatattgaaggaaaaacgtttgaagatttgctcttttatgatgggcgtgtctttgatgaacagcaaacgatcagcatattgaaggaggtgcttcacagcgtttcacttcttcacagccgggggattattcaccgggacttgaggatcccaaatttgattgtgaatcgaggaacgatccgcatcatagatttcggactggcatgccgcctgactgagagagaacgcgttgataaccggcacccggaaaaaaagctgatgcgtgcagtttcagtcaaaagtgacttttatgcgttagggcattttgcattgtttctcctgtactccggttttaccccgtccgacgaggaagaaaaatgctgggaagaagagctcagcatatcgtctgggcttaaatctgttctgcggaagatgctgcagattgatctcccgtatgagcgtgcagaagacattatcggcgatttgatttcctgtacggcggaaaagaagaagctgccgttttaacggcagccctttttccctgctatttcattttgacttcaccgatgagctgatgcaaatcttcagccagtttggagagttcatttgcagaggcggtgacttcttccatagccgcaaactgctcttctgtcagacctgcgacttgttgtgaataatcagatgtttcctgaacttcttttgagattgctgtaaatgatgttgtgatgttttgaatgctttgcgatatatgccgggcgtcggaagacaagtcggaaattcttacgctgaactcttccattaagccgtcaatagattcaaatgtccttttgttcttttcgatcattttgacgccgttgaccgcttccgttttcactgtcatgattgaatcggttgtggttgcgatttctgattgaatccctgaaatgaggtgggagatctgattggctgattgctgcgactgttcggcaagacggcgaacttcttccgcaacgacggcgaatccttttccgtgttctcctgctcttgcagcttctattgaagcgttcaaagcgagcaggttggtttgatcggcaatctccgtgatcgcttttgaaatgctgccgatttcatatgatcttgtattttaagcatttcaatgatttctccgctttcatggaccgattgatgcatcgtgtgaatttgccgcatcgtttcggagatatcttttgccccctgttttgcttttttgcgggcgtattggctcttttcattcaggatcgcagcgttttctgatatgttttgaatatcggcggaaacttgttcaacggcttgtttgctgcctgctatccccgatgtctgcatttccgatgaacttgcgatatgctggacggcttcggtgattttctcagaagcgaggcttgtttcttcagctccagatgtcagctgatcagaagcggcagctacactgtgcgacgactgtgaaattttttgcatcagccggtttaggctgtcattcatttgattgaaatgatgtgacaagtcgcccagttcatctgtcgaatcatcctggatctcggttgtcaaattgccgctgcccgcctgttcaaaagcatgagtcagcattctgagccttccgcctatccttttggtgaaaatgaggacaagcaaaatggagatgatgattgaagcagtcagaacgatagcaaaaattttcaggaacgattgaagagtgcttgtgatcatatcctggtcggcccctgtataaaagatgccgataacttcaccgctcttgtctttgatcggcatatatgccgtttgatatgtttttcccgctacatctgcttttccataaaagttttttccttcttttaaaaccgcatttgctacctccgaagacactttcgttccgacagcgcgttttccgtctaccgtcacatttgtagatacgcgcgtgtcatattgaaagatggtgacagtgtctttcgtatcattgccgatttggtcgacgagttcttcatttccgttgataagggtcgaacctttgtagagcctgtcttctttgacttcccaatcaccttcaagagattcattcaaataacggtagctcaatttcaaatcgcttttggctttctctgtcgccatctgttctaactcttttgaaagctctttgataatgaaaatcccgagtgctgacgaaaagatcagaataacggctaacacgagaagattaattttcgtccccaatttcagcttaaatcgctttcatgtttcacctgtatacaatatcggttaaaacggaggcgtgttgacaaaatgaaaaagaaaaccccgcttgtgaaaacggggttttggacaatctgaaagcctaaagttcctctgctttttcggcttttcctgtttcatactgtttttgtttatttgcgatgtagcttcttgcctcttgatgcatgcgatgtttcattttatagacttcactgttttgatagatatgtgaattgtagtttaacggagacgcatttttcccttttcctgttgcgtcgattaaggcggaatagtcggtctggatcatttgctgaatatgttcagaggccgagtattctcttttgagcagtccatcaagatcttcgacagccttgattgtgtcttttctgttttggtttgcagcgtcaagctgctgtttgatttcatcggatgagaacggctgtagcgatattaaatcatctatctgtcctaaaatattcgacagctcttgctgctgtgcggagaccatgttttgagagtgaatgtggacatttgcaagctcctgttcaagaaattgaacatcaacgaacgtatcctctgaaagtccggcattttcggcagcagaagatacaccattcagaaactgaatctgcatatcggttaaatccagccagccgtctacgactcctgataggtctctgtaaaacgctttaatggcatcggcgccttttccttgaaactcatcaagttctgcgacgctgtttaacgctttttttaagctgacgagctgttctctcaaatttttatattcatcagatctttgcttcatagctgaaattagggtttccgcttcgtagactttcattggaaatctgcccttcctgcgacttatatagtacagagtgtaccactttgccacagggaattgggcaataaatcctgaatatccatgaaaatgaatctttatgatcaaatctgcgagacgtttaggttttttgtcgcaacagatgatctttgctttagtagttaattagtcctctttatgacaggaatgtgtcgatggaccgaagaaaagctgaacaccaaaaatgtgaaatactgtgaacaacacaattgaaaatgtgattttatggtatcttaaaataaaatattaaacaaaaaagacttggaatattgtaattaaacataattgactactttctcatgcttgattagtatgatagtaaaatattttaaaaaaaggatatttttaaaaggggagatcgggattgaatgaagaaggttaccggcttggaattgatattggaggaacttttaccgatcttacattgttaaatccggcggacggaagcatgaccgcagttaaaacgccgaccgttcccgaagatccggcccgaggaatcatcaacggcttggctctcttgaaaactcggggtgtccagccttcagaaattcatcactttgtacacggcatgacaatcggtttgaacacattattacaacgcaaaggggctgatattgctttattcgtaaccgaaggtttccgtgatattctttcgcttcagcgtctccggcttccggtaccctacgattttagatctagaatgccggagcccctcattcctcggaaaaacgtgtttcccattcaagaaagaatgctttatgacggctctgaaaagctgccgcttcatatggaagatatcgatgaggcggttggacaagctttaagaaaaggcttaaaaggaatcgttgtttcttttttgcacagctatcggaatccgctccatgaacgccaggctgccgaacggatcaggcaaatagcgcccgagcttgaggtggcaacgtctgcggagctttggccgcaaatgagagaatacgaacgaacggttatgtccgtcgcgaatctatacatcaaaccgaatatccatcactactttggaacgctgaaagagaggcttgtccaggaaggaatatcggcgcagccgtttatcacccagtccaacggaggactgatggacattgaatcggctgccgaggcacctgtcaaaacgcttttttccggaccggcagcgggggtcataggatccatcagaacggcggaagccgccggcgaggccaatatcatcacctttgatgtcggaggaaccagcgcagatatttcgattgttgaaaaaggagagccgacctttacccagtcaaatcaaatctcgggatttccgattgcgattccatctgtagcaatgtattcgatcggtgccggcggaggatcggtggcatggattgacagcggcggtctcttgaaagtagggccggagtcagttggctctgatccggggccggcctgttacggaaaaggaacaaaggccgcacttacagatgcgtttcttatatgtcattatttaaacccaaacaggtttgcagcaggaaatatgaaactgtaccgggaaagagccgaaaaagcgctcctcccggttgccgagtatttaggcacagatgtggagcaagccgcggataagatgattcaagttgcgcttgccaatatgtacacggaactaagcaatgtcatggagcaacacgggtttgacccgcgtgaattcagccttatggcttttggaggcgcaggcccggttactgctaattttttggctgaggaaattcaggccaaaaatgtgctgatcccgccgcatccgggaactctatcggctttgggcgcactgacggctgattttatctacgatgctgtatgttcaagacaggtgctgcttgagcaaataaaaacggctgagttaaaagtggagtttatgaggctgcaagaacaggcggaaacatggctgcggaaacaacgggcggacatggtgactgaagcctctcttctttacttgcttgatgcccgttataaaggtcaggcgtatgaaattgagctccctgtttcaccggaatggctggaaggcgaaagtacgagtgaaatcgcagactcctttcatctcttacatgggaagcaatatggacacagcgatgggaaagcaagcattgaattgatgaatatgcgcgtccgcattataggcaagacgccgaaaccgccaggcggaaaaggatgtcaaagtaatctgcccgaagctgaacctgtcagccaaagaaagatcatcatgaaaggcggtacatatcaagcctccgtataccgccgtccagatttaaggagcgggcagagaatagatgggccggccattgttgagcaggacgatacaacgacgctgattttgccaaattggagcgggaaaaccgatcatgccggaaatttgatcattgaacggaaggagagctgaccatgcgcacagatcctgcccggctggaaatgatgagaagctactttaacgcgatagccgcgggaatggggcacgttattgaacggacgtcctttaccacatttgtaaaagaatcggctgatttcgctactgcgcttgcgacgccggaaggggagtttttcgtttatccgaaaacggtcggcgtcacgatttttttagggctttcattaaaacgggtcatcgaagaaagcggcccatttgaaccgggagatattatcctcacaaacgatccttatacaacggacggattggcgacccacttgcctgatattcatgtggtgaagccgattttcttggagggcgagataatcagttacgcgtggtgctttgtccattgcagcgatgtcggcggccttgtcccggcaagcatttcgccgaccgcgacagacatccatcaggaaggcctgagaataccgccggcaaggatttacaaaaaggggagagaaaatcgcgatatattgaaggttttgcgggcaaacagcagggttcccgacttaaatgaaggggatattcatgcgatggtggccgcggtcaatacggcggagaatcgattgacagaaatggtcggaaagtttggaaaagaagcggtccaacaaggaatggatgatttgctcgaacaagccgcgatgagagccggacgggtaatcagcaggattccggaaggttcatacagtttttcagattatcttgatgacgatatggtttctgacgttccgatccgcttggctgttacggcaaacgtctcgggaggggagatcacattggacttttcagactgtgatcctcaggtgaagaccgcatttaaccttgtcaccaatggaagcaaacattcatttctatatcagggcctgatcaactatatcataagtgaagacccgtatattccgattaacggggggctgacacggccgatccaagttatcgctccaaagggtacgctggttcatccggaatatcctgcggcggtcggcattcgtcattcgatcacgatgagactttataatgctgtactgggcgcattggcaaaggcgcttccgaaagccgtgcctgcagcaggcgccggtcagtcagcgattgtcgtactgtcggttcccgatgaatcaactggcagcaggaagatgtcggtggtcgaaccgatgggaggcggaggaggcggccagcatgacatggacggagcagatggaattgaccatgcctccggatttttgaaaaatacgccgattgaaagccttgaacagcacatcgacatccatgttcgccgctatgaattgatcaaaaatacagccggagccggttttcacaggggaggccatgcaatcgggctggagtttgaagcggcggcaccagaatcaattgtgaccgcaagagggatggagaggatgcgttttcatccgtgggggctcgccgggggaacggcaggagcgctcgggcgggtgcgcctttatcctgatcagcctcaggagaaaacgatgtcgaagatcgatgttctaaagctcaataaaggggatgttatcagcattcattcaccaggcggcggaggctggggaaatcccttccgccgggaagctgaatcgattttaggagaagttgaagcgggcttgctgagcccggaagcggcatatcatcaatacggcgttgctgtaaaagaaaacggcgctggctccttcattattgatctggaagaaacagctgaaatcagaaaaaagaaagcaggcgaacatcggaaacaatgggatttcggaatcgccagagaagaatacgaacggtgctggacagaagaagccagcagcacattggcccggcttctgcgacagcttccggctcatcaaaggtcacatgttaaacatttagtccatcgttatttctcaaaagaacataacggtccgatcagtaaaagcgaagttgcggccgctgtggaaaaactggctggaaaaaataacacgggaatggtgagatgacaatgaaaagtaaaatttctgctttatttattctgtctcttgcagcggtgctcctcctttcgggatgcggcggaaacggaagtcaggaaagcaaacaatcagatacagtcgttatcggcgtctatgggggcgattgggaaaaacatatcaagccgagcctcgaatcttttgaaaaagaaacaggactgaaggtcaaagttgtcgcagggacagactctgagtggttcacaaaactcaaggcatcgaatggcagaaatgctccctatgatctcttaattctgcagccggacacgattcacagagcgcagtcggcgggattgctggcaccgatcgatcaggaaaaggttccgaatgtccgcgatctgtaccactctgttcagaaacgcttcaccgatgatggaaagcagtatgcggccggtttcagtatgggacagcttggaattgtctaccgaaaggatcttgtaccacaggagcctaagcgctggacggatctttggaacagcagctataaaggtcatgtcgccatatcatcgccggcttattcggcggggcttcagttttttgtaggattaatcaatgcccagggcggcctggagtcaaacgggaaagacgtggataaagcgttcaacagcttggctgatttaaagaacaacataacggcctatcccgataatccaggctcgatacaaacgcttctggaacgtggggatgcatgggttgttccgttttgggacggccgcgctttttctttgcaggatgcaggtcttgacctgggatttgcatatcccgaggaaggtgcagtcgcagcagttgcaagctgggctttaatgaaaggaagtcctaatcaggataatgcgtacaagctgttaaatcatctgctcagtccagaagtgcaaggagattttgccgatagaacgttttacggcatggccaataaaaaagtgaaatacagcgataaattaaaagggaagatcaaagtaggggaggattattacaggaatttaaaatgggttgactatgaagtcgcggcaaaagatctaggcgattggacaaatcgctggaatcaagtacttggcggaaaataggtgacaaacatgagcgcaattcagattaggcatgtcagccggcatttcggaaacaccatcgcattggaagacgtacagcttgaagtcaaagaaggggagtttttctccctccttggtccgagcggctgcggaaagtcaacgctcctgaatattattgccgggttccttgaaccgacgtcaggttttgtatatataggaggacgagatgtaactgatttgccgccatacgaccgacatatcggaatggtttttcaggattatgctttattcccgcatctcagcgtttttgacaatgttgcatacggcttgaaagtccgaaaatggccccgccgcaagattgaagaacgggtgatggaatgcctcgctcttgtcaggcttgaagcgtttgctaatcgcatgccccatcagctgagcgggggtcagcagcagcgggtggcgattgcccgggcattggccgttcagccgtctgtgcttttgctagacgagccgctgagcaacctggatgcgaaacttcgaaaagaaatgcagacggagctgcgcagcatccaaaagcgcgtcggcattacaacgattttagtgacgcacgaccaggaggaggctttaagcttatcggacaggattggaattctcggatgcgggaggcttcagcagctcggcactccgttggacgtgtaccgcacgcctgccaatcaatttgtggccgaatttatcggacaggtcaatttactgaaagcgcgtgcgtcgaagatacagccttcatcgggcggctatggatacgaaacggtcgatttcgaagtgtatgaaggcgttccgctgacatttgaaatcaaccaggaactctcaaaaaaaacttctgtattgttcatggtgcggcctgagaggatctcagtctccttcgagaagcaaaagaacaggctgattgaaatgcctgcaacaattaccgaagtcagttacgccgggcatgatctcaggctgaaagccgctgttttcaaaggagaatggatcattcaggcgcccgatcctcaattccctagattgccgaaggcgggagatcaagtgtatctttctttggagccgggcgattttgttccgctggatgttaaggaggatgcagatgagggctgttgaacaaaaacggttttattggtttttgctagttcctgtccttttatttctcggtgtttttcttgttttgccgcttgttctgctgctgttattaagtttcagagacgtggacgctatgatgaatacgctcgatacgtatagtttttctcaatatgtcgaggtgttctcttcagacgtttatttgaaaacaatcggtataacaatttggacggcgttgaagaccactgttttatgccttgtgatggcgtatccggcggcatatttactcgttaaggcgccaaccggcaggctgcgggctttgttttacattttgcttgtttcccctttattgaccagtgttgtcattcggacgttttcctggattgtgctgctttcgcaaaacgggatcgtcaacgaggcgcttatcagtatgaagatgattgaaaagcccctgccgcttttatggaatatgaacgcagtcatcattgcatatgtccaggttatgctgccgtttgcagtactgccgcttgccagttctttaagcgaagtgaaacctgatcttaaatttgcttcgatgagccttggagcgggcaggctgcggacattttttttcgttaccttgccgatgacggttccgggattgctgacaggagcaatgatcgtgttttcgctttctgccggaagctatattacgcctcttctcgtcgggggaaggatgcagccgctcctgccgttgtccatctatcagcaggtcatgcaagtctttcatcttcctcttgcagccgcaatgtcgattactttattagccgttgtcagcgtggttattggaatccttggcattttccaaaagcgttgggaggcgagaataaatgggtaggcgattgcgacgtatgcgcaggggaaaatggattgatgcgtgtgtttggacagcgggtttattggtatacttctttttggcgctgcccgtcttcgtgatcatactgtcggcattcagcccggacgaatatccgaagttcccgccatcaggcatctcgctgcgctggtttgccggagttttcagcagcagcggctggatggaatcgatttgggtcagctttatgctgcttctcgttgtaacgcatcttgcggtgatccttggaacagttgcagcctatgcattggcgcggctgaactttccgggaaaacaggcgattcaggcttttgttttatcgccgttgatgattccccaaatcgcattaggcgtatcatttctctatttattgacaatgattggggtaaacggcacgtttgccgggctggccgccgggcatatgctgatcagccttccgtatgtcgttcggacggtcggagtcagcatggcaaacgtggatcagaagcttgaactggcatccatgaatctcggcgcaggtccctggcataccttttttcatgtcatcttgccgcttattaaaccgggaatcattgcgggagccgtttttgcctctgtaacgtcattcggagaaatatcaatcagtctgtttgtttcttcaccggctgtcacgcctgtaccggttcgtacattcagctatattgaccagacatttgatccgagcgttcatgcgatttcggttatttttatcacggtttcagtgattgcgctgatcatcatcgaacggacgatcgggctctcaaaaaccatgtagcaggcgaaactcagcctgcttttttgtatggagcatcggaagtatttcaagataccgttcagaatgagacagttcagcaaatttaacattctgcttcaatgttttcgcaagccggtttgtcttttctcgtcagtttaaacggcctggtaaaagaaacgttttaattgaatgaacattgtaaaaggaagcgccgaagctttaacagaccttcatgatttatttatgaagtccatgctgtttttttaatattttaatatactctttatctaagatttggaattttttgcgggtttaaacgatttttttcgttttcccgcatatttttttgtcaatttcgggatcgcgcattaacattcatgtacaacattcggtatcccgcatgaaacttttcacctatttttcggtgaaaaaaacaaaattttcatttaaagtgaactgtgagcagaaaatgaatttatatcaagaaaagcagataaaggcaaacctgcggaaacgcagggacgcaaagccatggcctaaggtgctgacggtgctacggttgacaggttgccgaataaacagggagttcgcccgtttttattcgggcgggctcttttctttttatttccaatataatgttttattggaaacgacaaatctgtgacagcgtttttcgctcatcgcaaaaccgcaacattgcattgcggcttggctgttcgcatcgtcatacataacaagagataaaggaggaataaagaatgggaaacacattttacccgctgacacatgctcaaaggcgaatttggtacacggaaaagttctatcccggtacaagtgtttcaaatttgagcggctttggaaaattaaaatctgcatccggaatcgattccgggttattgactgaagcgattcgcaagtttgttcgtacgaatgacacgatgcgattcaggctgatgtttgaaggagaggatgagccgaagcagtatatagcggaagacgaacctttccaaattgaatattttgatgcttcagaaagcggaggagcagacggcgttcttaaatggggacaagctgaggcgcgccggcccctgcctttgtatgacagtccgctgtttaaatttgccgttgttcgcattagtgaagaagaaagctggttttttgcaaaagttcatcatatcatttccgacggcatttctatgacgatcctaggcaaccggattacagatatttatttgaagcttgccaaaggggaaaccgaccttgaacctgtacagtcatcatttacggaacatatccagagcgaattggagtatgaaaattcgaagcgtttccagaaggataaagcatattggaacgcacaatatgaagcgattccggagcccgtatcgttaaaagcgagcgatacgtatcagatccaattggatgcagcccgcttttcaaaagagatttcccctgacctgtataaaaaaattcaaacgtattgtaatgaacacaacatcagtgtactctccctgttcctatccattctgcacatctatatgcaccgggtaaccggacaaaaagacgtcgttctcggaacatttatgggtaaccggacaaatgcaaaagaaaaacagatgctcgggatgtttgtgtcgacgattccgatgaaagcctccattgaagtacaccaagactttagtgcatttgtgcaggaaagaatgaaggaccagctgaaaatcattcggcatcaaaagtatccgtacaatctgctgattaatgatttgcgggaaagacagccgcatgtcagcaaattgttcgccgtctcactggaatatcaggttatgcaatggcagcaaaaagaaacggtgtcgtttcttaccgagccgattttcagcggcagtgaagtaaacgatatttccattcatgtgaaagagagatgggataccgggacgcttgcgattgattttgattacagggaggagctttttacttcggaagaaatggccgtgttatatgaacggctgatgacgctgcttgaagatgccctgctgtctccgcaaaaaacaatcgctgaactggagattgttcccgcttttgaaaaagagcggctgttaaagcgtgcatcaagccaaaccattgcatatgacaagaacatgaccctgcacggtttatttgaacaaaaagcagccgatcatcccgaaaaaacagcggttgtatatgaaggacaaaaactttcgtaccgggagttgaatgaacaatcgagccgcttggcaatggcgcttcggagaagaggcatcgggcctgatgctccggctgcgatagtgatggagcggtcagagcgggtcatcacggcgatgatgggcgttttgaaagccggcggagcttatgtaccgatcgatcctggatttccggaagaaagaatccgttttatgctggaggattcaaaggcgaaagcggttatcacagacagcgggctgacttttgaaacggctgaaacggtgcagttcagcgaagcgctttctgaatcgcgggaaaacggctatccgtcttcagcggcaggcgccgggcaccttgcatacatcatttatacttccggtacaacgggccgtccaaaaggcgtcatgattgaacacaggcaggtccaccaccttgtcagaggacttcaacaggccgttggtacatacgatcaggatgatttgaaactggcgcttctggctccatttcattttgatgcttccgttcagcagatttttacgtctctattgctcgggcaaacgttgtacatcgtaccgaaaaagacggtttccgacggacgcgctttatcggattattaccgccggcatcaaatcgatgtgacagacggtacaccggcacatttgcagcttttggctgcggctgatgatctttcaggcgtcaaattgaggcatatgcttgttggaggagaggctttatcaagggttgcgacggaaaggctgcttcagttatttgcagaaacagctgaatccgtgcctgctgttacgaatgtttacggaccgacggaaacttgtgtggatgcctcttcttttacgattacaaaccgcacagatcttcaatacgatacggcctatgtaccgattggccggccgataggaaataaccgtttttatattttggatgaaaacggcgcactccttcctgatggcgtcgaaggggaattgtatattgcaggagacggagtcgggcgaggctatttgaacttgcctgacatgaccagagacaggttcttgaaagacccgtttgtatccggaggtctcatgtatcgaacaggggatactgcacgttggcttcctgacggtacagttgattttatcggccgaagagacgatcaagtgaaaatccgcggcttccggatcgagcttggcgagatagagtcggtgctgcaaggagcccctgctgtcgaaaaagcagttgtcctcgcgcggcatgaaaccggcggcagccttgaggtttgcgcttatgtcgttccgaaacaaggcggaaagattcacattcagggactgagggagcacttatccaaacacctgcctgattatatgatcccttcctgctttgtcgagcttaatgaaataccgctgacggcaagcggaaaagtcgaccggaaagcgctgcttcgccatgaggtgtctgtcagcgggactgcagaatatgcggcgccgagaaatgaatgtgaagaaaaaatggtgggtatatggcaggaagtgctcggagctgaacaagtcggaatccacgaccagttttttgatctgggcggccactctctcaaagcgatgaccatgctggcaaaaattcataaagctttcggagtcgaagttccgttgcaagtcctatttgaaaagccgacagtagcggcgctgagcggctttgtttctgaagccgagaaagacggattcgcggtaattgaaccggcgccggaaagtgacgattatcctctttcattggcgcagcagcgaatctatatcgtcagccagctggagggtgtcggctacaatatgccggccgcggcgatgcttgaaggcactcttgactctgggcgccttgaagctgcttttcaaaaactgattgataggcatgaggcgctgcgtacttcgtttacagttgtggatggcgagccgaggcagaccgttcatcaaagggttcagttcaagattgagaaggttaaggcggaaggcaagccgatcgaacaaatcgcgaaatcatttgtccgccgctttgatctcgccaaagctccgctgatgagagcgggtctcgtcagccttgcagacggcagacatctgctgttgttcgatatgcatcatctcgtatctgacggcgtgtcgatttcgatcatattgaatgaactggccgcgctgtataacggggaggaattgccggagctgcgtttgcattacaaagattatgccttctggcaaagggcgcaggcacaagaaggctttcaaaaagaagaggcctattgggaaagcatgtttgccggcgagcttcccgtactgcagctgatgacggacgagccgaggccgcctgttcaaagctttgaaggagacagggtatccgcagtcctgccaaaagacctgaaagaaaaattagccgtgctggcagagcaaaacggcgcgacattgtacatggtcatgctgtctgcgtacaacatgcttcttgcaaagtactccgggcaggaagatgtgatcgtcgggacgccggcggccggccgcagacattccgatctggaaggaatcatcggcatgtttgtcaatacgctggcgatccgttcaaaagtggacccgggcagaacgttcgcagacttcctgaatgatgtaaagaaaacggtaatcgatgcttttgagcatcaggattatccgtttgagcggcttgcggagaagtttggcgcatcgcgcgatttaagccgtcatcccatctttgacacgatgtttattttgcagaatgcatgggaagacattccgctgctcggcgatttgcacctctcgatttatgaaacgaacttcaatattgcaaaattcgacttgacgctgcaggcaaaagaagagcagggagaattgatactcgatttggattacagcacgaagctgtttaaaaaagatacggctgaaaggatgctgaaagcatacttgaaccttctggaggacatggcggctgatccgatgctcaggatcggcgagtacagccttttgacagaagaagaaacgaatcgccagctcgtcgcgttcaaccccgcgacaagcgattatccgcgggagaaaacgatcgttcagctattcgaggaacaggctgcagaaagaggcggttatcccgccctgcaatttgaagacaaagtatggtcatatgatgagctcaatcggaaagcgaaccaattggcaaggcgcctccgcgaaagtggcgtgcaagccggcacgacggcggccattcttacggccaggtcggctgaaatggtcatcggcattctcgctgtgctgaaagccggcggggcttatgtgccgatcgatcccgatcatccggaaaagcgtgtgcaacatttcttcaaggacagcggagcggcggttcttttaacgcaaaaggcgatgaagccgctcgctgaggcggcggaatttggcggcgacatcctatttgttgaggatgaaaacctttatatgggagatgcgtctgatttgcgccttccgatttctccggaagcaatggcaaatctaacgtacacatctggaacgacagggacgccgaagggcaatatggtctctcaccggaatattttgcgtactgtaaaaaacgcgaattacttggaagtgatggaatccgatatcgttctttcgatttcaaattatgtgttcgacgcctttatgtttgatgtgttcggttcattgctgaacggcgccaagctggtgatagctccaaaagacacgattcttgatatgagccggctcgcacatgtactcgaaaaagaaaagattacgattttaatgatcacgaccgcattattcaatctgctgacagacatgcggccggacagtttgaagggactccgcagggttctgttcggcggcgaacgtgcatctgtcgatcatgtcagaagagccctgaagacagttggcagagggcggctgcttcatatgtacggtccgtctgagagcacggtctttacaacctaccatccagtcaatgaagtgccggacgatgcgcaggctataccgatcggaaagcctgtcagcaatacggaggttctgattcttgattcattcggcaatgtacagccggcaggggttgcgggagaattatgcgtcggcggagacggccttgtccgcggctattttaaccgccctgaactgacggctgaaaagtttacggcgcatccgttcaaaaccggcgaaaagatttaccggacgggtgatatggcgagatggcttgccgacggatgcctcgaatttatcggtcggattgatcatcaggtcaaaattcgcggacagagaatcgagctgggcgaaatcgagcatcatctcctaacgcatgacatggttcaggaagccgctgttcttgctgttgacaccggggcgggagatcaaatgatctgtgcatactttacggctgatcaggagctttcgagccaagagcttcgccgacatgcggcagaaggtctgccaggctatatgatcccgtctgtgtttatgcagcttgatgagcttccgctcacaggcaatggaaagatcgacagaagggcgctgcctgaaccggatatcgcgcaggccgcgcaaaaggaatatacggcgccaaggagcggcacagaagcgcagcttgccgatctttggcaggaggtgctcaatgtaccgaaaatcggtgtgcatgacaatttttttgaactcggcggacactctttactcggaatgacgctcatcgcccgcatccagcaagagatgaatgttgacctgcagctgaaagacttgttccaggcgccgacaatcgaaagcctggcccaggcggcggcaaaatctgagaaaaaatctgccgtttatattgaagcggcgccggaccgggaaacgtaccccgtttcgtcggcgcaaaaacggctgtacgttcttcagcagattgaaggcgctgagaaaagctataacatgccggccgttctccaacttgaaggaaagcttgacctgaagcgcctggagtctgccgcgcaaatgctgatcaagcgccatgaagcgttccgcacgacgtttgaaatcaggaacggcgaacctgttcagcggatttgggaagctgcggaattgaccattgatgtcatcgatgcagatgaacaagaagcggaaaagctgattaaagagttcatcaggccgtttgatttaacaaaggctccgttatttagaatgagcatcatacgtgtcacggaagaaaaacatcttttgcttgtcgatatgcatcatatcatttcagacggcgcttccgtcagcgtgctgatcgatgagatgacaaggctttatgcgggagaggcgcttgaaccgctgaggattcagtataaagactatgctgtatggcagcagcacttgctcactgaacggcacaaaatgcaggaggaatactggctcaaggagcttgacggcgaactgcctgttttgacgctcccgacagactatccgcgtccttctgttcaaacgtttgaaggaagccgtatcagcttttctctgaaaccggagcttgtccagcagctcagaagactggccaaggaaacggaaagcactttatacatggtgctcgctgcctcatacagtacgtttttatcgaaactgagtggacagagcgaggtcattttcggctctccggctgccgggaggccgcatgcagatttgagccgtatcatcggcatgtttgtcaatacgcttgcgataagaacgcgtcctgaaggagacaagccgttttctgcattccttgaggaagtaaaagaaacgacgctcggcgcatttgagcatcaagattacccgtttgaagaactgatcgagaagctgaacatccagcgcgacatgagccgaaacccgttatttgatgccgtcttttcaatgcaaaatgccgatttgaaagacttgtcaatggaaggagtcacacttaaaccgtatgattttgcccatcagactgcgaaatttgatctgacgttgacagcggcggaagaagacggacttctcgtttttgaaatggaatacaatacagatctctttaagcgcgaatcgatcaaacgctggagcgggtactgggtcaacctgctcgaagcggttgccgaaaccccggatgcaagtctttcagacctttcgcttctggatgaagcggaaaaacggcggatcgtccaaaagtggaatgagacgaagctcgctgtgccgcaggacaaaacggtccatgagctgttcgaagcgcaagtcctccgcactcctgaccgcggggcagcggtgtacaacggcgtgaagtggacgtacaaagagctgaacgcgcgcgccaaccgtctggcccgcctgctgattgaaaaaggagccggtcctgagcagcgggtcggaatcatggtgaagccttcgctggaaatggcggccggcgtacttgcgattttgaaagcgggagcggcctatgtaccgatcgatcccggctatccggccgagcggatcggatacgtactgaaagacagcggtgcagaactgcttctgacgcaaacaaacttagccgtacctgaagaattcagcggtgaaacgcttcttctcgattcgatgctgagcgaagaaatcacaaatgatgatgaagtgaacccgcaggcaggtacacagccaaacaacctggcatacttgatttacacatcgggcacgacaggccagccgaaaggcgtcatggtcgaacatcaatcgctcgtgaacttgtgctattggcataacgatgcattcgcggtcaccgaacaggacaaaagcgcgaaatatgccggcttcggctttgacgcttccgtctgggagatgttcccgtactggatcgccggagcggagcttcatatcattgatgaagcgatccggatggacattacgcgtttgaatgaatatttcgaagagaacggaataacgatcacgttcctgccgacacagctgtgcgaacagttcatggagctcgacaaccagtcgctgcgcgtgctgcttacgggcggagacaagctgaagcggatcgaaaaacggaactacacgctcgtcaacaactatgggccgacggaaaacacagtcgttgcgacgagcacagcaatcgatcctgatgaaggcatgctttcgatcggaaagccgattgctaatacgcgggcgtatgtgcttggacaaaacaacgaagttcagcctgtcggcgtcgctggcgagctgtgcatcgccggccgcgggcttgcgcgcggctatctgaacaagccggaggaaacggcgaagcgttttacggaagacccgtttgtgccgggcgagcgcatgtaccggacaggggatgcggtcaaatggctggaagacgggcggcttgagtacatcggccggatcgaccagcaggtgaaaatccgcggcttccggatcgagctttctgaaattgaagtccagctcgcgcggctctctgaagttcaggaagcagtcgtcaccgacatcgaagacgcctacggcaacaaagcgctgtgcggctatgtcgttgcggacgaacagcttgatacagaaagcctcgcccgtaagctggggcagacgcttccggactacatggtaccggcgtattgggtgcagcttgatgagcttccggttacggcgaacggaaaagtcgaccgaagggcgctgcctcagcctgacgtcgaagcgcagacagccgaatacaaagcgccgcgcacagaaacggaacagctgttggcggacatttggcaggatgttctcggcatagaccgaatcggagtcacggacaatttcttcgcgctcggcggggactcgatcaaaggaattcaaatggcaagccgccttcagcagcacggttggaagctggagatgaaggacttgtttcagcacccgacgatcggggagctcagtgcttatgttcaagcggctgacgatcagccgatcgatcagaaccctgtcgaaggcgaagtcacactgacgccgatccagcgctggttctttgagcgcaaatttacgaacgagcatcattggaaccaatcagttatgcttcacgccccttcagggtttgacccggaagcggcaggcaaggctttaaccaagatgatcgaacaccatgatgcacttcgcatggtttatcagcgaaatggagacgggattgttcagtacaacagagggctggaagaaacagcggttcgtcctgaagtcatccgcttcaatgaatcgggtgctgaacttgaagctgccgtgttaaaggaatcaaaccggattcaaagcagtatcaatttaaccgaaggcccgcttttgaaagcggcgatctttgagacggatcaaggcgatcatcttctcatcgtcattcatcatctcgttgtggacggaatttcatggagaatcctccttgaggatttcgccgccgggtacgcccaagctgaaaaaggggagccgatcattcttcaagaaaagacgcactcttttgctgaatatgcggctcgcctgaaagaatacgcaaggtcaaaagctttcgcgaaagaaatcggctattggcaggaagtcgagaaggcggagacggcatcgctccctaaagatgatgaagcagaggacaaacggatgcaccatacgaaaacggctgagttttctctctcgaaagaagaaacagaacagttgatgacaaaagttcatgaagcatataacacggaaatgaacgacattttgcttacggcgttgggcttggcgctgaaagagtggaccgggcaggaagactttatcatctgcttggagggacacggccgggaggacatcatggaaggcttgaatatttcccggacggtcggctggtttacaagccagttcccggcgctgattcaactgcgccattccgaagatatcggctatcaaatcaaacagatcaaagaagagttgcgccacattccgaataaaggaatcggctatggcatttatcgctatttgaccgaagaaggcaaaaaggcgcagccgatcaagcatgatatcagctttaactatttgggccagtttgcagagatggcggattcgggtctgttcacgagatcagctttgccgtccggcgatccgctcagcccggaaacggaaaaaccgaatgcgctagacatcgtcggctatatcgaaaacggcattttgacaatgtcaattgcctatcattcactcgaatacaaagaaagcaccgtcgccgctgtcgccgcaagctttaaaacttatttgctgcaattgatcgatcattgcttagagctggatggaggcgaactgaccccgagcgatcttggagatgacgaactaacgcttgaagaattagataaactgatggaaattttctaacaaaaaaacgaggtgccttatggggaaacaaaagattcaaaaggtgtatcctttgacaccgatgcaggaaggaatgctgtaccacgcaatgcttgatccggaatcttcctcttacttcacacagctggagcttgtcatagacggggaatttgatttggggatctttgaaaaaagcgtgaatcagctcgtgcgttcatacgatattctcagaacggtttttgttcatcagcaattgcaaaaaccgcgccaggttgtcctggctgaacggcaggcaatagtggaatttgaggatcttgcggacttggatgaggaaaggcaaaaaacccgcattgaccggtataaacaagaggtacaggcggccgggtttaatttggcgaaagacatgctgtttaaaacggcggtctttcggcttgaccggaaaaaataccatctcgtctggagcaaccatcatatcgtgatggacggctggagcatggggatattgatgaaacgcctttttcaaaactatgaagcgtttcgagcaaaccggacggttccgcttgatcagggaaaaccgtatgcggactatattaaatggctcggccggcaggataaggatgaagcggcatcctactgggaacaccgcctttcgggtttagaaagcccgagcgtcattcccggcggaaaaacgcggccggattcaggatcgtaccggaacgaggagttcacgtttgtttgggacaaagacatggtggatgctcttcaaaaggcggcaaaccgctatcatgtcacagctcccaatctttttcaggcgatttggggaacagtgcttgctaaatataacagatccgaagatgtggtgttcggcacggttgtgtccgggcgcccgtcggaaattgacggaatcgaacatatggcagggctgttcatcaacacgatccccgtccgtttaagggtcgatcaaaacgcatcgtttgccgagttgttcaaacaagcacagcagcatgcaattgacgcggagcggtacgactatctcccgctatatgagattcagaagcaatcggcattggacggccgcttgatcagccaccttgtcgcgtttgagaactatccgcttgataaagagctggaaagcggaacgatccatgagcggctcggcttttccatcaaggctgccggagcttttgaacaaacgaattacgactttaatttgatcgtttatccgggagcggagtggacgatcaaattgaaatacaacggcgaagcttttgacgcggctttcattgagcaggccgcagggcatttaacgagacttgcagaagaggcgattgcaaatcccgaatcaaaagcaggcagcgccgacatgttatcaaaacaggagcaacaaacgctgctcgcttttaatcaaacgaaaaccggttatccaagagaaaagacgattccggagctgtttgaagaacaggttgaagcgtctcctgacaaaacggctgttgccgctgacggaagaagcctgacttaccgcaggctgaatgagaaagccaatcagctcgcgagaaggctgaaagcaagaggcttgatgcacggaaatgccgccgccattatgatggagcggtcgcttgaagcagccgtcagcatgctggcggtactgaaagcaggaggcgtgtacgtaccgatcgatcccggatatcctgaagagcggattcgcttcttgctcgaagacagcggagcaaagatcgtccttacaaaagacagcccgcagatttcgctggaagggtatgaggtactcgccgcaaatgcggtggatgcagaaaaagaagatgccgccaaccttgtacatgccaacaaacccggagatcttgcctattacatttatacatccggatcgacgggcaagccgaagggcgtgatggtcgaacaccgcaatatcgtccgccttgtcaaaaatgcgggctacatcccgctgaagagcgacgtgaagatggcgcagacgggggctgtcagctttgacgccagtacatttgaagtgttcggcgcactgctaaacgggggaaccctttatcccgtcccgaaagagacgctccttgatggaaagcggttcagagtgttcctggaagagaccggaatcacaacaatgtggctgacttcgcctctttttaatcagctcgcccagcaggatccgggaatgtttgcaaccctaaatgatctgattatcggcggagatgcccttgttcctggaatcgtcaacagagttaaacgcgaatcgccggaactctcgctttggaatggatacggacctactgaaaatacaacattttcgacgtgttttttcatcgatcaagcatatgagagaacgatcccgattggaaagccgatcggaaattcaaccgcctatatcgttgatgaacacggcgcgcttcagccgatcggcgtgcccggcgagctgtgtgtcggcggagacggggtggcccgcggctacttgaaccagcctgagctgacagatgaaaagtttgtcggcgatccttttgccgaagggaagcggatgtaccgcacgggcgacttggcaaaatggcttcccgacgggaatatcgaatttctcgggcggatcgatcatcaagtgaaggttcgcggcttccggatcgaattaggcgaggttgaagcggctttggcccgccttgagggaatttcagaagcggctgctgtcattcgggaaaacaataccggagaaaccgagatttgcgcctactacactgcagttggcgcgaggccggccgcacagctgcggacagagctgtcccggtcgcttccggagtatatgattccggctcatttgatcgaactcgacagcatgccgctgacagccaacggaaaggttgacaaacggcagctgccggctcctatcgctgaagagactgacagattcgaagcgccgaaaaatgaaacggagaaaattctggcggcaatctgggaagagattctcggcatcaagcagccgggaatcgatgacaacttcttttccatcggcggacactcgctgaaggcgatgatgctgacagccaaaatacaagagcagctccaaaaagaagtgccgatcaaagtattgtttgaaaaaccgacgatcagagagctggccgaatttcttcaaggggaaacgaaagagaaaaccgctccgattgcgccggcgccgtcccgtgcgaattatccggtgtcatccgcccaacggcgcatgtacatcctcaatcagctcgaagaagcaagcacgagctacaatgtgccggcggttctgcttctggaaggcgaattggataaggagcgtctggaagacgcgtttcgggccttgatcagccgccatgaaacattgcggacatcgttcgaattaatcgatggagaaatcgttcaaaccatccatcaagacgcagtttttcacctgacggaatcagtggcggatgaagcggaagccgaagcggcgatcagagggtttatccggccgtttcagctgaataaggcgccgctcgtccgggcggaactcgtaaagcttgaagaaaagcgccatctgctgatgatcgatatgcaccacattattacggacggaagctccaccggcatattgattcgcgacctggccagcttctaccacggtgaagaggcgcctgctcctaagctccactataaggatttcgctgtgtggcaaaacgggccggagcatcaggagaaattgaaagaacaggaacagtattggctcgatattttcaaaggcgagctgcctgttctcgatctgccgtacgattttccgcggccttcaaaacgcagctttgaaggcgaccgtgtcgtctttggaatcaatcgaaaactgacggcagacgttcaaaagctgctttctgaagccgatgcgacactttatatgttcctgttggccgcgtttaatattttgctgtccaagtatgcgtctcaggaagatttaatcgtcggatcgcctgtggccggcagaacccatccggatctgcacaacattccgggcatgtttgtcaatacgctggcgctccggaatcgtcccgaaggggaaaaaacgtttaaggaatttttgcaggaagtcaaagagacaagtcttcagggctttgccaagcaggactatccgcttgaagaactgattgaaaaactgccattgccgcgggatacaagccggaatccgctgttcagcgtctttttcaacatgcagaacatggaaatcccgacgctgaaactcggagatttgcagatttcgtcttactcggtgcgccatcgcacagcgaagtttgatctgtcgcttgaggccgtggagcatgatggggaaatcggtttgagctttgactatgccgtatccttatttaaagaagaaacgatcaggcgctggagcggccacttcttaaatgtgattaaaacaatctgcgaaaatcccggcattaagctccgggacatcgaactgctttcagacaaagagcgcggacttctcctggaagaagtgaggcgcagccgggcagaacgcctagaggagcggccgtttcatgtacggtttgaagaaaaggcggccgaaatgcctgatcagccggctgttgtctgcggggaaacaatcctcacataccgcgggctagatgaaagagcaaatcaaattgcaaatgtgctgcgaagtgaaggcatcggaaaagacgacgttgtcggcattatgctggatcgttctgcagaggtcgccgcggcaattctcggcgtaatgaaatcagggggcgcttttttgccgattgatccggaaatgccgacgagcaggattcaatatatgctggaagacagcaaagcccgctggctcttaacagaacattcccatcaagctgctctcgcagattggtataacgggagattgatagatgtgagaaacgacacgctgatggcaagcaaaaaacgaccgcatctaatccatgacggggcgagtctggcgtacatcatctatacatccggaacgacgggtcagccgaaaggcgttcagctggaacaccgcaatctggcaaactatgtttcctggtttatcagtgaggcgcgcctgtcagcttcggataaaacgatgcttttgtcttcctatgcgttcgatctcggctacacgagccttttcccggtgctgctcgccggaggagagctccatatcgtccggaaagaaacgtatacagaaccggagacatttattcattatatcggtgaacaagggatcacatatatcaagctgacgccgtcgctgttccatacggtcgttcagccgcaaagcttcgctttggcaaaggggcttcagtcattgagactgattgtactagggggagaaaaaatcaatccgaaagatgtcgaacggttccattcccgctatccggacacccggttcatcaatcattacgggccgacggaaacgacgatcggtgccatcgctaaaccggtcgaaccgggcatgatccggcaattcgccgagcgcccgacgattggacggccgatttcgggcgccggagcactggtattggacgcttcccgccggcttgttcccgcgggagcggcaggcgagctgtatattacgggaagcgggcttgcaagaggatatgtgaacaaccgggaacttacggctgcgaagtttatcgaaaatccttacacaccgggcacattcatgtaccggacgggggatctcgtccgccgtcttccgaatggggagattgaatttttagggcggacggatgatcaggtgaaaatccgcggctacagaatcgaattgaaagaaattgaagaggccttcattggacttgaacatatagagagagcggtcgttctttcatttacggctgactcagggctagacgaactgtgcgcttatattcaagcgaaacgacagctgccggtttccgaaatgagagagcgtctttctgagcggcttccgtcgtacatgatcccgtcatatttcgtaacggtggataaaatgccgcttgcggcgaacggaaaagtggaccgcagcgcgctgccggagccgcaaggtctaagtggtcaaagcgattcatatagagcgccgtcaaccgaatttgaaaaagccctctgcggcatttgggaggaggtgcttggcgttcggccggtcggacttgacgacaatttcttcgatcttggcggacattcattaaaaggaatgatgctgacagcggaaatccaatccaagctcggaaaaaaagtaccgttaaaaacgttgttcgattgtccgacagccggcttgctcgcccgcagtatcgaagccgatggacaggcagaacaaagcgggattcagcctgccgaaaaacgcgactggtatcccgtttcatccgctcagcaacggatgtatgccctccatcatattgaaaagaacggaacgggctacaacatgccgtctgttctcatgctggaaggcgtacttgatacggatcgcttaagacgggcattcgcagacttggtgaaccgccatgaatcattgcggaccgcattcgttgaaatcgatggccgcaccgttcaaattgtgcatgaaaaagcggacattgacttaaaggttattcatattcatgaagaggacgcagaagcacagatcaaccgctttatcagaccatttgatctcagcaccgctccgctgatcagagccgagctgctctccatcagctctgcgcgccatctgcttttgattgatacgcatcatattattgcggacggcgtttccagaagccttttcgtcaaagaaattgcacagctttataaaggcgcttcgctccctgaaccgaagctgcattataaagattatgcggtgtggcagcaacaacctgaccagcaagaaaacattcggaaacaggaagacttctggctccggcagtttaaggaaaccgttccggaactcagccttccgctcgactttccgcgtcctcctgtccaaagctttgccggggaccgggttcactttaaagtatcaaaaggcaccgcccttaaaatccgccgtttgatggcgaaaacgaacacgacgctgaatattgtaatgctcgccgtttttaatctgtttttaagccgtcttgccggccaaaaggatattgtcgtcggctcagcggcagcgggcagaacgaatgctgatttgaaagacgtgccggggatgttcgtcaactcgttggcgctgaaaaaccatgtacctgatcaagcatcattcagcgggtttttggaagaggtgaaaaacaacagcctcgcagccctcgaccatcaggactatccgtttgaagagctgattgccaagcttgatttgccgcgcgatatgagccggaatccgctgttcaatgtcatgctgacaacggaagatcctgataaagaaacgctcgatttagacggtctgataatcaagccgtatgagacttcacatgccgctgccaagttcgacctgacactgggggcttttgaaaaagatgatgaaatcggtcttcagttcgaatatgcaacagatttatttaaaaaacaaacgattgaacgctggagcggatatttgcttaacctgctcgaagcgattgccgaaaacccggatgcaagcctttcagacctttcgcttctggatgaagccgataaacggcggatcttgtacgaatggaacgaaacagttctcgacgtgccgcagaacaaaacagtccatgagctgttcgaagcgcaagtcctccgcacgcctgaccgcggggcagcggtgtacaacggcgtgcagtggacgtacaaagagctgaatgcgcgcgccaaccgtctggcccggctgctgatcgaaaaaggggccggccctgaacagcgggttgggatcatggtgaagccttcgctggaaatggcggccggcgtgctcgcgattttgaaagcgggagcggcctatgtaccgatcgaccccggctatccggccgagcggatcggatacgtactgaaagacagcggtgcagaactgcttctgacgcaaagcggattaacgatgccggacgcatttaccggagaagtgatcgatttgaatagagaagcctccattctggccggcgagctttatcccgaggatgacatcaatccaagcgcagaggctcagtctgacaacctggcatacttgatttacacatcgggcacgacaggccagccgaaaggcgtcatggtcgaacatcaatcgctcgtgaacttgtgctattggcataacgatgcattcacggtcaccgaacaggacaaaagcgcgaaatatgccggcttcggctttgacgcttccgtctgggagatgttcccgtactggatcgccggagcggagcttcatatcatcgatgaagcgatccggatggacattacgcgtttgaatgaatatttcgaagagaacgggattacgatcacgttcctgccgacacagttgtgcgaacagttcatggagctcgacaaccagtcgctgcgcgtgctgcttactggcggagacaagctgaagcggatcgaaaaacggaactacacgctcgtcaacaactatgggccgacggaaaacacagtcgttgcgacgagcacagcaatcgatcctgatgaaggcatgctttcgatcggaaagccgattgccaatacgcgggcgtatgtgcttggacaaaacaacgaagttcagcctgtcggcgtcgctggcgagctgtgcatcgccggccgcgggcttgcgcgcggctatctgaacaagccggaggaaacggcgaagcgttttacggaagacccgtttgtgccgggcgagcgcatgtaccggacaggggatgcggtcaaatggctggaagacgggcggcttgagtacatcggccggatcgaccagcaggtgaaaatccgcggcttccggatcgagctttctgaaattgaagtccagctcgcgcggctctctgaagttcaggaagcagtcgtcaccgacatcgaagacgcctacggcaacaaagcgctgtgcggctatgtcgttgcggacgaacagcttgatacagaaagcctcgcccgtaagctggggcagacgcttccggactacatggtaccggcgtattgggtgcagcttgatgagcttccggttacggcgaacggaaaagtcgaccgaagggcgctgcctcagcctgacgtcgaagcgcagacagctgaatacaaagcgccgcgcacagaaacggaacagctgttggcagacatttggcaggatgttctcggcatagaccgaatcggagtcacggacaatttcttcgcgctcggcggggactcgatcaaaggaattcaaatggcaagccggcttcagcagcacgggtggaagctggagatgaaggacttgtttcagcacccgacgatcggggagctcagttcttatgttcaagccgctgacgctaaaccgatcgatcaaggccctgtcgaaggcgaagtcacactgacgccgatccagcgctggttcttcgaacggaaatttacgaacgagcatcactggaatcagtcggtcatgcttcacgccccttcagggtttgacccggagctcgtcgaacagacattggcggcattgacagagcatcatgatgcacttcgcatggtgtatcaaaagaataacggccgcctcattcaatataaccgcgggccggatgaccgttcgttcgcctttcgagtggttgacctgcgatatgtcaccgacattgaaacggaaatagccgctcaagcaaaccgccttcaggcaagccttgatcttgaaaacgggccgcttgtaaaggctgaacagtatcagactgcggaaggcgaccatttgctgatcgtcattcaccatttggtgatcgacggcgtgtcatggcggattctgctggaagactttgcatcaggctattcgcaggccgcacagcagcatgatgttgttttccctgataaaaccaattcgtttaaagactgggccgaagcgcttgaggcttatgcgcaaaccgaacgcttccttaaaacggccgattattggcgcagacttgaacaagagcgtatttgtgagctgccgaaagatcgtgctgccgcagaaagaaaagcggaaaacacctctgctgttaagtttgaattaagcgaagcggagactcgtctgctgctgacgaaagtgcatgagccgtatggaacggatatcaacgatatcctgctttccgctctcagcctgacgatcagggaatggacgaacggctccaatatttgcatcaatatggaaggccacggcagggaggaaatcattccagggatgaacatttcgagaacgacggggtggtttaccgcacaatatccagttgttttaaaaagccaagcagcggcagggttgcctgagaccattaaaaacgtcaaagaaaccctccggcgcattcctgacaaaggaatcggctacggcatccttcgctacttaacagaccggaaaaaagccggtgcaattttctcgatcaagcctgacatcagctttaactacctgggacagatcgacagggaggtgcagaccggcttctttgggccttctccttatgatatgggaagacaggtctctgaaaggtctgaagcactctatgcactgagcttcagcggcatcatcagcaaggaaaaattcatcttgtcatgttcattcaatacagaggaatatgacaggcagaccatacaggagctcatggacagattcaaagctttcctgacagcattgatcgaccattgtacagctaaagaagaacgcgaatttacaccgagtgatttttctgccggcgatcttgagatggaagaaatgggcgacctgtttgacgttcttgaagaaaacttgaaataaccaccgaggacttgcccgcttgtcaagcgggcgagcctatgaaagggggatacgatcttgagccagtttaaaaaagaacatgtccaagacatatactatttgtcaccgatgcaggaagggatgctgtttcatacgctgctgcatccggggcaaggcttttatattgaacaaatcagcatgcaggtgaaaggctcttttcaaaaggatgtattggaaaaaagcatgaatgtcatcatcggcaggtatgatatattccgaaccgttttcgttcatgaaaaaatgaaacgtccggttcaagtcgttttaaaggaaaggtcatttcaggcagaagaaattgatctatcaggactttctgaagcagaacaaaatgagagaattgaagattataaacgaaaagataaagaaaaaggatttaacctctcaaaagacattccgatgagaacggcggtttttaagaaggggcaggatcgttacgaatgggtgtggagctatcatcatattctgcttgacggatggtgcttcggcattgtcgtacaggagctgttcgaagtatacaacgcgctccgtgaaaacaggccatacagcctcgggcctgtcagaccttacaaagaatatattaaatggctcgaaagccaggacaaacaaaaatcgctggtctactgggaacatcatttagccggattcgaagggcagacgacattcagcgaacagcggaaaaacccggagcaagccggcaatcagccggaagaactgctgtttacacttccaaaagaagatacagaagcgttcacacagctagcaaaagcgcatcataccacgttgagcacggcgcttcaggcggtgtggtcggtgctgctcagccgctatcagcgatcccgcgatctgatcttcggtacagttgtttcaggccgccccgctgacattcaaggtgtcgagcacatggtcggtttgtttatcaatgtcgtcccgaaacgggcgacctttggcccgcaaacgacctttacggagctggtcgctgatttgcagaagcaggcgctcgaagctgaaccgcatcaatatgtgccgctctatgaaattcaaagtcatatagcagcgccgaacttaatcgaccatattatcgtttttgaaaattacccgctgcaagaagccaataaacagcagaaagaaaaaaatctcggcttcacaatggacgagatcagcgtttttgaaaaatcgaattatgatctgaatttgcttgcttcaccgggtgaagaaatgatgctgaaacttgcatacaaccggaatatattcgaaccatctttcatcttgcggttaaaagaacagcttttgacagccattcgcgaggtcatcagagatccggagcagccgcttgacgacatttgtgtcgtttccaaaaaggaaaaagagcgacttctccatgaatttaacggtcaagtccaacggaagcaaatcggcctgacgattccccaatggtttgagcaatacgctgaagcgctcccggaaaagcccgcggtatcagcggccgggcggacgctgacatatcgggaattgaacgaaaaggcgaacaaggtcgcgcaccttttgcgcaaaaagaacgtcggccgcggcgagcccgtcgcccttttgttccgccgttcgccggaaatggtcatcgcgatactcgccgtcttaaaagcagggggcgcctatctgccgattgacccggaatatcctgaagcacggattcagtatatgctggaagacagcggggctgtttgcatgctgacacaggaagagcttgccggccgggcggcgtcgctttcttttcataagcatacgatcctgatcgacgatcctgctgtgtctgcagaaagcgggagaaacctcgaaatcgccgccgagccggacgaccttgcttatattatgtatacgtctggcacaacgggaaaaccgaaaggcaatctgacgacacatgccaatattacaagggttgtaaaagagacaaactacatcagcctttccgagaaagacaccttgctgtccctttcaaactatgcgtttgacggcttcacatttgatctgtacggcgcgctgttaaacggagcaaagctggtggtggccgatcaggcgacgattctccatatcggcaagctgacagaagcgattcagaaggaaaacatcacagtcatgtttgtgacaacggcgctgttcaacttgctggttgatgcgggaacagggtggatgaaagggattcgcaaagtcctgttcggcggagagcgctcatctgtcagccatgtcaagaaagcatttgctgccatgggaccggacaggatcatccatgtatacgggccgacggaaacgaccgtcttcgcgacgttctatccggtcaaccgtatggaagacagcgcggtttccattccgatcggcaagccgataaacgaaacgaatgcatacatcctgacggaaaataaccggcttcagccgattggagcggtgggtgaattgtgtctgagcggtacaggagtatcgcgcggctatttgaacaggccggaactgactgcggaaaaattcgcgccgcatccgtttaacagcggtgaaacgatgtacaggacgggagatctggcccgctggctgccggacggcaatatcgacttcatcgggcggatcgatgatcaagtgaaaatccgcggacaccggattgagctcggtgaaatcgaagagcagctgatgcgctgccaaggcgtaaaggaagccgttgtaaccgccaggaaaagcgggaacggggatgcggcgctcaccgcttatgtcgtcccggtgcagggaactgaggttgcaaacgaggaggttcgccgccaattggcgcggaggctaccggcttacatggtgccggctgcgtatatcatgcttgaagagctgccgcttaccgctaacggaaaagtcaaccgacgccttctccctgaagccgatggccggccgaattcaacagagcgccgtgcaccccgcaatgctacggaagaaaagcttgcagtgatttggtctgaggttctcggcagacagcagatcggaatagacgagaacttttttgaaatcgggggacattcattgaaagccatggccgtcgcctcccggatgctgaaagatctcgcaatcgatgttccggtgaatgtgttgtttgaaatgcccacaatcgagggcctcgcggcttatatcgaccaaggcggccatgtggatgaagtgaaaaaaaccgtcttcaatcaggcaagcacccgccatttgttcgctttcccgcctgtcctcggatacggcatcatgtacggcaagctggccgaacaaatgccggaatacaggattcacgcgttcgactttatagaaagcgatgaccgcgctgtgcgctatgcagaagccatctccgaccttcagcctgaagggccgctgacattgatcggctattcagccggctgcggacttgcctttgaagtggcgcaagcgctcgaaaagaacggacggaaggtcgaaaagctgctgatgatcgactcatatatgaagaacgatgtcagcgatttagaagggcggtcaattgaagccgatacggccgccttgatggaagccaacaaggacaatgaatatatgaaaatcaagacggttgccgatggcatcgctaaaaagatgacagcctattattcttactttgtcaatcttgtccatcaaggaacggtcagctcggagattcatttgatcaaatcagagcacgcaaaaccgctcccggcatggctttcgttgtggaaagaaggaacggagtcttcatatgatgaatatcaaggcgctggaagacatgatgaaatgcttgcggacggctttgttaaaagcaacgcagatctcatcagacagattttgggcgaacgtgccgctgtaatcggaggtgcatgatgcatgaacgagatcattaagcagtttggagcgccggcaagcggtatgcagttgatctgtttcccgtttgccgggggatattcggcatcattcagaccgcttcacgaacatttaaaaacagattttgatatgctggcgatcgaaccgcctggacacggcacaaatcgaatggcgcttgtcgacaatttggaaaagctcgccgatttgtatatagcggcgcttaagccgcggctttcctctcaattcgtgctgttcggccacagtatgggcggcatggttgtttacaggctggcgcaaaagcttgaacaagaagggatctttccggcagccgctgtgatatcagcgatacagccgccccatattcagcggcaaaaggtgtctcaccaaaaggatgacgcatttctcgaccatctcattcagcttggcggaatacccaaagaactggcagagcacagggaaatgatgaactttttcctgccttcgttcagagcggactacagagcgcttgagacgttctgccataccgatcatacgccgcttagatcgcctgtgcatattctgaacggagaccgcgatgagaaatgcatgagggatgcgcttggctggaaaaagtgggcgaatacgatcgatttccactatttcaaaggcggacatatgtatcttttatcagaaacggaacaagtagccgccaagttgaaaacgattgccgcggccagccgcagtacggctgttccgacaatgtaaagaaagcggaaaatcggtgtgctgcagctgccgattttccgttttttcagctttttttcagccgattttcccgccgaaccatcgtcgccccaataattccggcaatgatcatccccgttccggcgaagtgaaaccattcgagtgattctcccagccatataatccccgccaaaatcgtcaccagtgtcgccaagtgattaaacatgctgattttcgcagcttctatttttgacagtgcataatttgataaaaatgatgtcgcaaacgatgacaacacgcctaaatacaataccgaaagaacaaacaccggatcagtgaagggggcaaaaaatccgctcagcgtgccgtctgacatatggctgattccggcgatgccgttgaaaaaaagaaatcccgctcccgttgtgacatatgttaattcaagcgagctgaaggttcgcgtcatctttctggcgagcacgctgtagcccgccgatgaaagcgccgaaagcaaaatcagcgccgcccctcttaaatcggaacttccggtgcctgcacttttcatcataaagatgcaggccacccccgccgctgacaagacggtaaaaaagaattgccgtttcgtaaaccgctcatttaaaaaataagcggcgaatatcatggtgaaaatcgggatcgccgcttgaatgattccggcttcagacgaagacgtgtagacgagcccgaaaacttgaaaagcaaaaaacatgacagggtaaaataatgctaaaggcagcactttcagtgcgtcttttatgctgatggcgatcttcacccatccgagcagaaggggaataagcgcagccaaaaaagcgaccgtaaagcgatgggccagaatgtcgaccggactcgctgcagtgagagccaatttgacaaagaaaaaggaaaatccaatgataaaagcatagagcaaagctgccgcataagcagatttgttcaaagtcgatcatctccgttaaagtatgcatgcaatacagatattttaccggcttctgtcatcttatacggaagcgaaatctgatacaatacaaaaaaacggaatctgtaccgttacagattggcgaaggagacgaacatgcacaaatatgtcgcactgatgaacgaattggaggatatgatcgaagacaaatcctttcaggaaggggacaggctgccttccatccgcgcgctggccatacgtttcaaggtaagcaaaagcacggtcatcagggcgttgaacgagctggaaagacggcacctcatctattcagtgccgaaaagcggctattacgtcgtgaaaaaaacgaatcagcggcccaactccggaaaggctgtaatcgatttcgcagcatccgctcctgatccggatgtttttccatacatcgattttcagcattgcatcaataaagccatcgatacatacaaaaacgatctgtttatttatgggacgccgaaaggtctgccgtcgttaatccaagccgttcagaaagagctcgcaaacagccaggtgtttgcaaaagaggaacacatatttattacatcaggcgtccagcaggccctcgccttgctcgcttcaatgccttttccaaaccggaagcggaaagttctgatcgaacagccgagctatcatttattgattaaataccttgaagttcacggcatccccgcggtcggcatcgagagaaccgccgaaggcatcgatatggacgagctggagcgcatctttcaaaccgaagatatcaaatttttttatacgatgccgagattccacaatccgctcgggacatcctacacggaacgggaaaaaacggccatcgtcaagctggcggagaaatatgacgtctatattgccgaggatgattttttaggagatttggagaatgataaaaaggcggatccgttacattactatgacatttcttcccacgttatttatttgaaaagtttctcaaagattatttttccgggtctgcgggtcggagccgccgtgctgcccgattctctgacaattgtgttcaaccggtacaaacagctgctcgacattgacagttccatgctgtctcaggccgctttggagatctatttgaagagcgggatgtttgaaaagcataagcaaaagatccgttcttcctatcaaaaaagatcatgccttctgcatgatctgctaaaagaatgttccgcgtctctaggggatgtgtttgaatttcatcctcccgcacagccggctatccacacccatattgaattggaccggacgatcccggcatcccgtctgattaaaagcctacaaaaacgggacgtcctgctcgaaccggtcaacgctcattatatgccggcttttccaaaaagaaatctattgaaaatcaatacgtccaatgtgaaggaagaggacatccgcagcggcatcgagcggttgcggcaagcggtggaaaccgcttatttttagggcgggactttttaaagcattgacagttcagcgcagcttttcatcacaatccggccgggaaattcaggtgcggcggaacacaccgccattttatagccggggtcaatttcataggcttgtatatagcaaggcggatagccggggggagtttccaccgaagctcgcccctgttcgttcagtttgacggagaaggaatcaagcggcagagacaggccttttcccgcctgtttaataaagctttctttcatcgtccacaaatgatagaaatacgacaggcgttctgattcgtccttttccatgagatcatcgtgctcggaaggtgaaaaaaaccgtttggcaatgtcgaaattgatcggcttgatcttttcgacatccactccgatcggctgcgcgccggctccgcacacgatccattttccggagtgggaaatgttgaaatgaaagtcgttcagaccttcagcagccggtttgccgtaccttccttctgtaaaacggatctgctcattcggcaaatgaaacgtttcgctgatgatgtgcctcgccagcacttctccgatcagcgtccggctggcatcttcgggatatctgtatctgcccactttttttcgcttttcttcagacaccatggccatcattcggttaaattgaccggcttccggcagctgatccatataaacggcgtaaatcttcatcaaacgcaacctcttcacatgatatttttctgctttcattttagcaaacagacagcaggaaagataggcatgatacttgtgcagaatggagtaatgaacatgatagacggaacattgataaaagatacatgcttcgggagggagcttttgatctatcttcctccttcatacgggagcggtgaaaaccgctatcccgttctatacgtccatgacctgggagatttattcgatccggcatacagcaacagtctgcgctcaatcgaaaagctgttttcgagtcaggaagtgccggaattgctgctggtcggagtggctccaaaagacagggaaagcgaatacacgccttttcccaagcggcatttgctgccgaataaacgggagtacggcgggaagggcaacgaatatgccgcttttttggccaatcggctcaagcctcatatcgaccggcactaccgaacaaatccgagccgtgaacaaacaggaatcatcggaaagtcgttcggagggttgatctcggtttacacagcttttctagcatcggagacctttggaaaaatcggatctttgtcaggttctttctggtttgaaggaataaccgagtttatgaagaataaccgctttgagaataagcatctgcgcatttatatggatgtcggaagcacggaagggacagacagggataatctgcagaaagagatgataccgaggacaaaggaagccttcagcctgttaacagaaagcgccgcctccgaaaaagaactgaaatttgtcattgatgaaggtggctcacatcggcttgagcggtttgcgaagcgttttccggaagccgttaaatggctgtttggctcctgtcacaacagcgcacggaatggcaggagtttctgattggcatgaagtatcgttgtaaacgagaggcgcggaagcaatggacattctgaatcgtttggctgaaaaacatcgattatattgaaaagcactggatcagccgctgaaacacgaagacatcgccaaaatcgcatattgttcgaaatttcattatcagcggatgatctacatgctgacgggtgtcacctttgccgattacattcggaaaagaaggctgacagccgccgcgcaggagctgactgcaagtggttgatgctgcttttaaatacggctacagcacaccggaatcattatcgggaggccttcagccgccttcacggcatcagcccttcacaggcccgagaaaaaggcggacgctcagggcatttccacgtctatcctttcatattcaaataaagggagtggaggatatggattacaagattgttgaaaaagaaccgtttcaggtgatcggcaaagcgttggaggttacggtcaaggatggtcaaaacaaaaaggatattccggctttttggaacgaattaaatcacaacggctttaccgattctttaaaaccgcacatcggcccgcttggcttccttggcgtctgcatggattttaacgatcaacccgatacgttcaatttttgaaaaaaataccgcttacacgcctgccggctgtgtcgaaaaaacgattcccgccgcaacttgggccgtctttgaggccatcggccccgtcaatccggctggtcaagccacatgggaaaggatcttctcagaatgttttccggcgactggctatgaactggcgaacgagccgcaatttgaagcctatcctgaggacggggatattatggcgcaagatcatatcaccgaaatttggataccggtggtaagcagaaataatcctgaactagaaaaacggatgaaacgctcatccgttttttttcagcgacatatgtacaggcttggcagctctgatgcgccttcctgccattgctgcttttaaaagctgtttggactgcggcaaagaaaaccgcaaaatcaggccggttaaaatggcggttaaaacagtaccgatgccgatcggcccgccgagcagccagccgatcaataaaatcgtcagctccattccgtttcggacccactgaacgttccagcccgttttctcggaaatcaaaagcatcagggagtcacgcggacccgcaccgagatcggccgatacataaatgccgactccgtaaccgataaaaataacgccgatcacgaatacgacagtgcttgaaatatacgtttccgggtctggaagaatataagtaaagaaatctataaaaataccgattaacagcatattgagcacggcgccgattttcggccatgcttttgtaaataaggacgttaaacctacgatgaccgccccgacaataatcgcccattggccgaccgtaaggcccaaaagcatatacagcccgtagtgaaacgcatcccaaggaccgatgccgagcactttcccttcaatcgtaagagaaaccccgaaagacaaaacaatcaatccgacaaaataaaaaagccagcgcaaaacaagttcccgcttcaatggattcccctcttttcaaaaaaacaatcaattgtcattgtatcatattcttcagtggggtgatatccaaaaaatgttttattttgtgtaatacttgtaccaaactttattaaaataacaattgactaaaagatatttccattttataaaattaatgtataatatttactagtaggtgatctttatagggatagttgcttaaaaggtatatagactttaatggatttgggatcattctaaaaaaggagagtaaacatgaagaaactttatattagtgctgtcctgggtttattgtttgtttttgttggtggaacaaaaatacatgctcaagaaccacagaacaataacggggttttggatgagaataaattcattgatgaaacagtgtattcatatacgcagccaattagcatacaggatggtgaagtaacaacacaagcgaaaaaatatatcaaaaccgtgtcagttaataggagctataaaagtcttttaaacattgtagttgccagacattactctgatactactttcacttacggaagcggtaagttatataagagtcccagagctttaagtaatgattggtggacacttcctccgaattttaaatcaggaagctctaaaagctgggactggtacaatacagggaaaggtgcaacaggacgttctaatttacaagtaagatacacttggggagttccaacaccatgggggccagttggatctaattatagctcaagaataaaggtttcatttaaatcaaatggcagttggtatacaaattaaagctatatatgaaaggtgacataccgatgggtacaatagggataaactttaaaaacattcaacatcaatatcgtaccaaggatgtgctaaggggggtgagtttccatgccgatccctcctccatcacgttcttggcaggcgagaatggagccggaaagacaactttgataaaggttgctctcggcttaatcagtccgaaggcaggaaatgcgctgttcgacgggcaaagcgtcggggaaatccgggagaagatcagctgcgtgtttgatgagcctcctgtttatcctaatgaaagtggtcttgacaatctaaagtttttatcaggtatacacagccttgatcgaaagtggagtcaggaggtttgtgccatgctcaaattggatgagggacttttaaaacaaaaagcaaaagcgctatcactgggtcaaagacaccgtttagctgtagcggccgcgttattgcgcaaacctaaatatttgtttcttgatgagccgtcaatcggcctcgacccaccgtcatggcagctggtccaaatcgctttaaaacagatgactgccagggatgtgcaattttgattacggggcaaaattatgacgcgattgaaatctcgctgacaatatagcgattttgcaaagtggaaaaattatcttctccggtcctattgtaaaacttgttcaagcatttcccgtatatgttcgaattgtaactgatgaccatcgggaaatagctgtgcagtttccagaagctgaacctgattcttccggaatataccgcatcgtttgcgaatcaggtgaacaggcccgcgccgtgattgatcaggtgaggagaagcaccctgaattttcaagagctatcgactgaaaaagcgtcaatggggaaaatggtgacagatatttacaaggatggatttcagtcggaaaagagagggttaacgtatgaatccgttcaaaattgaaacgaatcaattgaagaatagcatgcttgtgagggtttgtatcgcgttattattttgttgctttatctgggggcttctcactttatatcaaagcgctgaaggcgaggaacgcagacaggaaaagattcaccaatccgtcattgatgaagtgaaaaagaatggggcggaggaagagcttgaaaacggcggattggagattgaaaaaaatgatgatatagcgcgtagtatgtacataggacttcatccaagtgttactcctaatctgtttttattaatcctcgcgaacattgggccaattgtttttattataatcggatctcaccttgtcggaagcgaataccatcaggggactgtgaaaatgaaagccgctcacatcggatggagaaaagcggtttctggaaaactatgcgcactgttaagtctggttattgttatggttattgcagctttattgcttggactggcaggcggttggctggcttggacgttcgccacggcacattcagacttagccgcttctcttgaagtgaatgcagctgtctcctatccgatattaattttgtttttaatgatcggattgacattttacagtgttctaggaatgactgtcacgctgttgacgaaaagccggctggcgggtgtgctgatcagcttggcgatcccgtatgctgagcaaatgatgagtctgccttttttgccattgactgcttatcaatccctcatggttcaccattttatttatgtcgacggaagcatcatcggccagccctatttgacagagccgatgggcgaaccgggcgcttgggctgttcttgtatgctggctctttgttgtcattgcggttcagcagtttgcagcgaaaaaacagcagattttatgaaaaaaggggggaatggcgttgatttttttagttaggctgatctgtcttgcctttttagcctgtctggcgctgttgttttatgcaccttttctggcgatgcccgtttggatcgctttgatcattgccttaatcgtctgtctgtatcttgcctttatagaggaaatgaaggaatggagaagacgaaagcactaatcctttcttcagcgttttttcttgtataaaagaacgtttgctaaaacgaaatagatgacggccgtcccggacacaaacaaaaaaattctttccactctaatgccgtcatgtatgcgaagcggaggagttcgagatgttcatccaagtaataagcctgggtatatgcgccgactgtcatgccgataaaggcgaatagaccgaccacattgagcaccattctcatactgaatgtctttttctctttttctctttttcgtggttcattttaaagaaatcctttccaatatgaatttattatcattctattgtacgaatacaacgcttggatgattcaaaaacttcttaatctattgttaagaagtttttttattttggagaaaatgtaaaagataaaacaatttcatgaactttttgagcgaaggcctaaaaatataggaatattataccgatatggcaagtgaaatctttttctgaaatataaaagacaaggcaggagagaaaatcatgcagcaacgcaatacaccggatgtacagagatggtttccgagcgaggacggaaatgaagcaaaacgaaacgagttcctatcattgatcgagcagctgatcgagggagtggacaacctgaaaaatccggatcaggtcaaccttggcggcgagaagaaccgagagggcttcttttatgaaaagctggttgcagagagtcggattccgcatgaaggtgcgccgatgaaagaggttaacgaagagctgttgaagctgttgcacggccatccgtatcacaccaaatactttttcacgaacattctgccgatggccagcatcccggggatattaggcatgcttacggcgtttatggtcaatggcaacaacctgtgggatgtgtacggtccagccggagcggaggcggaagtgaaggttacagcgatgatgtcaaagcttgctgggtatgatgccgaaacaagcggaggatatacaacgtggggaggacaaggggcggtatacagcggcctcagaatcgcgattgccaaaatggctccgtcatccctaaaagaaggggttcccggcaatttctatgcgttttgttctgaagcggctcattacagcttgtataagtcgatggaagccgcaggactcggcagcgatcatttaattaaagtcaaaacaaatctcgaccattccatggatacggaagatttgcgagagaagcttagacaagtatgcgaagccgggggcattcccgtctatatcgtagccacgacgggaacgacagatgcgatcggcatcgatgatgtgagcgctgtccgccgtgcggctgaagaaaccgcgaagagcttcgggctgccggttccgcatatccacgccgattccgccctgggaggattttttgccttttttaatgagtacgatctgaatgagaacgctttatccttcagtcccggtgtcctcagcatgatcaaaccgattcaggaaaaaatgaggcatctgcatgctgccgattcgctttgctttgattttcagaagctcgggcagacgccttatgtgacgagcctgtttcttgtgaaggatcgcaatgacttaaaacggatcgatctggatcccgatgagacgccgtatgtcggccaccgcggctatggggactaccatacgggctacacgctggaatgttcgcgcatggccagttcgatcagtatgtacagcgcattgatggcatttggctatgaaggctatcaaaagctgcttgcccagttccttgaagtcaacctgcattttagggaacagctgtctcggcagattccggaggccgatattgtgaacccggacaactgcggcatgtctacgctgtttcgcatttatcctgaaggggcgcctagatttgaagacgaaatttcgggagcatgcaccattgaagagctggaaagaaacaatgcgcttactgaaaaattatttgaaaagctcggaacaaaaagggacaagatgttttttggcgatacgaaaaaacacttgcttgtgaagtcctgtgaaggggttgaattaccgctttgcgtcagcaaatttttcgtcatttctccgtataccatgcctgaacatgtcccgggaattatcgattatttaaaagaaactattgaggaagtcttccgggagcatgggtctctcatgacaaattaaaggggatatagacgatgaaaacgttgaagaaaaagctaacagaacacatttcagtcaaaattatgattggcgtcgccttagtgcttttaatcacgatcgcatcattttcagccgtgtttacttttatcagcaaagacttgtcagagcagctgaaacagcagttccaaaaccgcctttataccgatattcatcttgctgaaaatcaaatcaaacgtctggacgggaatccgcttgagatcgattccgcagacggtccgctttacaagcagacaaaaatggctgtggacagcctgaaaaagaaaaacaaacttgagaatatttatatcctttccaatgaaggcgggaaggagcggattctcgtgctgtcggatacgcccgatgatttcggcacggattacagcttttctcctgaaatgaaagaagccttgacgacaaacaaagagacggtaagcgacgtgtatgaggacgaatacggcatccaccagtcgatttttctgccgcttgagaacggctcaggagaaaaggtgggaattttggggatcgaccttgatgcttccgtgattccggagacagcggcaaaagcgaaatggtatacaattgcgatctcagcatttgtcttgctgctcggaatggtcatggcctattttctcggttcttacatcgcgaagccgatcaggcagctgatgaaggcttcagaaaaaattgccgacggcgatctatcggccgacatttctgtcaagagccgggacgaagcaggaaagcttgccgaatcgttcaagcggatgagcgaaaatttacaacaattgattggacatatttcagcttcctctgaagaggtatccaagacgagcctgcagctgaaaaatgtatcggctgaatcgagcgaaagcgcagctcaagtggctgaatcgatgaacagcatgagcgagggaatcaacgaggttgtctcttcagtttcggattgtcatacatcggctgccgaaatcgatcagcagcttacacatgtcacagaaaaagtgaacgagatgaagaacgttgccgagggcgtcagcaaggattccaagacggggcaggagcttgtcgaagaaacattgcggcagacccagacgattaaaaacgtgatggaagagtcaaaacaagcggcatcagagatgcaaaaccatacagaagaaattgaaaaagtcatcggaatgatttcctctattgctgaacagacgaatttgctggcgctcaatgcttccattgaagccgcccgggtcggtgaggaaggccagggctttgcggttgttgccggagaagtcagaaagctttctgaacgttcggcagatgccgctttatccgtttcccagcttgtggcgggcacgcaggagagcagccggcttgtcatggaacgcattcaggaaggaaacgaagcggttgacaaagggcagattttaatcaatggcacatacgagaatttttcaggaatttttaaaggaatttctcaattcgccgaacgcacagatcaattgcttcagtccttgttaaaagtcgaaaaatcgtatcaaaccatttcgtctgcgatggagcagatttccgccgttaccgaagagcaggcggcaggctctgaagaagtcgctgcggcagcggagcagcaaagcgccggcatgcaggaaatcgcatcggccattcagcagctctccgctttgtcggaagaattgaatcaggcggcatccaagtttaaactggccgctgaataaaaagaacagcctgatctctcttgatcaggctgttttgtttatacaggattcaaaatccggtttaaaaactgttttgttcgttcttccttaggggctgagaaaatttgttcaggcgggccctgttcgacgatgacgccgccgtcgataaagacgacttcgtctgcgacatcctgcgcgaatttgatttcgtgggtgacgacaaccatcgtccagccctcatttgcaaggtctttcatgactttcagcacttcgccgaccagctcggggtccagagccgatgtgggctcgtcaaaaagcatcagctcaggcttgatggccagggcgcgggcgatcccgacgcgctgctgctgtcccccggaaagctggaatggatagagatccattttgtcttcaaggccgaccttttgcagaagctgaacggcttcctttttgacctcttctttattgcgcttttgcacttttacaggcccttccatcacattttcgagcacggtgcggtgcgggaacaggtgataggcctggaataccattcccgactttctccgcaggcggaggaggtcagcaggtttatttttcttggaaaaatcgatggtgaaatcgtcaaaagaaagaatgccgcggtttggaatttccaaagcgttcaggcagcgaagcagcgtcgttttgccggaaccggaaggccctaaaatggcgatcacttttcctttttcgatgttcagatcgattttttttaagatttcattttcgccgaaggatttattcagccctttgatcgcaagcatggtctatttccctccttacttggccacataccggtccaaacgccgttcaatctgctgctgaacaagcgcgagaacaaagcagatgatccaatagatgaatgcggcttccatataaatgattaaaatttggtcaagattgccggccccgatttcctgggccttccggaataattcagcaacaagaatctgtgacgcaagcgatgtatctttaaccaagctgatgaatgtattggataatggcggaattgacacgcgcacagcctgcggcaggatgaccctggtaagcgccgttttttgagtcattccaatcgaataagccgcctcccactgtcctttcggaacggaaaggatggaagccctgatgatttccgacgcataagcgccgacatttaatgaaaaggcaatgattgcgctcggaaacgggtcgatcgtgacttgaaacgctggaaacaagtaaaaaataatgaacagctgaacgagcagcggcgttccgcggatcgctgagacataaatgccgaaaaccgctcttaaaatgcgggatttggacattctcgccagcgccgtgatcaatgcgatgatcataccgaatataaaagagagaatggcaaggggaatcgagtaatagattccccttaaaaagatcggccaaaatgactcacgcacaagatcccacgggatcgcctggccgatggccgccgcttgtatattacttagaaacatcttcgccaaaccatttcttcgctattttcgcgagtgtgccatcctctttcatgtccttcagcgcggagttgaccttgtcaaccagttcgccgcttcctttgcggaaagcaaaatgcgtagtttgcggctcgcctgtttcaaaagcgattttcaggtttttgtttcctgacgtcttcaaatagttcagcaccgccagtttatcgttataggtgaggtcgacacggccctgctgaatcagctgaaacgcttgagccattccttctacgccttcgatttcagcgccggcgtttttcgcaaggtcattatagttgcttgtcaaagactgcgcggcttttttccctttgacatctccttcagactttacatcgttgttgtccgcttttgtgacaacgacggcttgggaagttgtatatgaatcagaaaaatcgtactgatcttcacggtcttttttcccgacttggttggcaacgacgtcaaaacgctttgagttgagtccggcaaacatgctgtcccactgcgtttctttaaattcagctttcaggttgaggcgcttggcgacttcctgcatcatttcgacatcataacctgttaatttatctgtttttttatcgtggaatgtaaaaggttcgtacgttccttcagtaccgactgtcaatacgcctttatctttaattgaagaccagaggctgtcgccggctgcgtttttatccttggaattgtcccctgacgcgccgcatgcggccatcacggtgatcaacagcgtcaataatacagcgaatattgctttcttcattttattccccactttactgattggatttagttgatatgattttacttaaggctcttacaaaagtaaagcataaaccttttttagtatgagtcaagaaatacgtttttagtgatgaaagggagagaagatcattctgattcctgatcgaagcggatcttccattttttaagcctgtattgcaggctttgcctgctgatccccagcacccgagccgcttgtgacacattgtaattgcattttttaacggttttttgaatataatacttttcggcattctcgatttgttcctttaaaggagcggccgaggcggaaggaagcggggcgaacagatcatagccctgctgcggcagctgctcttttgccgctggtttcgtcctgtattgcaatggaaggtgcgtcagctcgattttgtcttcgtaggacatcaaattcatggcgccttcaattaaatgttcaagctccctgacgtttcccggccaatcgtatgaaagcaggaaccgccgcacctcttcttcaaaacccttgacctccatttggaacaatgcgttgtatttgtcgataaaatgctgcgtgagcggcataatatcttccttccggtcttttaatggaggaataaacaaggtgacgacgctcagcctgtaatacaaatcttttcgcagcctctggccgctgacagcgtcgactggatcttcgttcatcgtcgcgatgatcctgacgtcgatcggagtatcctttgaagcgccgatccgcctgatcgttttttcttgaatcgcgcgcaaaagctttgcctgcaatctgaagtccaaagaattgatttcgtcaaggagcagtgttccgccgtcagcttgttcgaaaagacccggacgatccacggctcccgtgaatgcgcctttgaccgtgccgaataataggccttcgacaaggctttccgggagggctgcacagttttgcgagatgaatgggcccgttgagcgctggcttccgttatgtatactttgggcgaacagttcttttccggttccggtgtcgccaacgattagaatggaggaagaggtccgggtcgcccgctttgcatgttcaatgacttccttgaacgccggactgacgccgatcaggctgtcaaacgtatactttgtgctttctgttttgttcatattttctctgatcaggcgttcaagctttgtgacatctttggcaatctcgaccgctcctttcgtattcccgttttccataatggggaatgtatgattgacggtcgtaatttcctgtcctttgttattaaagtaagtctgtttgacgtttttgttcgttttcccgtgatgcagcgcctgcaggagggtgctgtcatgctggctggcaaacgtaaacacgtccagcacgtttttgccgagcacatcgccgacatccatcccttcaatctggctcatctttttgttatagacaacagatgtgccgttttcatcgacgacatgcaagccgatatcgatttcatctataattccttgaaaaataagtttcagaaaatcataatccttcagcaattgatatccccctttgttcgtatctgtctccattttaagtgaagacttgataagggtgcaaaaaaatatgcatttatttttgcacctttgcataaaaaccgcaaaattttttgcgagttacacatgcaatgttctgaaaatttgcggtattaagagttggcacgatacttgcatataagatagtgtgaaacaaaatacgacatctggcatgtatgtccaaaaataagaaggaggaatcagaatgacggttctatcaaagtccgagaaaattatgaagcaaaccgcacattttggcgcgaataactatcatcctctgccgatcgtgatttctgaagcggaaggcgcgtgggtgaaagatccggaaggcaaccgatacatggatatgctgagcgcttattccgcagtgaatcaagggcacaggcacccgaaaatcatccaggcgttaaaagatcaggcagacaaaatcaccctgacttcgagagcttttcacaatgaccagcttggtcctttttatgaaaaggtcgcttcattaacggggaaggacatggttctgccgatgaacaccggtgcggaagcggttgagtccgcagttaaagcagcgcggcgctgggcttatgatgtaaaaggcgttccggacaatcaggcggaaattatcgcatgtgaaggcaattttcacggccggacgatgctggctgtgtcgctatcttcagaagaagagtataaacgcggtttcggaccgatgcttcccggcatcaagctgattccatacggggatctggaagcgctgaaacaggcgatcacaccgaatacagccgcttttttaattgagccgattcaaggtgaagcgggaattgtcattccgccggaaggctttttgaagcaggctgctgaagtctgcaaagagcgcaatgtcttgtttatcgccgatgaaatacagtcagggcttgcacgtacagggaaaatgttcgcctctgattgggaggacgtcacaccggatatgtacattttaggtaaagcgctcggaggcggcgtgttcccgatatcgtgcattgcagcaaaccgggatgtgcttggcgtgtttaatccgggctcacacggatcgacctttggagggaacccgcttgcatgcgccgtatcgatcgcagctcttgaagtgctggaagacgagcggctcgctgaacggtcgctggagcttggggaatactttaaagaaaagctctcgcaaattgataatcctaaaatcaaagaagtgcgcggcagggggctgttcatcggggtagagctgaccgaggcggcgcgtccgtattgcgagcgcctgaaagaagaagggctgctctgcaaagaaacgcatgagacggtaattcgctttgcacctcctcttgtcatttctcatgaggatctggattgggcgattgaaaagattacccgtgttttgtcgaagtaaagcgaacggctgaacaataaggggattgttcagcccgttttttcgctgtctgtgcgaagtttgtcaaaaattgaaatatcaggaaaatgttcagaagatttaaaaaatagtctatatgtcatagggggagctgacattagggagaattgaaacggaaggggtgaaggcggtttgaatcatgaaaaccgtgaacaatatacactgaaacgaacgatgaaatcccgccatttgtttatgatctcgcttggcggcgtcatcggaaccggcttttttctcggaacaggttatacgattaatgaagccggaccgatcggcgcgattctttcctatttagcgggcggaatgatcatgtattttacgatgctctgccttggggagctcgctgtggcaatgccggtttcaggctcttttcagacgtacgcgacaaaatttatcgggcctgctacagggtttgccgtcggctggatctattggctcggctggtcggttactgttgctttggaatttttgtcagcggggcagctgatgaaaagatggtttcccgatgtcggcgtctggatatggtgcttgattttcgggctgctgcttttttcactcaatgctttatcggcaaaggctttcggggaatcggaattttggctgtccggcatcaaaattatcgtcattcttctgtttattattctcggcggaggcgcgatgttcggactcatcgacttgaaagacggacaggctgcaccgttcttttccaatctgattggagacggaatttttccaaacggattcggcgcgatctttatcacgatgatcaccgtcaactttgcctttcaggggacggagctgatcgggatcgcggcgggggaaagcgaaaatccggaaaaaacggtgccccgctccatcaaacagacggtctggcggacactggtgtttttcggcctgtccgtatttgtactggcgggattgattccatgggaaaaagcgggggttgttgaaagtccgttcgttgtggtatttgaacaaatcggcattccgtatgccgccgatctgatgaactttgttattttaattgctttgttatcggtggcgaattcgggcttgtacgcatcgacgaggatgctttattccctggcgaaagagggaatggccgctcaggctttaagccgggtcaataaaagaggtattccgatgaatgcgctttggatcacgctcggttttgcgggtttgtccctcatctcaagcgtagtcgcagcagaaacgctctacatttggcttttgtctctagccggtttaagcgcgcaagtcggctggatcacgattacggtatcacagctgctatttcgcagacgatatgtcaaagaaggcggaaaggttgaagacttaaaatttaaaacgcctctttatccttatttgccgctgacgggatttattttaaacagcgccgtccttgtgagcctcgcttttgattcagagcagaggatggcattgtactgcgggattttattcatgtcggcctgctactttgtttatcacgtgtttgtgaaaaaacgccaggctcttgatcgacaagaagcaatgatctatcaaaacaaaacaaacgatgaggtggttattgatgaataaacaagtttctttgattggaatgccgatggacttggggcaggcgcggcgcggtgtggatatgggaccgagcgcgattcgctacgctcatatcgtggagcgcttaaacgagctgggctatgatatcgatgatctgggcgatgtgccgatcaaccgcgatcagccaaaaggagacgaagggctgaaaaatttagtttccgtactggaaggaaaccgcaagctggccgatatcgtcgacaatgtcgtcgagcagcgccgcttcccgctcgtgctgggcggagaccacagcattgccatcgggacattggcgggtgtagccaagcattatcaacagctcggcgtgatttggtatgacgcacacggagacctaaatacgcttgagacatcgccgtcaggcaacatccacggcatgccgctggcggtaagtctcggtgtcggccacgaaaagctggtcaacctccacggctatgcgccgaaaatcaaaccggagcacgtcgtcatcatcggtgcgcgctcgcttgatgaaggagagcgcaaatatatccgtgaaaccggcatgaaagtctataccatgcatgaaattgacaggctcggcatgacgaaggtaatggaggaaacgatcgagtatttgtcagcaaattgcgacggcatccatctgagccttgatctggacggtcttgatccgagtgacgctccgggagtcggcacccctgtcgtcggaggcatcagctacagggaaagccatttggcgatggaaatgctctatgacgcagatatcattacatccgccgagtttgttgaagtcaacccgatactggatcataaaaataaaaccggtgaggcggccgtcgaactgatcgaatcattgttagggaagaaactgctgtaaccaatgcgaaggagagggcatcggcatgatgccttctctttttttattggcgcattcccgggcgcttatcaaaataaagccaaaaattctctcacaggcttcggcagaaaactgccggccctccaaacgacagacggctgcagaatgaacggattgttttgaatttccaatgtctgaacatgccgtgcaaaatgcgccggcagcatggacagcggcagaatcgtcgctccgaatcccgaagtgacgaggctgagaagcgttgtagaatcatggcactcacaaacgaccctcggttcgaggccagatgattgaaagtgatggacgacctcgtcgtaaatcccttttccgtgcgacggcctgagcagaatcagcggcaggccggcaatttctttcattccggcttctccttttaagccatacgactgattccctggaagaacaagcttgcatggaacctccggcaggctttttgattcggtgtttttgctgtggataggcgttgtcgtgacggctgcatcgatctgccggctttccaggagctcgcttagccgtgaaggctcaccttcccaaatgttaaacattaaattcggatacatatctctgatcttcgagacttttgagagcagcagggccgcgcagtaaatcgtcgagccgacggcaagggttccgttgacttcttcacgcagctcccgcacctccaagatggaatcctcaagcttgtgcaggatttcttttgctcttttcaaaaaaacttctccttcgtaggtcaacgtcaggtttttctttttgttccggtcaaataaaacgactccgagctcctcttccatctgcttcaactgcctggagagcggcggctgtgcaatatggagccgcttcgccgccgttgtaatttttccttcccgggcgattgtaacgaagtattttaactggcgaatatccattttcacggcactcctttttatacctttagagtattatatatagatttaacagatattttcaatatggtaaatagaggcgtatcattttaactgaagcaccaggaaggaaaggggggcgcatatgaacatcatcgtcggaatcacgggcgcgaccggcgcggtatttggcgtgcggatgctggagtggctgaagaaaaccgacgcagagacacaccttgtcatctctccgtgggcagcggcaacgatcctgcacgaaacgggatatacgatgaaagacgtggaaaagctcgcatcttttacgtattcccacaaagaccaggcggcccgcatttcaagcggttcctttcaaacggacggaatgattgtcgcaccgtgcagtatgaagacgttggcgggcatccgcaccggtatggcggataacctcttgacccgttcggcggacgtcatgctgaaggaacggaaaaagctcgttctgttaacaagggagacgccgctgaaccagattcatcttgaaaacatgcttgagctgacaaaaatgggggcggtgatcctgccgccgatgccggctttttataatcatccccaaaatctgaccgaaatggtcgatcatatcgtatttcggacgctggaccaatttggcatccatctgtctgaagcgaagcgctgggaaggtatgaaacaggagaaataaggaggataacagaatggcttatcaagattttagagattttttaaatacgctgaaaaaagaaggacagcttcttgaagtccaggaagaggtgaagccggaacccgatttgggagcagctgcacgcgccgccaacaacctcggagacaaatcacccgctcttttattcaacaacatttacggctataacaatgcccaaatcgcgctgaatgtaatcggctcctggccgaaccacgcattaatgctcggccttccaaaagacacgccggttaaagaacaattctttgagttcgcgcgccgttataatcagtttccagtaaaagtgcaaagagaggagacagcgccgtttcacgaaaacgaaatcacagaagacatcaacctgtttgacattctgccgctcttccgcatcaatcagggcgacggcggcttttatttagacaaggcatgcgtcatttcgagagatgtcgaggatccggaccacttcggcaagcaaaacgtcggcatgtacagattgcaggtaaaaggcaaagaccgcctcggcattcagcccgtcccgcagcatgacattgcgatccacctgcgtcaggctgaagagcgcggcgaaaacctgcctgtcacgattgcgctcggctgcgaaccggttattgcaacggcggcatccacaccgctcttatacgatcaatcagaatacgagatggcaggggccctgcaaggcgaaccatataaaatcgtcaaatcaaaactgtctaacttagatatcccatggggcgcagaagtggttctcgaaggtgagatccttgcgggcgaacgcgagtatgaaggtccgttcggcgagtttaccggccactattcaggcggacgaagcatgccgatcatcaaaatcaagcgcgtctgccaccgcaacaatccgatttttgaacacctgtatttaggcatgccttggactgaggttgactatatggtcggcattaatacatgtgtgccgctttaccagcagcttaaagaggcgtatccgaatgaaattgtcgcggtaaacgcgatgtatacgcacggcttgatcgccattgtatcaacgaaaagccgctacggcggattcgccaaagccgtcggcatgcgcgcgctgacaactccgcacggcctcggctactgcaaaatggtgatcctcgttgacgaagacgtcgatccgtttaacctcccgcaagtgatgtgggcaatctcaacgaaaatgcatccgaaacacgatgcagtcatcatcccggatttatccgttttggcgctagatccaggttctgaaccggcgggaatcacccacaaaatgatattggacgcgacaacgccggctgcaccggaaacaaggggacactattcacagccgctcgattcccctataggaacgaaagagtgggaagcaaaattaatgaatctgctaaatcaataaaagaggagagtgtttcatcatgcatacatgtccgcgctgcgacttaaaaaaagcggaaaccgtcagcaaatcacccgttgaaggagcctgggaagtctatcaatgccagcactgctttttcacttggaggtcatcagagccggagacgatcacaaatcctgaaaaatacaatccggcctttaaaatcgatcccgctgaagttgaaacagctgtacaagtgccggcgattccagaccggaaaatctaaagggaggcatccggcatggctcagctatcaaacgaactatttcagcttttaaacggagagaagctcgccggtaagcggcacgaagcgatgatgctccagaccgtcacagaagacggctggccgcacacggcgatgatcagcgccggcgaaatccttgccctgaacaaaaccgacatccgcctggctctctggcaaggcacaacgacgaccgcgaatattgcgagaacaggacgggcgctcttcgtcgcttgctggaaaggcaaagcacattatgtgcggctgtctttaaagaaactgcccgaattaagagacgccaaacacccgagagcgcgcttcgccggtacggtcgaagcggcccgggaagatatcgcaaaatacgctgatatcatctccggcgttcagattaagctgaaggatgaagcggcggttttgcggcggtgggaagagacgctgggggagctgaggaaatgaagaaaaggaccatggcgaaccatggtcctttcaattatttctgcagcattttattcgtcactttataagccaggatacagcaaattgtaataaaaataatggcgatcgaaaggatcacgagcttttcagcaacggtatatatcggcatgggaagaatagcagcgcagacggcaaacaggctgccaaaataaacaaacaggatcagaggctttttgtattttttccaaatcacttgattaatcccgtttttttcgggatctgccgggtgtttgcggtcttcatctttcatcaatttatttagcagtagataaatgagaaatgcgaataaagttgccgagaaaatattaaaacagaggataaacagcttttccccgatgctcatcttcggattcagaacggcgcttagaacggagccgcatacgaaaaacaggtagacggataagatggctttgtttcttggtttttgtagaaaattagacattcggatctctccaattgtaaatgatttaaacgctgaaaatgagatggaccagaaaagaaaaaatataaaagatgatgatgcttaagatgcctctgcccacaagataaagggcgaaatacagttttctcaggaaccagttgtatcttaatagccgtttgtaaacaaagtagccggtgccgacaagaagaaaaacgaatgtatttgtgattttatgggaccgtttttcaggttttaaaaagatcattttttcatattcaatgatcatatgactcgcaatgattaaaaaacacaaactgtaagcgaaatgagcggccaacataccggcgattaagtattcggtatattcaacaaaagtttctggtgacatcataactcctttatgaatagcggtctcaagcgttttttaactgacataaaaagcttttcattcttcgtcaggcattctttccaaacaagaccggttcagcatttgattcgccgtttgataaaccgcaaaaaaattgcccgatatcacggcaaacagaatcgcaaacatgccggatttccaagcgagtgagagttcggacatggaaaacacggatattcccacaatcagtatgccgacgaagtagaaagagagcgtgaacggttttctgtgtttcttccaaaagattttcgcgacgatgttgcatcggggcgcgctttgatctttcttcggcttatttataaacacataaatgatgaatgtgaataaagaaattgaaacgaacataaagccgatgacggcaagcctttccttccagttgattgcaggtttgacaagggcggccaaaatgatgattgttgcatatagggaataaactaagaaaatgattttatttctgcctttcaaacatgacatctccttgtgccttaaatcctatgctgtctgatgatatcttgattcgctttgatgaagaagtatttgtggatgaatttgacccccattatagaaaataaacaagccataagcagatagacgatactcatcaacaaatagacggcagactctgaaactcgcaaaacagcatgacttatcatataaccggccgccggaacagccgccaaaagcatccctgtcggagctgctgtctcccttttgcctcttttaggatcagggaatacagccaagtaataccgaatgacgaggaagatagaggcggcatatatgaatagtgacagactgatcaacggtaaatgaaaaccgatggcagaaaacatcattttttgcgccgtgatcagctggcaatatgacataccgctgaaagatacgcccataaaccgaacatattgaaggtgatgaagatattcggtcatgtttctggtatttatgaggatcatccaaacattgatcagaatagcgacagggaggacggcaaaagtgaaaaattcgactttgctcgccagcacaggtaatatgcagagaatatccagcaccaacacgataaaacaggccattccccatttcgtttcccggctgacgggagccttcaaatgagattgaatattgtaaggtaaatctttgtatacaaccgtttcttttaatctcagcaaaacttatattcctccgcttatccctctgaatttttataattctccatgtgttttttcagccagaccttttttctgaagatatgcaataggagcggaagaacgaaaaagaacaagctgataaccgaaacaaacaagggaatttctgaaggggcttgttccaataaaccccatatcgtcatgatgacaaaaaagataccaaccacagggaataaaatcgtgaagatgatcatagcttcgtttatttttttatatagaaaatttttttcgtttttcatattgagccccttttcttgatgggtgttttctgcatcggcaacgtttggctttgtgttttttcatatctcgtctatcttcttgaaacaataattcgggaaactgagataagagaaagcatcccgatgtgagatgctttgaaatgtatttattctcgcattgcggcattatgtattttgaaaagatactgtatactcaagcccttttaataattcgttccattgctcaagtgtccttaatgaaatatgtacaggtttttcattgtgttcatcatactgagcaacccaaacgccacgggcagatggaataaaaaagacgatattttgcaagaaaggtccatcgtttaagctagggatgtaaaaatgtgagatgttgtttagcgaccattggtttgcttcaagatcggctatcaattgattaaagctatgttcttcctcaggtgaaaaagaacttttcttccgaaccttttctgtcatgtctttattactcagccagtcaaagcatttatctgaaagacgaaattttaaaggaatatgttcctcatcagttgaaaagtggtaatagtctttcatcagctgggcaatttcctgctcgtcgacatacgcaaattcatggatgatatcgcggtcaatcatatggaaaagccatgtttcattttcaaaatggtgaagcattaaagtgtttttattgtcaaggttggaacagcggatcatttgttctgaattcacataggaaacgatgaatttctgcatttcttcgcttaaaggattttcgtcttttgaacttttttcttcgtcccagtattgttttaaaatgagctggttgacagttgcctctaagattgcatcccattctttttttgatttttttcctaacgatgattcaagaattccttttgcaacaccaggatagtcacataaccctactaaaagcgctagttcttctgatgtacatgtgatgaggtgtttcattgttttcacatccttgattataaacttaaaccttgaaaatgaagtgaaggataaatgataaaatatagaaaatgatgatacttaaaataccgctccccagaaggtaaagggcataataaaattttcttaggaacaagttatatctatatagtcgtttatatgtaaaataacttgcaccaaaaatcaatgcaaaaccgaaattaacagtttttttaaatatatttgaggggggtctgaaagtcccctgctcataataattcatagttatatacccaagaaataaagtgcaaagtccaaatacaaattgagaacttaaaatagcagcaatcaaatattcagcatattcaacaaatactttcggcgtcataatgcctcctatctatttaaaccaacttttcacagactcaaaactgtttttaattcctttttcaatagaaccagcaactttttcaccagcatccttaattgcatcaccgtatgaagagctagcaattgctccagctactccgcctatcgctccaccaacaatcactcccacaggaccgccgacgcttcctattgttgctccaatttcaacacctgtagaaacagcaaaaatgtctgtaccaacacctgctgcgaaacgtcctgttttttctgcaaaacttttgtccgagttctcgggatcggtatattctgtaaggttagaagcgaaagtaactgcggtaccaacaatagggactcctctttctaatgcagtaaacccttttgccttggctgtggactccattatatcaaccgcacccgcttttgtcctcagggcagctctcttgcgaaattctttcccatctataaaactatgttgatttttagggaaccccacagcatgtttaaacatcatggatggactatcataagaagcgacaaatttttgcgcttttttaagtaatgggttgcttggattcgagtcagagatgtttttaatggttctcgcaactttcgaactgtgatctccttgagaagtccaagaacgatgtgacatgacctgaaatttatattcccctttaaatcgctgccacttcgtcggttttcctccttgataataaatttttaattttcgcgtccacgcgattgatgctgttgcgttggctgcgtgataccctaataaggctttatcaccgacatctaatggttctccgaatgtttcgaagtaactaagaatttcgtgtgctatatttgttttttctttatcctgtgtatcaggattcgttaacgtttctgccgctttttcttctaatcgcccaagcatcttttccatcggtgtttcgccggggttttgcaggtcgttttgcaggccgccgggagcttgactgattgttgagtcattttgcggttttaaaattgaaccgcttttatattccgatatttcaatcttcggccccgtatacattttctccagctgctggatgtattgcttcatcgtatcgaggtcttctctcgccgctttcagcgcatttgtctgttcgcggtcgaaggtgtggagcttttcgagcgtctcgctgatttgtctttgcgctttttttgcgttttcgttgacggctgaatcgtctaggtcgggcaggtcgacgatgtggctgacagtggccatcgtctggttggcttttgacgtcaatctgccagtcagcgattcggcttgactgacgccgtcatggagttcgttctcaagaaagctttgcgagataaagccgttttggttcggttcaagggaatgaagcgcacttttcgtcttttctaaaagtcctttatagtcggaaataaaagattcataaaaaagaagaaaagtggtgtggcattcttcgtagaacgagcggatcgcttcaccgcccgcgccttttaaggcgtcgtcaagggaggtgaggcctttgatgctttgtttgacttttgaaatctcgtcagtctggttttttaattcggtcagcgttttgtctaggccggtttgaaaagcctgaacatctagagttttcaatgcgtagtcccttccttctacttggctttgatcgatgacgacagctttttgtcggcgtcttttatggcgttgacagcctgctcggtttgcgcaatttgtttagcgagagccgatgcgtatgcttttgtcaggcttttcaaatctttgttcatgctttcgatttttttgacgacgtcaaggttgtttttgccgctgatatctgtctgcacgttcggcttcacggcttgggctgaatgcttcagttttgagagcgcctgtttgacttcgcccgttttgactttgatttcttgacccatcgtaatcactcctttagcggcgggcttctctttcttctttttccagtttttcgattttcgtttttaatgagctgatatccttacctagcgaatcaatatcatcatttaaagaagagattttctcctttaattgtttaaacacttcatttagctgctttccgcaaatatcattatatgccgttttcatgtcgcttctgacgtttttaaaagaatcagccaggctgccctgccatgtcgtcggcgacagttcgggctttttgatactgtcttttgaatcgtcaaattcctttttatctgcttctaattcagtttggcaatttttcagttgttcgagctgttgttttttgatgagaagtgtaccttgcagcccgtataaaactgttttttcccagatcatgttactgccacctcccggaaaatttgattcaaatgacctgttgggttccgttcattaaaggaccttattaatgttacaacatggtataaatgagttgaatgggaaaaatgtaccgtgaacaaagaatctagttgagcggtggagcaggggattccttattatgactgcgattttgcacatttctccattttcctgcaaggtcaaaagacatagttcttaagttttggatttttggtgtgtttattttttgtttcacaaactttaaggtaattttaagaaagaggcgatcttgccaaccctaaacagggtttttcgaacagaatgtcaaatagattagatatttcataagaacaagggggaattgtctgtttgtgatgaataaaggaggacgggcggaatttctgtcaggatgctcagctgggttcttagaaaaaaatgcggctaaatatatatttatagattgtaaacgctgtcttgtcctcgaccaacagggggatgaagatgaagaagctgttagttgtttatgccgtgatgctctgtttgttttttctgtatgtctacgactactcccggggcgataaagccggttctgcagaagaaagcaggaggcctgcggccgcaggcagtctgtccgaaaaatacgtgatggtcacgtttcaatcgggaatcgaatattggaagagcggtctgaaaggctttgaggatgccgcgcagcttttcaacgtctctgtcgagtatcggggggcggcccattatgatgtccatgagcaaacgaccgtcctcgagcaggtgattgcaaaaaaaccggcgggaatcgctgtttcggcaataaacccaaaagctttaaaccctgtcatcgacaaggcgcacgagcagggtattccgatcgttttatttgattcagacgccccgctcagcaaagcttctacatatatcggcacaaataatatggaagcgggtgctgtggccgcaaggcgaatggccgaatttttgaatggaaagggagaaaccgcggtcattacccagccgcagcagtacaatcatcaggaaaggacgaagggctttgaacaaacgatcaagcaaaaatacccgaacatgaaggttgccgcggttttggacggaaaaggggatgagctgacgtcgaaaaaagaagcggcgaagattttggaggaaaatccgtccatcaaaggaattttcacgactgaagccaatggagcgagcggcgtggcccgtgctgtgaaggaggcgggacttgaaggggaagtatgtatcatcggctttgataaagacaagaaaacgctggacggcatcaaaaacggatcgatttccgcgacaatgagccaggacacatggcaaatgggctattggtcgctgcacatgctgtttttctcaaatcaccatctgaagcatgaacgcccgcttccggccgcaatcgacacaggcattaccatcataacgaaagaaaatgtggcagcctattatgcgaatgattaaacgtttgatcaataatgcgccgatccgtcataagctgatcagccttctcttgttaatcagcatgctgccgacgatcggcctgggcattttatcgggatgggccgttgaaaatattattgaaaaacaggtgatcgaccaaacactgcagctgatcggcgaagtgaacaagacggctgaagtgtatgtcagccacatgcagaacctgacatatttaatatcaatgaatgaagaaatggaagcgttttttagtcataaaaaggaggatggagaggcggattataagcgaaggacgtttttgcagggcctgacttctttatattccgaagcagcgggtattctcgttgtcaatgataagggtgagatgatcagcaatgagatgtatgaacgcacgccgacagatttgacaaaagaaccatggtatcaggcggctctcgacaatgaagggattttcaagatgatcgggaagcctgtcaaccggaatatcagaagccatgtgcactatagggaagatgaggtcgtttccgccgtcagagctgttatcgatcctgaaacacagcatgtgaaaggcgttgtactcatcgatttgaagctgcgcgtcctcgcagaagcgacaaaaaatatccgcttggggaaaacgggttatttgatgatcatggatgaaaatggcggcaatatttattcgccggagacttcgaatctatttctgccgaaaaagtggttccgtcaagaacgttctggatatttttcgaagcggatcaagggagaggaatatcagttcatttatgagacgtcttcctttacgaactggacgacggtcggcgtttttaaagcgggtgaaccggttttcgaagtgaaggaaatccacttgtatgtgcttttgtttttattgacggcggcgtttctcggaatgtcagcttcctattatttgtcccattccatgtcgcggccgattttgaagctgaatgctgtcatgaaaacggcggaaagcgggaatttttcaacattgtatcaggaggaaagggaagatgaaatcggccttttgggaaaaagcttcaatcgcctgatgttcagaatccgcgagctgatgtccgttacagaaagacaggagcgccaaaaaagagaagccgaattaagagcgctgcaggcgcagatcaaccctcactttctctacaatacgctggatacaatcaattggatggcaaggaaaaaaggagcggaagaggtcagcgatctcgtgcaggctttatccaagctgttccgcatttccttgagcaaagggaaagatatcatcccgctgtctgatgaatttgaacatgttgaaaactatttgaaaatccaaaaagcgagataccgcgataaattaaactactcaatcgaaatgaccgggctttgtgatgaccgcctgattttgaagctcgttcttcagcctatcgtcgaaaatgcgatctatcacggaattaaagaaaaaaaggggccggggcatattgcgatcaaaggcatggaggaggatggctcgctaatcatcaaaatcgaggatgatggagccggaatggatgaagagacgctaaagcaaataacggatcaattcaaacacagggacgatacagcgggctacggcatgatcaacgtccatgaacggatcgctcttacatttggcgagccgtacggtataacggttgaaagtcggaaaggagccggaaccgccgtcacgatacggctaccaattttagcaaaagggggaacaagccttgagtgaatgttggcgcgtactgattgccgatgatgaaccgtggattcgggaaggaatacgggatgccgtctcttgggagcgctatcaaatgtcggtgtcggctgaagcggagaatggcgaggaggcttttgagctcgctctcaaacacggtatcgacttattgattgtcgacttgaatatgccgatcgtaaacggaattgccttgatgaaaaagctccgcggcgccttgccccagtgccgctttgtcatcgtgacgggctacgatcagtttgcatacgcgcaagaagcgatccggctgaatgttgatgattatttgttaaagccggtcgatcccgctcatctggaacaagtgctcaaaaagatcagcgtgtcgcttgcagctgagaaaaagaagctgagcgagcaaaagcttgctgagcagcatattcaacaaaacctcggccttctgaaggagcatgttttcagaagctggatcgaaaaccgggcagacgaagaagacgtttaccggcagctcgaatgcctccgtctgccggcgcgcaatcctgaaacgctcggcgtcatcgcggctggacatgtatggaacaaaccgtctgaagccgacaatctgaaagaaaaagtagaacgtttttttattaacgagcgagataaagccgtatttttcgacggagaccgcctgatcgccgcctgtctgtggcgttctgttacggaagccgaacagcgggcgcttgcagagatgatcaaagccgaattgcaggcaagcgcagccgtctgttttgcgaagcttgctgaaaacggccgctcagccccgcaatgctatcagcactgcaggcagcaagtgtcgaaagcattcaatatctcgccggttgtcataagggccaaggagtatatgcaaaagcatttcactgaaagggagttttctttaatacagatggcggatgcgcttcaagtctcgtccgtctatttgagcagaatgatgaagaaggagctcggcgtgacatttgttcagcttttgacggagatgcgcatggatcaagcggttcacctgttagagacaacccctctttcaattcatgacattgccgaacaaacgggctatgatacacagcactatttcagcactgtatttaaaaagacgatgggtgtatcccccaatcagtaccgccgcatgtcgggaattgaaagaacaggaggaaaattgtaatgtaagcgcttcaaaaaagtctgatttttataaaaatagttaattaattcaaaagacggacattcgaaagacatggtacagttggcatgattcatgatgggagaaatcaaaaagggggataccaagcatgaaaaaatgctggctgttgatcactgcaatgcttttctgtctcatcgttaccgcttgttcggggaatcaggcaagcggagggggagacaaaggctacgtcggaatctcaatgccgacaaagtcatcggaacgctgggtgtatgacgggaaatacatggtgaaagagtttgaaaagctcggttataaaacggatctgcagtatgcggaagatgtcgttgaaaaccaagtttcacaaatcgaaaatatgattacaaagggcgtcaatgtgcttgtcattgcttcgattgacggagaagcgctgaccgacgtcctagagaaagcaaacaagcaggatattaaagtcatttcttatgaccggctgctcatgaacagcaaacatgtcgactattatgcgacatttgacaatcataaagtcggggaacttcaagggaaatatattgaagaaaagcttggcttaaaagacaaaaaagggccgttcaacatcgaattgttcgcgggatcgcccgacgacaacaacgcgcatttcttttttgacggcgccatgtctgttttgaagccttatatcgattcgggcaaattaaaggtgttgagcggccagacttcatttgagcaaggggcgacgctcaggtgggacggcgcaaccgcacaatcccggatggacaatttgctgagtgcgcattatacaaaggcgaagcttgatgcggtgctttcaccgtatgacggaatcagcatcggaatcatttcatccttaaaaggtgcgggctacggctcggacaagaagccgctgccggttattacgggacaggatgcagagcttgcttccgtgaattcgatcattaaaggggagcagacctcaaccattttcaaagatacgagagagctggcgaaaaaagccgttgagatggcgtcatccgtcttaaaaggcgaaaaagcggaagtcaatgacacaaagacgtatgacaacggagagaaggtcgttccatcatacctgcttgaaccggtcgtcgtcgacaaagagaactacaaaaaagtgctcgttgacggcggttactataaagaatcggaattagggaagtgatccgatgtccgattgcattttagagatgagaggcatcacgaaggagtttcccggcgtcaaagcgctcgacaatgtccaccttcgcgttaaagcgggcgaaatccatgccctctgcggggaaaacggggcgggcaagtcgactttgatgaaggtgctgagcggcgtctatccgtacggtgcgtatacgggcgacattttatataaaggggaagtatgccaattcaaaaatattaagcaaagcgaggaagcggggatcgtcatcatccaccaggagctggcgctcgtcccccagctttccattgcggaaaatctttttttgggcaatgaacaggccagccgcggcgtcatcaattggcgaaagacaaagctggaaacgctcgaattaatgaaaaaagtcgggcttcaagaatctccggatacgcttgtttcccaaatcggcgtcggaaagcagcagcttgttgaaatcgccaaagctttggcaaaaaaagtgcagctcttgattttggatgaaccgacggcggctttaaatgaagctgacagcgagaatctgctgcagctcttgctcgaactgaaaaaacagggaatctcttcgattatgatttcccataaattaaatgaagttacgaaagtcgcagattcgattaccgtgctccgggacggacagacgatcgaaacgcttgatgttcaaagcgggcaattgactgaaaaccggatcatcagaggcatggtcggcagggagctgcaaaaccgctaccctgacagaagcgccgagatcggcgacgtcatctttgaagtgaaggattggacagttcaccatcctcttcaacaggaccgcaaagtggtaaacatggcggcgttttccgtgaaaagaggcgagatcgcaggaattgccggactgatgggctccggaaggacggagctggcgatgagcatttttggaagatcatatgggaaaaacatttccggcacaatcgaaaaagacgggcgggagctttacatcaaccaccctgaagatgccattaaaaacggcatcgtctatgtgacggaggacaggaaaggaaacggtttgattctgaaggacagcattaaagaaaacattacgctgtcgaaactggataaggtgtcgagccgattggtgatggacgagcggcgcgaacaacatgaagcggaggattttcgccggaaattaaacatcaagacgcccgatatcagccagcggaccggaaatttaagcggaggcaaccagcagaaggtcatgctgagcaagtggattttcgcggagcctgacgttttaatcctggatgaaccgacgcgcggcatcgatgtcggcgccaaatacgaaatctacggcgtcatcaatcagcttgccgaagcgggtaaagcggttatcatgatctcttcggagcttcccgagctgctggggatgtgcgacagaatctatacgatgtgtgagggggaaatcaccgccgaattttccaaagaagaagccgatcaggagaagctgatgaaatatatgaccatccgcatgaagagagggggagaagcgtatgcagacaccggtgcaaacggataaagaccgcgctcagcccggctactttcagctgtttcgcgatatgtataagcagaatatccggaaatacagcatggtcattgcgctcgtgtttattatgctgctgtttcaaatattgacagacggaattttgctgagaccgctgaacattacgaacctgattttgcaaaacagctacattctcattttagcgattgggatgatgctcgtcatcatcacgggacacattgatctatcagtcggttcagtcgccgcttttgtcggcgccgtctccgcgatgatgatcattgaaaacgatatgccgctgtttgcggcggtcgtcctgtcgttgcttctgggagcggcaatcggcgcctggcagggtttttggatcgcttatgtcaagattccggccttcatcgtgacgctggcgggaatgcttttgttcagagggctcacgatgatcgtgctggaggggaaatcgatcgctccgtttcctgtgtccttccaaaaaatggcgtccggttttattccggactggctgaacggaggcacgttccatttgacgacgattgtcgccggagcgggtgtgtcgattctttatctcgtatatcagcttcagcagagaaacatgcagaagaaattccaatttgacttgcagggaaaaggtctgtttacagttaaggtgttttttatcatcgccattatcaacctttttacctacattctcgcgacttatgaaggtatacctctcattttgatcacattgttcgtcttaatcgccgggtatacattcgttatgaaaaaaaccgtcatcgggcggagaatctacgcgatcggcggcaatgaaaaagcagccgagctttcaggaatcaaaacaaaacggctcacctttatggtcttcgtcaatatgggcgtcttagcagccctttcaggcttgatttttgccgcccgtctaaacgcggccactccgaaagcaggaaacctgtttgaacttgacgccattgcggcctgcttcatcggcggggcttcggcttacggcggtatcggcacgatcggcggggccatcatcggcggtcttgtcatgggagtcatgaacaacggtatgtcgctgctcggcctgggcatcgactggcagcaggcgataaaaggcctcgtccttctgattgccgttgcatttgatatttacaataagaataaaacttcttaattcataagaaaaacctgtttttgaacttcaaaaacaggttttttcattattgctggacggaacgcccttcctgattcagtgttggatttatttttttaggttccggcagcaggatgttcaaaatgcttgctaccgccaaaataacgattgaaaggtagaaagacaggttatagttgcctgtttggctgtaccagacgcccggcaaataagccccgagcgccgaaccgatctggtggctgaggaatagccagccgagaatgaacccgacggaatactgcctgaaatactgggttgccagcatttgcgtcggggcgacggtcgcaaagtcgaccaaaccgaacaaaaccgcgaagcaaagcaggagcatcgagttgtggctcgacaacagaatgacaagcgacagcgcccttacggcatataaaaagcacaaaattttccggctgctccagcggtcagcgacgacgccggaaatcaaaatgccgatgatgttaaacccggccagcaggctgacagcggcgcttgttacttcggtcgaaaacccgtggtcatgcgaaaaagggataagatgggtatccattaaccccgttgttgtaaatccgcaaatgaaaaacggcaagacgaggaaccaaaacgttcttttgagaaaaacggctttgtatggaatctttttcggctgggcgtccggctcttcttttatctcgccgccctgagcgccgccgatcggctgtacattcttttccgaaggatggttccgcaataacaagatgacgatcggaaatacaataacggctaaaaacaatcccagaacaatgacggtcactttccagttaaaccagtggatcatcatgagcgatccagggacaagcagcatctgtcccgcaccgaatcccgcttccatgatgccgaatgcaagcccgcgcttctcattgaaccaattggtcacgatcacggtcgacgcgacattcgacgcaccgccgacgccgagagaaacgatgatgccatacaaaataaacagctgccacggagaagtcacgagatatgtaaaaaagatgctcaagccgaccagaagcgtgctgagggataaaatgatccgcggtccgaagcggtcgacaagcctgccgatcaccggctgggacacgccatatacaatgaagctcagcatggaaataagcgaaatcgtgcccctgtccattgaaaattcctcttcccaaggctgaataaaggctccgaaagaaaggcgcactccttgaacggccaaaagcgtcaaaaacgtcacaaaaacgataatccaggcgtagtgtattttccgtttcatagatcctccatttcgtcagcctaactcggcatcccagcgttcttcccggagccgctgcccccataataaagtctcgtctttcacttccgtcagtctgaatccgaatttttcatacaaaggccgtgcttcggccatcgtgcttaccgtccataaaaaaatccgctcatactgattttctttgcaataatcgatgagatgctccaagaggcgtgtgccgactccctggtgccgaaaagcggcgtcgaccagaaaccatctgagctgcacggtcctgccggggtgtttgacgagcccgacacatcccgcgaatcttccggcgctctctgcgatccagattttttcgatctcggcgtcgaatgtttcgtgaaggtaatccaaaaatgaatcgtcccagccgtgtgtctccgcgtagaaggcacgctgtttttcgatcatcagtttgatatcgtccgatatatagtaatctcttatagaaacggccgatttttcgggaggcaggtgttccgacaatatgcattcaattgtattcattgcctccgtcagcttttcctgatggcggccgtcgatatgcttcagcatgttttcgatttgttgattggctttggcctccagctttttataaatggattcaccgaagctggttaagtagatatagtggttgcggctgtcctcctcgcttctctttttatagaccatattttctttttcaaaccgcttcaggatccggctgacatagccccggtccaggccgagcgtatcttgaatcagtttggctgtacaatcggccgtattgtgaatttcaaataatatccgggtttccgtcaatgaaaaagggctgtcataaatatgttcattcagaaaaccgagcacatttgtatagaatcgattgaactttctgaattttaatgttgtagaatgattgatttccgccatctcaaaacctctctccctgtaaatcgttgctttaatcaattataataaattagttgatttagtcaagtgtatggaaataaagttaaaaatgttaatgatagaatatattttacaaataaagaaagagaaattcaatcgtacaggaaaattcatccaccttggcaggaaagagggaagaaaacagagtatataatctaacaacctgtttttgaaagcgtttttagtgtcatgtccgtctccgcgtcatatgaaaacgaggaagaaaggatgaaactgtaggatggttaaaccgtatcccccgatcagccggaaagttccccgactattgcatggagccgattacaacccggatcaatggcttaaatatccggacgtattaaaagaagatatccgcctgatgaaactgtcccgctgcaatgtgatgtctgtcggcattttctcctgggtttcgctcgagcctgaagaaggaagatttacatttgactggttcgatcaggttcttgatactttcaaggaaaacggaatttatgcgtttttggctacaccgagcggtgccagaccggcttggatgtccaaaaagtatccagaggtgctgagaacggagcgcaacagggtcagaaaccttcacggaaagcggcacaatcactgctatacgtcgcctgtctaccgccggaaaacggcgatcataaacggaaagctcgcggagcgctatgcgcatcacccggccgtcatcggctggcacatttctaatgaatacggcggagaatgccattgtgaactttgccaagacaagttcagagagtggctgctggcgaaattcaaaacgctggaccgccttaatgatgcatggtggacatcgttttggagccatacctatacagattgggacgagatcgagtcgccggctccgcacggcgaggatgccgttcacggtctgaatttggactggaagcgttttgtcacggatcaaacggttgatttttgccggcatgaaatcgcccacgtccgttcgtttaaccctgatctgcctgtgacgacgaattttatgggaacgtatgccggattgaattattggaagtttgccgatttgcttgatgtcatctcgtgggattcttatccggcatggcacaacagccggcaggaagacagccggcttggagccgatattgcttttgttcatgacatcaatcgctctcttaaaggcggccggccgttcatgctgatggaaagcacgccgagcatgacgaactggcaggatgtcagcaagctgaagcgccccggtatgcatgaattgtcgtcattacaggcagtcgctcacggatcggacaccgttcagtattttcaatggcggaaaagccgcgggtcaagcgaaaaatttcacggagcagtcgttgatcatgaaggatcagagcatacgcgcgtttttcaggaagtgaaaaagctcggggagaagctcgaaaagctggaagacgtcgcagggacgacagtcgaacccgaggccgcgattatatttgactgggagaatcgctgggctttggaagatgcccaaggtccgcgcaatatcggaaagcattatgaacggaccgccaaatcgttttatgaaccgttttggcgggaaggcgtaccggttgatgtgattcatatggaggccgatttctcccgctataagcttttggtcgccccgatgctctacatgctgcgagaaggcaccgctgaaaggattgaacagtttgttcaaaacggagggacatttgtcgccacttattggtcgggcattgttgatgagaatgaacttacgttcctgggagggtttcctggaggcttaagaaaaacgctcggcatttggtctgaggagatcgatgctcttcatgacggacagaaaaataccattgtgatggatgaagaaaacaggctcggattaagcggaagctatgaagccagcgagctttgcgatctgattcatttagaaggggccgaagcgctcgctgcgtacgaggatgatttttacgcgggccggccggcgctgacggtcaatttgttcggagacgggaaggcctactatatcgcttcaaggaatgaggcggcgttccaagaggcgtttatatccaggctcattgaagagtgcgggattgccaaagtgctcgatacagagctcccgaaaggcgtcaccgcccagctccgcacagacggccgccacgattatattttcgtgatgaattttacagcggaaaacagaagtgtctcgcttccggaggaaacaaatacggacgttttaaagggaacccggaaaaaaggcgcgctcaaactgccgccttacggaacgagcattttacggagaagccataaggcataggaagccttacttttcaggccgacgcttcgtgcaatatgcagcagcaagcaggaagatgacagcagaagtgtacgccaatacaccttgattaaaaacgcagagaaacaccacatttgataaaaccgccaacatgataaacactacggcatagagatttaaacgcaataccatccctccattaatagttatcttaacataaaggaatgtgaaaaatccgcgggcatttcccgcggatccgtcgttatttggctcgttttttcagttttcggggattgacctgatcatcgatatcaggcttgtcgtccagcgcgtcagcaattttttcccaggagacaattttgaagttctgattggctggctgtccattttccgtattttcgcgtcttgggcgacaaagatgccgtatggatattttttgccgaggccgaagccgatgacgtcgattccatcggtatcgcttgtcccgtcgatttctttaccgtcatcaattgaaaaatcggcgacatagtcgtttttcccgcgccggtcatagatggcataacggttatcgccctgactggacgcgatcaaatatccttcgccgtcttctccgtagtaaatcgtcagcccttcaatatcagcggttaaatgcggtccgcctgcgcgatcgacaatttttcctttatctccgccgtttggctcggcgctgaaagaccaaatcgcagcgtcttcttcagcgatgtacattttgccgtattcatcatctgctgcaagcccttctgtttgagagctcattttgaatgagcggacctttttgccttcgacttgtccttttccgttgtcaaacagttcgtattgctcgaattctccgttctttccggtcaccatggcgtagaacttgccggttttctggctgtgatacaggctgaaaccatacacctcctcaatatcggtttgaataggtttttgaggattgacgatgtttttcagcttgtttttttcgccgtcaaaggcgtatatttcaaccgtgtttttgccgtctgaccggtttgaggccccggcaatatcaatttttttgccatcgagcggaaaattgtagcggagatcgacgttgtttaatttgccaaacggataggctgccagctgttttccgtttaaatcgtaaacgatcaagccagattttttatttgttgtgatcagccggcttttttcaggctgcttcggatgaacccaaatcgccgggtcatctgccgcgtcgtcaggggtatccaccggctctgtctctgcatcggcagtcaccgagaagtccttataagctgaagcttcggcacgggggagaatgctccatgagggagacaataaggatgccgcaagagttgataaggcgagcgttttgtaaaagttcatatattaacctccttttgataacacttatactagcaaatcaatgaaaactatcatttgaggaaatgtaaacttttgttaaaaaagcggtggtttaaaggggctgtgagatttagcatacgaagccgcagagaaaacccccggaattctttccgggggttttgctttaacaggtattccctatctctcattaaatcgaaatgtatatatcctgcgaaaaaacagaagaaaaggagtatcagcctattgctttttaattaacacccttcataaatttctgaattttcggtgacagcagcatcaaaatgatcccgagcaggatggatacaccgccgatgatgccgaagtaggcgatctcggtatcaacgctgtaaaatctgacgatctgtgcgttgatggcctgtgcagaagcgtttgacaggaaccatagactcatcgtctgcgctgagaaagcagcaggagccagctttgacgttgcggataacccgactggagacaagcacaattccccgagaacgacgatcaggaagctgagcacaagccacattggattggcaagcgattcagtgccgttgatgtaagcagggaaaatcatgacgacaaatgacagtccggctaaaatcaacccgagtgaaaacttcgtcggcgttgacggctgacggtttccgagcctcatccaaatccatgcgaaaaccggtgcaagcacaacgatgaacaacggattcagcgactggaaccaagaagagtgcaattggacacctaaaaattccaaatgagtgcgtttatctgcataggtggctaaaatattggcgccttgttcctgaatcgcccaaaacatcatcgatgcgacaaacagcggaatgtaagctgtgagacgggaacgttcatcactcgtcgtcttggagcttttaaacatgacgatgaaataaatcagcgggatcaaaatgccgagacagctgacgatcatcgtaaacagcttgattgtcatccagcccataaagatggaatagccaaagatggcagcgatcaccaaaacaccgatcccgatccgtccgaacaccattttcctttcagctggtgtgagcggattcggtaccgttcttccggcagatccgaggtttttcttccgcgtcgctaaataggtcagcagtccgaacaacatgccgatggcagcaaggctgaagccgagatggtagttgtatgtctgaccgactgtgccgacgataatcggcgcgagaaatccgccaaggttgattcccatatagaagatgctgaaaccagaatcgcggcgggtgtcttcagggctgtacaaatcgccgacaacgcttgatacgttaggttttaaaaggcctgtcccaatgatgatcaagaacatgctgatgaagaaagcggggacgcttcccgggaatgacaaaagaatgtgtccgaacataatgagcacgccgccgtaaaacacggtgtttgcagttccgaggagcctgtccgctatccagcccccgataatgccggacatatagacgagggaaccatatacggccataatcgagttcgctgtcgtttgatcaaacccgaggccgccttttgtcacctctgtatacaaataatagataaggatggctctcatgccgtagtatgaaaagcgctcccaaaattcagtgaagaataaggtgaagagtccgcggggatgtccaaaaaaccccttttgcggaatgttttgaaaagtttctttttgatggtttgacattcgcaatactccttctctttctatgtctattataaaaatcatattcttatataatgttcgtgtcaatacaccttcaatcgatttgaatttttgatcgatgatgccacaagttgtgaagcgctttacaagcggatagaaaaaaattttgggagaaaatttggattgaaagattttttaataaaattttatctatttatgtacaagcggattttactagattggcatatatataacgcaaaccgttttacaaaaggaggctgaaaacagcgtgcagcagcaacctgatgaaatgagaatgacagtggttgacgcgacaaagttcggcgctgtcggcgacggcaaaacagactccacaaatgcgatcaacgaatgtttggcatggacaaagtcgatgggatacaacacggtatggataccgaacggcacgtacatgattgacgggacgaaaaacggcgacccgcgggctccgtttcgcggcgccggcatcaatgttcccggcaatattgaaattttgatggacgcggaggctgtcatcaaggtaaagccgaacagttcatggggatacgctgctttttatataggcggaacatccgatataaaaatatccggaggcagcatcattggtgaaagagatgaacacacatatacaccggccccgaggccgacccatgaatggggattcggaatttgcatcgaaggggcgtcaaatgtcgtcattgaacacgtgagaatagccgattttacaggagacggaatcattatcagcaacggaggagaagggtatagaccgtcagagcgtattcaggtaaccaattgcgatatcaggcgctccagaagaaataacttgtccatcacagggtgcgacaatgttcttgtagaaggatgcgaaattgcagatgcgggaacaggaaacggaaccgctccttgctttggcattgatatagaaggctatagtgaaggaagcatcgtctatgaagaacccgtcaatgtcatcatcagaaacaacgtgttaaaaggcaatgtcaatcatgccgtttccaacttcaacggtacttctgtcatcatcgaaggcaatgttgcagacggtaccatttcatacggctatggaacggggacgacgattgcaaacaatatcatcaagaaaaatcccgaattcaccgggcagagcactggaattaacggcctcggtgtaggggctttggaagaaagaagcgatgccgtaataaagggaaatttgatttccggttttacgacaggcatagatatccgcggaaaaagcgtttttgctacggggaataaaatccgtgattttgtaaatgccggaattcttgcttatcaagcgtcgcaagtcttcattgaaggaaattatattgaaaacgacgtacctgaacaaaggtccggcaccgctttcagcatcacgcaatcagacaatgtaacatgttccggcaatcatattgcaaatgtcgttcttgctgtcaggagcacagggaacgacgtccaaatcaagcataacgtcattaagcaattttccagaggcatatggatatctcaaggaaatgctgtaatagaaggaaactttatttcgccgaacggctttcaaacggtgccggagtcatatgctgtatccgtcacaaacacagcttcggcagttattcaacaaaacaccatcacacgcttcagaaactttccaatatactgctcgacaaatcagcatacaaaaattatcggaaactatattgaagattcaccgctgatcgtcacggtgtttctcacccgcggaacacacgaggttatcggcaatacgataacgctcagcaggccgtccttgccggctgtcctcatttatcttgaccaatcgtcggactcggcgatcctcaacaacacgcttcgaagcaatacggaagcaagagtaacggccattcaaaccaatacgtcaaggcaaacgctcatcatcggcaatacgattgtcaaaggaatgatccattcccaccaaacagatacagtcaatggaaatatcgaagtttaagctccctttggacagggagccttttatgtcctttttctctttttgcgaaagctttccgaggcttcgagaaaaatgataaacaaaaataaaaggatgatgatccactcgcccacttccaggatggcaaacgtcagggagtttacaatggctctttgcaaggtcatgccttgaaatacatccagcatgacggcaaaagcctctaaggaagctaataataaaagcccgattccgattaatttcaactttgcaccactctccgttccccgttattttttctcctttcataaagcactattcacccgggaatagtataaatgtgcttgcgcaaggaaaaatatgaaaaacgaaaaggggattctgacagccatgccattcttttttaaaggtcgtcatcaaaaagataacaaacaagaatctctaatgagcggagataagaacccggaaaccgtaaagttgtctgggtttgtgcgtcccttgcttgccgaaaacctgagcctgattaaagaaatgaccggaaacagctccgatattgtcatccgcaagttaaaaacgggcgctggcgaaaaaattgaaatagccgtcgtttatgtcggcggcattacagatgagaaagcgattcacgattttttgctggaatcgatcatgaactccgaagaattggcggaaaaggagtacggcagggaggttcttgagacgattgcaggtgatgccgttgcactgggcggtgtcgaaaaagaaaagcggttggacaaagtgcttgaatctttgatggcaggaaatacgatcattttggcagaggagacggcagaagctgttattacgaccacgaaaggcggagaaaagcgctcgatcaaggagcctgaaaatcagcaggcattccgcggttcacgtgaaggatttatcgaagcgctcgacacgaatatttctttggtgcgcagaattattaaaaacccgaatctttgggttgaaaaaacgacgatgggaagcgtcacaaaaaccgatgtggcgatcatgtatatcaatggaatatgcgacccgaaagcggtgaaagaagtcaaaaaaaggatggaaagcattgagatcgacagcatccttgaatcgggctacattgaacagtttattgaagacaccgtatttacgacctttccgacggtatatcatactgaaaggccggatatggtcgcagggaatctgcttgaaggaagaatcgccatctttgttgacggtacaccgtttgtcctgcttgtccctgccgtttttattcaattttttcaatctgttgaggattactattcacgctttgacattgcgacattcatccgctttttgcgcgtattgatcttctttatttcgctgattgcgcctgccgtctacgtcggtgcgacgacttttcacaaggaaatgatcccgacggagcttttggtcgtaattgccgcgcagcgtgaaatcgtgccgttcccggctgtggtcgaagccatgatcatggaaatttcgtttgaaattttgcgggaggcgggcatccggcttccgaaagcgataggttcagccgtttcgattgtgggagccattgtcattgggcaggcggcggttcaggccgggattgtgtcgccggcgatggtcatcatcgtagcgatcacagcgatttcaagttttgctacaccttctttctccatggcgatttccgcccggctcgtccggtttttcttcatattagccgcggcgacgacgggtttttacggcattattcttggactgatcatcatgtttgtccatttatgcagcctgcgttccttcggtgttccatatatgactccttttgcgccgtttattttgaaaaactggggcgacgccatcgttcgtctgccttggtggacacatgagaagcggcctgaactgatcggcaatgacaataaggtgcgccaaggagaataccagaaacccgagcccccggattcaggcgatatgaagacaaaacaagaagatggtgatccaaatgaaacgaatcgttaaaattgtgctcctacttgccgccattgtccttcttcaagggtgctgggataaaagagagctgacagatctgctgctgatcactgccatcggtattgataaaggtaaagatacagattacgaattaagctatcagatcgtcaatccgatcaatgtgacaggcggccttcaaggcggacagggaggagacaggccgccgatttcaagctattctgtgacgggcaacaatctgacggaaatgagcagacatgcgtcagcaaaaatgtcgcgggaaatttattactcccacaccaacctcgtggttgtcgatgaaaaactcgccaaggaggaaggcttgatcaaaattctggatgttcttgaccgggacaccgattttcgtacaacggcgacgattattatttcccgcggccaaaaagcgaaaacattcatccggacgctgacgccgatcgataagatcccgtcaaataaagtaaacaaaacgctgcaatttaccgaagagcatttgggagaacatatgaaaacgagcgtccaggatgtcatcaagtgcttaacatcgaaggcaaagcacccgattatttcttcctttaaagtaaccggaaacaaggaaaagggtgaaaaaatggaaaacgtgcagtctacatctcctgaggcaatagtcgaagcggacggcttggcggtcattaaagagggaaagctcgtcaattggcttgaaggcaaaacggcgagaggcgttttatggctgcgcaataaaatcagcagaacgtatttgacaattccaatgaatcatgagagagatgccgtcacatttgacgtcatccgccaaaaaacaaaaatcggatctcacctgaaaaacggcaaaccggcgatttcggttgacgtggctatggaaggggacatcggcgaaacaactgtgccgattcacctggatgatccaaaagtgctgagcgatatcgaaaggaaggtggcaaaggaactgaaaaatgaattgcagaatacgattgacattgttaagcggaacaagacggatgttctgcaattcggtgatgttgtgtatcgcacccaccccgaagtgtggaaaaagatggagggtgaatggagcaatcggtattttcctgacacagacgtcgacattacggttaatgcatacgtacgaagaacaggtttaagaaacaatccgaacattttgaatcatcatgaagggcgttcttgaatgaaagagagaggagggctttaaatggagaaagcaaaaatcagtgctgcacagctgttcgtgcttattgttctgtttgaactcagcagctctctgctgatttttccaggacaatctgccgaacaggacgcctggatcgcgatcttgttcggaacagtcggagggctggctttgtttatgatgcatcactttttctaccaggtgaatcccgacgcctctccctatgaaacgctgatgaatatttttggaaaaccggttggctggagcatgacatttatctacattgtttattattgttacattgcggcaagggttttgcgcgattttggagaaatgctgctgacatcggcttatccgaacacgccgattatcttcgctaatggattgttgattgcagtttgtatttttactgtgaggaagggaatcgaggtccttgcccgttcaggcgagctgttgtttggcatcatgttttggcttgctgtcacaggcctaatcctgatagtttcgtcaggcttgatcaaaccgaaagagcttttgcccattcttggaaacggacccggtccgatgtttcatgccgtgttcacgcaaacgctgtattttccgtttggagaaattatcgcctttacattgatcctgccgtatttaaaggaaaagaaactagcgaaaaaagccgggttgttgggaattgccatcagcggcctcatcctggcttttaatgtcgcattgaacatcagcgtgcttggcgtcgatctcaatatgcggtcgcgcttcccattgctgagtacgatccagacgattcaagtcgccgaattcttggacaggcttgatgtatttttcatgctcgtgctggtgattggcggtttttttaagatgagcattttcatgtatgccgtaaccgaaggcgtgaccgttttattcaagcttaaaaacccctccaaagttgttcatgtcatcggcattattattttgattttgtccgtctccattgccagcaatatttcagagcatgttaaagaaggaatcgagtttgttccattatatgtccatttgccgatgcaggtgatccttcccgcttttatttgcatagtcacttatgtgaaaatgaaaaaaaataaaaaaaaggccatgtaatggattgaccccgcccttagggcaccctttaacatgacagacgaggtgaggtttgatgctctatacggtaaaagaagtggctcgcttggcgaatatcacgatcaaaacgctgtaccactatcataaaatcggacttttatgccccgcggaggtgacggatgccggctatcgcctttacggggtaaaagagctggaacggctgcagcacatcttgttttatcgggagctcgaatttccgctcaaggcaattaagcaaatactggacggcaaagctgatcgactgacgattttgtctgagcagaaacgtcttttcactgcccgtttggacagaattaaacagcttatttctacgatcgatctctcgattcagcaggccgggaaaggagaagcaatggatcaatcaagcatgttcaaagggttttcaagcagcagggaatgggaggatgcgctcgctgaacaaaaccgctatttgaaggaggcgtatgatgtcgatttgctgaaaggagaaccagtcatagcggaagaaatgaatgaaaaagctgaagaggcggcccgttttatgaatggaatggccgaagcgctcagagacggagtcaaacacgaccatgaacaagtgaagactgcaattaaacggcacctcaagtttttgggaattacgcccgacgattttcagtcccagacacgcttctttatcgaagacgattttcatcgcggaatgcttgaaaatcagcaaacaggcctctcgtattatttggctgctgctgcagaagcatttgcttcataataaaagaaggggaacggctcatgccgctccccttatcctgctgatatgcgttttttgacggtaaagccgccccttgaaagcgtgatgttgacatcggatacctttgcgatctgttcatcatgggtgaccatgatgacgcatttgttttcttggtgggcaaggttttgaaagagccggacgatgtcttttgatgtatcttcatccaaattgcctgtcggttcatcggcgacgattaaatccgtgtcacagcagaacgctctgatgatggagacacgctgctgctggccgccgcttaatgtcaatactttctgtctggcctgcttttcgccgatgccgaccttttcgagcatctccaaagcgtattgttccttgtttttgacctgagatccggtgatttccatggccgacgtgatattttggagagccgtcatatacggcagcaggttataggactgaaaaacgatcgatacatattgattgcggaagctggtcagtccgatttttgaaatgttttctcctttgtagaggatgttcccctcttttggcgcgtcaagtccgcccgccaacgataaaaaggtggttttgccggaaccggaagtcccgacaatcgtatataagagtccttggctgaattgaatgctgatatcctcgaatagaggctgatcctgatttttataccaatagccgacattctgaaattctaaaatactgcccataatcttcacttctttctattcttgttttgttaaaatcgttttcggatggagccttaaaacagatatggacggaaggagtgtcgcgaacatcgcaattaaaaggccgattccgccaagtgccattaagttcccgaaggatacttgaatgtcgagctgatcaatggctgagacttgagcagtactttgtccgaagaagcctccgccgcctgggcccatcattccgcctgcagactggctagctgacgtttgttcgatttgctggctcaagagctggttcccgatttgctttgcaatcaggctgccggttaatgctgagatcccgatggcaagcactgcgatcattaagatttcggttaaaaactgtccgatgagtttccggcgtttttcgccgatcgccatcagaacacccatttcgtattttctctccctgattgacatcatgacgatcagtccgagaatcaccgccccggcgaccgtgacaagatagacgacatttttcgagaaggaggcgacattttcaatcgggccgaccatctgctggtacaactggtcattggcgtccaatgtgaatgtatccaaatcaatgcctgttttcttggcagccgcaatgaaagcgtcgatgttggaggcgtcgtccatattgtagaccgcttcatctatcgcgttttgataatcgtcgccttttaaggccgatgccgccgtatatggtgtatagattttgttataagggtttaaaaaggcgaagttttgcgcttgattgtctccggatgaagtcgttttatagattccgacgatttttaaattgatcgttgcatcttcatcgctgctcgctttgactttgatcgtatcgccgaccttcagctcgttttcttcggcaagcgtttcttcaatcacggcgactttttcattcacatcatcctttgttaaagcacggccttccgtgatcttggacgtcccgtcggcaaattcgtcgacgagggctgtgcttgtcacaccttcgattgatacgtcagcctgcatcatttgccggccgccctgttcattgccgcccgatccggccggctgatcgctgtttgagtccgttgaatcctcgtcaccgctttcgatcggatcgaagttgtccgctaaagcagatgttgaggagatgaagttatagcttttgacatggtaaaggctcgcaagtttctcggctgatttgagagaaacgggggtcgattcaaaccttttccggtctcctgagtcctgctgttctttcatcattttttccctgtcaactttgagcgtgacgctgcctccgagctgttccctcgccagttcgctcgatttcacggctgccgactggatcgtaattcctgtcagcacgagcacgcaaatcatcgtgaaaacaaacaattgtaaaagtgtttttccttttttcgctttcatgctccaaaaggctcgtttgaaaaaattcataacgcgtgattcctccgtatctatttcatttattattgctgccaaatctaacggcagcaggacttttgccttatgcttgatttcatcttagccgctacttatgaataaattatgaccaaactgttgccagacctttaaatgttcagaatggaattgagaaatggctgggccctatgtaaaatgaatctaacgtttgtctagcggaggcacttttacgatgaaaatattaatgattgaagataatttaagcgtatgtactatgacagagatgttttttgcaaaagaaggatttgaaacagagttcgtccatgacggactcgaaggatataaccgttttaaatcaggtgattgggatttgctgatcatcgatatcatgctgccgtcgatggatggggtcacgatctgcaaaaaggtcagagaagagagcacggttccgattattatgctgacggcaaaggatacggaatcagaccaggtgctcggttttgagctcggggctgatgattatgtgaccaagccgttcagccctttggcgcttgtggcgagaatcaaagcggtgagccggagatatcaaaacgccggccggcaggattccgctgacagcgacacgcttgaaacggaacattttaaaatcaataaaaaaacgagagaagtgtttttggacggcgttcaaattcaaaatttgacgcctaaggagttcgatttattgtattacttggtgcaaagcccgaaacaggttttttcaagggagcagctgcttgagcaggtttggggataccaattctacggagacgagcggactgtggatgttcatattaaacggctgagaaaaaagcttggcagcgactcgcggccgtttctttacaccgtatggggagtagggtacaagttcgatgaagattaagtatctctatcagctgctggccagtcacatcagtatattagtcttggcttttctcatcacgggggcgctgttttcacactttgccaaagactttgcatacgagagcaaagtcgatgagctgtcttcctacggctaccgcatcatgggcgaaatggagatgcggccgaaaggagcgccggccattatgaagccgtttgaggaaattttgcgaagcaggaagatcagcttttttctgtttaatgaaaagaaagagatcttgatgacgccggccgatttgcggccgcgaaaactgctgctcagtgatgaagaatggaaagagcttaaagatggaaaggccgttgtcgtcaaaaccgactttaaccgttttaatgaggaagtatcggtcgtcgctctgcccaacatcgtcaacaatgaatttcagggaggcattctgctgaccgctccgatcagcgggaccgaagaaatgatcagcgacatgaaccgctttatgctctttacggcggcgggtgtcatcttagtcgctattctcttaagctggctgacgtcgaaattccatgtcgcccgcattcagaagctccgcgacgccacgaaaaaagtcgcggccggggattatgacatccatatcgaaaaccgcaataaggatgaaatcggtgatttgggcgacgactttaacattatggcccgcaagctaaaaagctcaagcgaggaaatcgaccggctcgaaaagcggagaaggcagtttatcactgacgtttcacatgagctgaagacgccgctgacgacgatcagcggtttagtggaagggatgaacagccagacgatacccgaagaccagcaggataaatgtatgaagctgatcacggaggagacaaaaaggctgattcgcctcgtcaacgaaaaccttgattatgaaaaaatccgctccaaccagattacattgcaaaagctgcattatccgctgatcgaagtgtttgaaatcattaaagagcagctggcgcttcaggcggaggagagacagaatcagctgatcctcgatgtggaagatcatgtaatggtcaatgccgattacgaccggctcatccagattctcgtcaatattacgaagaacagcattcaattcacaacgaacggaaccgtttggctgagaggccgggaagactacaaggagacggtgatcgaagtagaggataccggaatcggcattgatgaaaatgatatcgaaaacatttgggatcgtttttataaagcggatttatcacggacaaacacaccttacggagaatacgggctggggctgtcgatcgtcagacagctcgtctcccttcacaacggcacggtagagattgaaagcgagaaaaacaaaggaacaaaatttatcatccgcctgccgctgacggcgagagatgatgatgaatagaaacccgccagacagcgtctggcgggtttttgttaatctttaattttgaatttctgaatcaggtgctgcagctcttcggcgttttgcgcgaggatctgtgatgcggcggcgatttcttccattgaagcaagctgctcctgggttgccgcactaaccgtttgcgtgcttcccgctgcagtctcggctacttctttgacgccggaaatcgcggtttcgatttcgcttgtgccggctgtcaggtttttcaccaagtttgtcacatcattgatctgtgtgacaacctcagttatcgagttttcgattttttggaaagcgcctccggcttcatgaacgacgacaagtccttctttgacttcgccggttgccgaaatgaccgagttcatcgtctgctttgtatcgttttgaatgatcgtaatcaaccttgtaatctgttctgctgactgggccgattgctcggctaattttctgacttcatccgcgacgacggcaaagccttttccttgttctccagccctggccgcttcaatggccgcgtttaaagctagcaggttcgtttgttcagcgatgctcgtaatcacttcggtaatattcccgatctcatttgaacgttctgttaaatgtttaaatgcttctgaaagagaaacgaccgtttcattaatagactgcatttgtgcgctcactttatcaatggctttcgtgccttcaagcgacatcttcgccgtctggtctgcggtggcggctgccttttcggcgctagaagaaattcttccggcaaactcggtcattcccttaataacggttctgctgttttcaacgctttccacctgctgatcagagcctaccgcaagctcctggatcgtcgttgagatgtactcgctcgcctttgtgctttcatcagcgctggcgctcaattcttgtgatgatgaagcaacttggtgggacgtttcgccgaccgtttcaatgatcgaacggacgcctgctaccattttgttaaacgatgcggtcagcaatcccaattcatccttcgattgatatgttcctttgacagtaaaatcgccttgctctgtttctgcgaacagcgcctgaatgtctttgatcggctttgtgatcagccttgtcattaagagtccgatcgagatggataaaacaagcgatgctgcgatcacaatgatgagaagcgtgatgatggaaccggcttctttagaatcccgctgatagatcgttttggcgttgtcagcatttagcgtttgaatgtcttcaatcagctggttgaccgtttctctttgaggctccatctcttttagatagacatcataagctttgtcattttcgttcttcaccgccaagctgagcatctggctgctgatatcttgcaatttcttgtattcgcttttgaagctctcgtatttttcagagacgttgtccattaatttcagctgatcgatcttttccattaaggtgttgttttcttcgtttttttccttgatgtttttttgcaaagtttcatttcgatcgctgtctttcgtcaccattaactcgaatttgtacgtatcaagatcgaggttgttcgcttttaatcttgcaaacaactggttgggaatcaattgatcttgatagatcatctcggaacctttggaaagcttgctcagcccgcctaccccctggatgcctacaattgacaaagccagcgccgaaatgataatgatgacaaacagtttgcttctgatttttatatttctcaacagattcatatggtgttctcccatcaatttatttactttacatatcggctttcaaaacggttttgtgaatcaatttagggcaggcaatttaagggaaggggacattttctgacaacaaaaaaaccccataaaaaaggggcttttttaaacgagaacttttgcgaaaaactcctggtataatgcgcggaccgcttgtttttcctgagcttccttaacgccgaacatcatgctgacttccgaggagccctggttgatcatttcgatgttgacgccggcttcagacaatgcttttgacgctcttgccgtcgttccgacgttatggcgcatggcttcgccgacgaccatgatcagggcaatattgtgttcaatcgctacttcatcagcatccaactcttccttgatccgtttgatcatccgtttttctgctgcttgatccatttgattctgccttaaaatgatcgtaatatcgtcaatgccggacggaatgtgttcatatgtcagcccttcatcttcaaggatttgcaggacgcggcggccgaagccgatttctcggttcatcaaatatttgctgatgtaaatgctgcaaaatccgctgtcgccggcgatcccgacgacaggtccgttcgtgttgtcgcgtgtggcgacaactcttgtcccttctgcgtccgggttgtttgtatttttgatctgaaccggtatgcgcgcccggaaagcagggatcaatgcttcatcatgaaagacggaaaagccggcatacgacagctctctcatttcccggtatgtcagctcgcggatttctttcgggttggatacgatcgccgggttgacagaataaacggcgtcaacgtcagtgaagttttcatacaactcggctttcaatccattcgctaaaatggagcccgtaatgtcagagccgctgcgcgaaaacgtcatcacttctccttcctggctgaatccgaagaagccgggaaagataatgatgcccttttgctgtctgagctgaaacagattgtcgtaggactcgggcagcacttgtgcgttgccgggttcgctcgtcacgaacagcccggcgtcttttggactgacataatgtgcttcaactccacggtgcctgaagtaggccgctaccagtttggcattgttatcttcgccgctagctttgatcgcatcaataaaccgttccggatttgttttatcaccttcgagcagctgaagcaggtctgcccggatccggttgatcacgtcatcggcaagcccgagctctagcgcgatatcggcataccgtccgacaatcgcctcaaccaggccggtcgcttctttcgataataggtactgttgggcgcattcgattaacaggtcagttactttcgtatcctcgggatgccgttttccgggtgccgatacgacgacggccctcctttccggatcggaagtgacgatttgaaatactttctctagctgggctcctgatgcgagcgagctgcctccaaatttaacgactttcatttgttacatctcctaaagtttaaattttcgaaataaatttaattttaattattgcgctttttacaagaagaatcaaggtttttctttcaggaaagaacaaatgtgtttttgaggaggactcatcatggggaaatcgcatgacttcaacctttgtatctattaatcttattgactatgtcagaaaaaatggtaagatatataaaggcccttattgataatgataatcattaacgtcggcggaggggttgctttgttgtgcaaggaggctactgcagcatgaaattacgatacttattgctaatgctcatcattctttcattcagctcgatattcatcggcgttaaggagctttcgcctcttgaccttttccgctttaatgaggacgaaattcaaacgctttacataagcagaatcccgcgcttgatcagcatcgtgcttgcgggaatgagcttgagcatctgcgggctgatcatgcagcagctgacgcgcaataaatttgtttcaccaaccaccgctggaacgatggattgggctcggctcggcgtgatcattgcgatcgtgcttttttcgtctgcagggatagtagtcaaaatactgtttgcctttgtttttgcactgtttggcagctttttgttcgtcaaaattttggacagaatcaagttcaaagatgcgattttcatccctctcgtcggaatgatgctcgggagcgttgtcagcgccatctctactttcatggcttatcagtacaatattattcaaaacgtcaatgcatggtttgaagggaatttttcgctcgtcatgaaggggaggtatgagctcttatttctgagtataccgctcgttatcattgcctatctgttcgccaataaattcacgttggccgggatgggggagtcattttccatcaatcttggtttgaaatacaagcgggtggtcaatatcgggctgatcatcgtatctattatttcgtccgtcgtcatcctgacgatcggcacgcttccctttttgggattgatcatcccgaacatcgtgtccatttacaggggagatcatttgaaaaacagcctgcctcacacggcggttctcggagccgttttcgtcttgttttgcgatatagcgggacgtctcgtcatttacccgtacgaaatttcggttggtttgatggtcggcatcatcgggagcggcgtttttctttacttgcttttaaggagaaaagcctatgcgtcataaacagaaaatgcttgtactcatcgtgatagcagcagtctgcatcgggctgtttctgttctacggtttgccgtctgtatgggaatatgcgcttccgcggaggtttgccaaggtttttgcgatcatcattgtcggtacagcgattgcgtattcgtcgatgattttccaaacgatcacaaacaacagaattttgacgccgagcatcctcggactcgattctctctatgttctgctgcaaaccgggattattttctttttcggtgcagccaaactcgctgaccttggcaaaaacggcaattttctattgtctaccggtttgatggtctgcttttcatttgtgctgtttttcctgatgttccgccgcgggggaaggcacatcttcctgctgctgctcgttggaatcgtgttcggcacattgttcagaagcctgtcatcctttatgcagatgctgatcgatccgaacgagttccaagtcgttcaaaacaagatgtttgccagcttcaacaatttgaatacggacattttagtgcttgcttcgctcgtcattctggcgattctcgtttacgcttggcggtttaatccgtactttgacgtgatttcgctcggcagggatcaagccgtcaacctcggaatcgattacgaccggacggtgaagaaaatgctgatcgtcgtcgccgttctcgtttccgtgtctactgccctcgtgggtccgatcacatttttggggcttctcgtcgtcaatgtggcccgggaggtatttaaaacgtataagcacagcgtcctgattcccggagcggttttgttcagcatcattgcgcttgtcggaggccagttcattgttgaaaagctgtttggtttaacggtgacgctcgtggtgatcattgattttatcggcgggatttattttatttacctgttgctgaaggagcgtaaataatgatagaagtacgagatatcatgaaacaattcggagagcagaccgttgttcatcccacgactttaacgatacaaaaaggaatgatcacgtccttcatcggaccgaacggagcgggaaaaagcacgcttttgtccatcatcagcaggctgatcggcatggacgccggaaaagtgctgattgacggcaaagaaatcggcgcttacaaaagcaatgatttagcaaaaaaaatcagcattttaaagcagtccaaccagatcaacatcaggctgactgtcagggagctcgtcagcttcggcaggtttccttattcacagggaaggctctcgaaagaggactgggcatatgtcgatgaagcgattgattacatgaagctgagagacattgagcataaacaccttgatcagttaagcggcggccagtgccagcgcgctttcatcgcgatggtcattgctcaggataccgactatatattgcttgacgaaccattgaataatctcgatatgaaacactcagtagagattatgaagctcttgaaagaccttgtcgaaaatcgcggaaaaacgatcgttattgtcattcatgacattaatttcgcctcggtttattccgacagaatcgcagccctgaaaaacgggcggattgtaaaagaggggccggcggaagacattatccaaacgccggtgctgaaagacatctatgatatggacattccgatccaacaaatcggagatcaaaaaatctgtgtatattttaaatgatgaggtgacctgaattgaaaaaactatctttattgattatggcattgataaccgttcttgtcgtagccgcctgcggaaacaaagctgctgacacagatgcaaaatcttcctctaaaaaagaaaccgtcacaattaaacacaacagcgacacaacagatgtaccgaaaaacccgaaaaaagtcgttgtcttcaattttggaatgcttgacacgcttgatgagcttggcttaagcgaccgcgttgtcggccttccgaaacaaacccttccgtcttacttgaaaaaatataaagacagcaaatttgaaagcgtcggcggactaaaagagccagattttgaaaaaattgctgagcttgagcctgatttgatcatcatcgaaggcagacagtctgaacagtatgacgagtttaaaaagatcgctccgacgatcgacattgagcttgaccagaagaactacatgaacagttttaaagaaaataccgaaaacattggaaaaatcttcggcaaagaagatgctgtcaaagaagcccttgcgaaaatcgatgaaaaagtagagaaagccaacaagctggcgaaagaaaaaggcggcaaaggattggtcgtcttaacgagcgataagcaaatcagcgcgtatggaagcggctcaagattcggcttgatccacgatgtgctcggcgttgaacctgtcgataaaaacatcgaggtttcccttcacggccaaagcgtctcttcagaatatatctctgaaaagaatcctgattacctgtttgtcatcgaccgaagcgctgccatcggcgaaaaaggaacagcaaaagaagtcatcgaaaatgaaattgtaaaatcaacaaaggcctataaaaacggccatatcacataccttgatccaggctactggtacctgtcaggcggaggccttgaatccgtatctgaaatggtgaaagaagtcgaaaatggattgaaataaaagagcgaggctgccggttcttatccggcagccttttttgtctgttcaaggagaagagggcagagagatgcaaagcgggttttcatgctcataacgccgcaagggccccagactcagttaagcgaatataaaaaaacacgccagttcgattgaactggcgtgacatgatcagcgggccggctggccttgtttgtcggcctgcggcttctttttcaatgtaaacgaaaggataaatccgatcagcgccaagacagcggccacgataaaggcggaattcatgccgtgaatgagcgcatttaacggatgagatgtcgcggcgtttttggctgaattactcatgacggaaatcagaacagccgtgccgatcgaaccgccgatctggcgcatcgtattgttcatcgctgttccgtgcggaatgaggtgcgccggaagggcattgatgcccgccgttgtgagaggcatcataatcatggaagttcccatcatccgcagcgtataaatgacgataataaatgtcagcgaagtatccatttgcaggtccgcaaacgggatggacgtcagcagcaagacggcaaacccgataatcgcaaggccttttccgccgatcttgtcaaaaatccggccgatgatcggcgacatgatgcccattgctatcgcgcccggcagaagcatcaaacccgaatcgaaagctgtcacgtctctgacgttttgcgtgtacagcggcaaaatggtctcagtaccgatcattaatgcaaaaacgatcataccaagtagcgttgttatcgtaaaagtccacgattggaaaacgcgaaactcgagtatcggccttttgattttcaattgtctagagataaagaagaacagggcgaccgcaccgactgcaaaggaaattaaaacagtattgctcccccagccttctgatccggcgttgctgaagccgtacaataaaccgccgaaacccaggctggacaggataatagatatgatgtccactgatgtttctctcaatttcgtgacgtttttcatcagcaagatgacaagcacaagatcaatcagtgcaattggcagaataatataaaataagtatctccatgtaaagctgtcgacgatccagcctgacaatgtcggtccgatggccggtgcaaatgcgatcaccaagccgaccatgcccattgcagccccgcgtttttcaaccgggaaaatcgttaaaaagatcgtctgcatgagcggcatcataattccggcgcctgcggcctgaatgatccgcgccgccagaagaaccggaaagttaggcgccaccgcaccgacgactgttcccgccgcaaagatgctcatcgccgcgatgacgagcgcgcggctcgagaatttttcgatcaaaaaggcggtaatcggaatgagaatcccgtttgtcagcatgaacgccgttgtcagccattgagcttttgtagcgtctatgttcaagtctgccataatatgcggcagtgcggtaaccaggagcgtttggttcaagatcgcgataaacgccccggcaataagcaaacctacgatgatatttctgttgtatgtctgttgttcagttcctgtactcatatcaatccctcttattcttttatactaatcgtttgtatttgtgaaacatcgtattggatggcctcgatttttccaaggtaatcaaggagagccttaattaaatacgtgcgtggctcattggcgaaaagctcctcgctcagcaaatctgcggcagacagcaattctgtcacggaaacatcgtcttgtggcagcgaagaaatcttggttttcagtttttgcaaaaggtcttcaagcaattcctcttttttgggcggtgcccagcatgatgagaaattcgaataggaggcaataatgtcttcatttaatgaacttttctgatcttcgttcagctttttctctatgaagaggtccagaactgacataatgaatggcggaatcgttttaacgtcaggctgcgcttttccagtgccgactaaaaacaggaattccctcatcagcccgtggaaaatgatgacgatatcccatataaacggctcgacctcttcgccgtacgcttgaatgatagagtctttatgccagctgataatcattgattttgtttctttcagatgctttttaaatactgcggtatccggagatgatccctcattggagatgaaattgataaattggcggttttccctgaattccgtaatctccaaagcgatttttttagcgaatctttctttcggcgtcagcgaggtttccgtattgatgacggcgcttttgttcagcatttcatgctttctgaacttgatcaatgccagcagaagatcttctttagattgaaacagtttataaatagatgcttttgacattttgcattcttcagcgatcgcttgcattgcaacattgtgatagcctttttgggcaaacagctttttggcggcccttaagactgctgcttttttttcgttcattccggctccttctttcgcaatgataaaactcatgggtcactaaaaaacccatgagttttcataaatgaaatattaacagaccgaacagtttcggtcaacgattttgttttgggtcacgatgaaggctgatccaatcagccgcttctccgtatgaaagcacgccgtccgtcatacgattgaaggcgccgcggcggatgatgtcttcaccgatctttttcaccagtgacagtgcagctctgaaaggggcggatccgcagctgatcctttcaatccccagttcggaaagaatctgtaaagagggggtgtgtgagccggccagcacgttgatcggcccggatataccttttctcagcccggcaatggtgcctgcatcatcggctccggggataaaaatgcagtccgcgcctgcttgactgtaccgatttgcccgccggactgctgcttgaagacgggagccgggggcgtcagcattgagccagtacacatccgtacgggcattgattaaaacaggaaggttcagttttttaacagccgttattttttcttccattaatgttgcatcagaaagcggccggcaggggtctttcgttccgtcttcaatattcataccgacaaccccggcagctgcggctttttttgcgttttcagcgactgtttccggtgtttggccgtaacccgcttcaagatctgcactgacgggaatatcgacggcatccgtgatggttttcagtacggaaagcaatgtttcaaaggggagatgttcgccgtcgggatagccgagggacatagcgattccggcgctggttgtcccgactgctttaaaaccgcagttttgaaatgctttggcgctggctgcatcccatgcatttggcagaacgaatgggtctgactgatgatggagatccagaaatgtttgatactttgcaaatgatttcatgtattccactccttttttacatagtgtaaatgtaaagaccttcgatgctcatcgaaatgtggaatggaacgcatggaaaaaggctatcgatcaccgatagcctaaagcatctattcgagtttaaatccttgtttctcaagcatttcacggatgtgaggatagtacactttattgtaataagcggatatgccctgagaccagtttcttgtttcctgtccgttagtccgttttgtcatgtattcggatatttcttcatcgtacgcgtcgatcagcggttttaaatccggttgatacgtttcgctgtgccttaccgcttgttccgggaggcgcggctttttggcggagcggtccgccggatggccgacgacaagtcctgcgacagggaagacgtattcaggaatattgagcagtttgatcaactcttctgcacggccgcggaccgcgccgatcggcacagtgccaagtcccatcgattcagcggctgctgtggccgtcccgagggcgatgcctgcgtcgacagctccgacaagcacggattccattccgtctgtgatcgcaagcgtttcgccgtttttctcaagggcgattttcgcacggttgaagtccgcgcagaacaaaaggaaaacaggggcctgctcgatccagacctgtccgccggccagttcggcaattttctttttccgttcctcatcctgaaccgtaatcacggtgacctgctggccgttaatggaattcggcgcggcttgaacggcttgaataatgtcgtccagctgttcagggctcacgggctcatctgtatagctgcggattgatctatggtctttcaatgttttcaatacttcattcattagaaactcatcctttctttaatccgttgtgtgcgttttaaccacattcaggggttctgataaaaggtcgcccgccgcttgaacgaaagcttgaaaatgctctgtctgattatgtgcgtcaagcgcgtcttgatccttccattgctcaagcatgacaaatgtattggcatgttcggtatcttcaaacagctggtactgggcattgccggcttcagctcttgaatgtttaagaagcggttgtacgctttcgagaaaggcgtctcgtttttctggttttactttcatataggcttgcaatacgatcattggatcaaacctccattatgtcatttagaattccttttcgtgtgcgttgtatacacagggaattgattgttcgaaaatcttcgaacaattgaatcgtaacatgtccttgcattgccggcaacccatttgcctccttgatgaattgtcttgaagttaggattatgatacatttaacccatgaaaacaaatgaaatgaagttaacagccgttctccaagccttgagtgatccttacaggcttgagattgtcaaagcattggctgacacagccgagaaaacgtgcggtacgtgcacaaatctcaatattgcaaagtctacgctgtcccaccacttcaaggtgctgagggaagcgggtctgctcaaagtccgcatcgaagggaagcatcattattactccctctgcaaacgggaattggaggagcagtttccgggactgatcgaggcggttctcaaggtagaaaaggaacggtggtaaacggaccagatgtcggctttttaaagccaggctgataccggcaggaaagaacctgccggtatttttaaagcttctcatcaccgcataccgcttcataaagcttggcagtcccttcgtcgatctgatcggcagcgattttggcgaatccgagcacgagcgataccgttccttcatgttttgtctgctctttctttaacgtaaaccgactcatgccgtaaacctcgacccgcctttcctttgctcttaataaaacctcttcttcacttctatccgtttcaaaatcggccacaaagtgaaggcctgcgctctcgcctttaattttgacccggccgttaaagtgtttgacaaggcttccgatcagccttgtccgctttttttcgtaaatctggttcattttcttaatgtgcttttggtactcccccgattcgatcagttcctgcagggcgagctgcgttaagacgctgctcgattgaatcgagaaatggtgcctttttctgtatcgcttcagcagcttttgcggcagtaccatatagctgattctcaggcccggaagaagcgattttgaaaaagtgccgatgtagatgactttttcagagcggtcaaggctttgcagggcggggatcgtatcgctcccgtatttaaattcgctgtcataatcgtcttccacaatatagcggtttgccccgtcggaaacccagtttaaaagctgaatcctcctcgataccggcataatgattcctgttggaaactggtgtgaaggcgtgacaaataaaacgtccggattcagacggtgaatctcgctgatccgcattcctttatggtcgagctgaatcgtggcgacttcttttccttcatttttcagcagtcgataaatgcggctgtatcccggctcctccatcgcatagacggctgaggcggggagaaggtcctggagcgtgtgaattaaggactgcgtccctgcgctgatcacgatttgttcggggagacatttgacgcctctcgttaaagcgataaagcgtgcgatcgtttggcgcacttcgtagacgccttgcgggtgcgtcatttctccgagttcgtcaacatgtgaagaaaccgctttctgttcgcagcgaagccatgttttaaacggaaaatgcgccgtatcgacgctcatatgggaaaacgagatccagccgtctttgctttcaggctcttcaaccagttctttttccaattgaaggggaccggggtgacggctggcgtggaacgtttcgatctgctctacaaaaaagccttttctttcacgcgaataaagataaccttctgccagaagctgctggtaggcggcgttgaccgaattgatgctgacgttcaatgtttcggcgagctctcgcttggatgggagctttttccccggcaaaaggttgcggctgaaaatttcttctttaatccgttgatagatttggtgataaatatattccgcgcccttggagcggtcaatcggtattgtgatcatagcgcctccctctggtaccatcaaaaattaatgattggtacttttcatcataccaaaaaatattcagaattataagaaataaaagtgggggagagattttttatgagtcggaacacaaaagcattcacaacggaagattggcaggccaaacgggatcaattcgtggcaaggggtgtctccaacggaaatcgtcatctggccgctaaaggggaaggtgccgttttatatgatattgacggacgccgttttatcgattttgccggggcgatcggcacattaaatgtcgggcattcacatccgaaagttgtagaagctgtcaagcggcaggccgaacagctcatccatcccggttttaacgtcatgatgtatccggcctatttggaattggcggaaaagctttgccggcttgcgccgggcgcccatgagaaaaaagcgattttcctgaactcgggtgcggaagccgtagaaaacgccgtgaaaatcgccagaaaatatacgaagcgtcaagccgtcgtttcttttacccgcggattccacggacgcacaaacatgacgatgagcatgacgagcaaggtgaaaccgtacaaattcggattcggtccttttgcacccgaggtatatcaggcgccgtttccttactactatagaaagcctgaagggatgactgatgaaagctatgatgacatggttattcaggcgtttgacgatttcttcgtctcgtctgttgctccggagacggttgcttgcgtcgtcatggagccggtacagggagaaggcggttttatcattccttcaaaacggtttgtgcagcatgtcgcagccttctgccaaaaacacggcatcgtttttgtcgctgatgagattcaaacaggctttgccagaacgggcaaatattttgcgattgagcattttgatgtcgttcctgatcttgtgacagtgtcaaaatcgctggctgccggcgttccgctcagcggcgtcatcggccgggcggaaatgctcgatgcggcggatccgggtgaactcgggggcacctacgccggaagtccgcttggatgcgtagccgctttggcagtgctcgatattatcgaatcggaacagctcaacaagcgctctgaagaaatcggcaaagccatcgaagagcgggcgcttgaatggaagatgaaatatccgcagattggggaagtccgccgacttggcgcaatggctgcgattgaaattgtccgggacgaaaagacgcgggagccggacaaagcagctgcggccaagattgccaagtacgccaatgaacacggtctgctcttgttgacggcagggatcaacggcaacattatccgttttctgtctccgctcgtcattactgatgaattacttgaggaagggttcggcatcattgaagaagcgctggaacagctctagtttgacatcttctaaaagaaggagcggattttgatgggtaaacagcaaatgaaaaaaacgatgtcgcagacggatgtgctatttttagcgatcggagctatgctcggctggggctgggtcgtcctttccggcgactggatttcgacagccggctttttgggcagcacgatcgcgtttatcatcggcggcatactcgtcatcttaatcgggttaacgtacgcggagctgtcttctgccatccctgaaacgggtggcggcttgattttcgtctacagggcgttcggacgaaaaacggcttttgtcgccgcttggggtgtgctgttcggctatgtttcggtgattacatttgaggcggtcgcattgcctaccgtcatcgattacgtcctgcctgtcgaacatcaggggtttctctggtcgctaagcggctgggacgtgtatgtcacttgggtgttgatcggttcgggaggtgcggtcgtcctgacagcgctcaattacttcggcgtcaagccggccgcgatttttcagtcggtctttacgattgcgattatcgccacgggctttctccttttgggcggcgccttggtaaacggtgatttcgaacatgtacagcccctttttaaagacgggttttccggtatgatgtccgtccttgtcatgattccgtttctatttgtcggatttgacgtcatccctcaggttgcggctgaaattaatgccccgaaaaaaatcatcggcaaaattttgattatttcgattatcagtgcggtcgtgttttatttgctgattgtattcggcgtaacgatgggtctgtcagaaagcgagcttgcgacgacttctttggcaaccgcggatgcaatggtcaatctgctcgggaaccagctgttcggcacggtgcttgtcctcggcggcgtcgccggaatcattacgagctggaacgcatttatcatcggcgcgagccggattctgtttgcaatgtcggaaaagggcatggtgccgaaatggttcggcttcatccatccgaagtataaaacgccgactaatgcaattttatttctgggtgcgctggcgttttttgccccgctgctcggacgccctgcccttgtttggatcgtcaatgcagggggaacaggtattatagtcggatatttgatcgtctcgattgcattcatgaagctgagaaaaacagagccggatttacacaggccgtataaaatcaataagtggaaaacaacgggtatatctgctatcctcttaagtgttatcttccttgccttttatttgccaggcatgccggccgcgctcacatggccgtatgagtggctgatcttggcgggatggacattgatcggttttcttttatacaacagcagttcaaaacgtaaaggggaggagattcaacatgaccagcatgctagaagtatataatcctgcgactggagaaaaaatcaaatcggttccccagcaatccgcaaaggaagtcgaagaagctgtcgtacgctcgcatgaggcatttcaaaaatggtcgaaaacatcggctgcagaacgagcgggcttgctgaaaaaatggtttgatttaattgtggagcagaaggacgagctggcaaaattgattacgcttgaaaacggcaagccgtacgctgaagcgcagggcgaagtcttatatagcgcaggctatatcgaatggtatgcggaggaagcgaagcgcatctacggaagaacggttcccgcctctgtgacgaacaagcgcatcatcgtcacacgccagggagtcggacctgttgcggcgattaccccgtggaattttccggcggcgatgatcacgagaaaagcggggccggctttggcggcgggctgtacctttatcatcaagccggcgcctgatacgcctttaacggcgcttgagctcgtccgtctcgggcacgaagcgggcattccgaaagacgtccttcaatgtgtgatcggcgacggacaagagatcggctctatttttacaagccatccgctgatccgcaagattacgttcaccgggtcaacacctgtcggcaaacatttaatgaaaaacagcgccgagacggtgaagcatgtgtcaatggagctcggcggccatgccccgctgatcgttgatgaagatgccaacattgacctcgccgttaagcagacgatgctttcgaaatacaggaatgccggacaaacgtgcgtctgtgcaaaccgtctgatcgttcatgaatcggttaaggatgaatttgcagaaaaactccgcgcggaagttgccaagctgaaagtcgggaacggactcgaagaaggtgtatcaatcgggccgatcatcaataaaaacggcttccaaaaaatcgtcgatcaaatcaatgacgcggtgaataaaggggcgaaagttctcatcggcgccgaatatgaaagcgatgatgagaaatcatgctactttgtccatccgacagtgctgacggatgttgatccttcaatgacgatcatgcatgaggaaacattcggccccgttgcgccgattacgtcttttaaaacgctggacgaagcggtcaagctcgccaatgatacgccttacggtttagcggcatacttctttacggaaaactaccgccgcggcatctatttatccgaaaaccttgattacggcattctcggctggaatgacggcggaccgtcaaccgttcaggcgcctttcggcggcatgaaggaaagcggtatcggacgcgaaggcggactggaaggcatcgagccgtatttggaaacaaaatatttgtccatcggtttggatgaataacaagacaacatgaaaacccgcccgtatatccccgggcgggttttttttacgctttcatctgttcagcgtttattttatcctttttgggctgataggaatataaaaaatgcctaaaagaagcagggcgatcccggcccaggaaacaagaggcagcgattccctgacaagcacggttcccaacagcgacgctgtaagcggttcagcaagcgacagcgtcaccgccgttgaggcgggcacttttgccaatcctgtcgtaaataacaggtacgcggctccggttgcaatgaccccgatatagaggctgacagccattccctgaaccgatgagatccagccgagatcgtacagaaacaacaacggggcaagcaatacagcgcttaaaaagaatacggtgcctgtgacagcctccggcttttgcttttgcaggagtttcttgcttgtcagcgtgtagacggcaaaggaaagaccggcgccaagtgcgagcagtatgccgagaaagctcccccccgatgaggcggagggaatgaataataaggctacgcctgctatcgctgcagcagttgcgatccaccatttcgtctgcggaacctttttgaacaccagccattcgaggcagccggcaataatcggagcgctgccgatggcgacgaccgttccgacggcgattcctgacaggctgacggctgaaaaaaagaaaggctggtaaaatgccatgctcaatgctgcgatgatcagcgttttaacgggccagccgcttcgtttcaattgaccgcggaaagccgcgaacaagagcagggtgatgccgccgacagccattctgacagcgccgaacacaagaggtgccgcctctttcggcgcaaatgcctgggttgttcccgtcgttccccataaaattgccgcaagcaagacaaacagaaccgatactttcatactaacgatctctccctactcgatcattcagaactttttctattgtaagataagtttgcggatttttgaatcgccgcttcggaaatttccctgaaaagaggaaatattcaacgctggccgaattcatataatggccaaaaaacaattaaagtcggaggaagcggatgaaaaaacgaacagttttattcttcttgttgatctggctcgccggatgtgcgagcgcccaagaggctgaggaacaaaccaaatgggtgaacagcgaacagaaagcgattgagaacggcattcgttatgaaagcattacaaaagacgatattatagacaaaatcgatttaaacggtgaacaagtcgtcgtttttcgattcggcgattcggagggagaggggattggcctcgcacacatcaaaagggaaaacggcaactatcaatggtaccgcgacttaaattacgcaattgtaaaatcggaccacccgaaaacggagaatgcggaagcttccgcgccgttcacaacccctaagggaagaaagtacacgttatatacaggggatgcagatcgcctgaatggtacatttgagactgatgacgggcttcatttggagccggtggtcgatcaaaaaacgggcatgtattatcagatcgtgcaggattcggactgaaatgaaacaaaaatgctgtcgggttgttcccgacagcatttcattttttacgatttctttttccgcactgtcaagagcagcgcagcacctccaagaagcacggcgaggatcgacaggatcagggaagcggtttgaatcccttgtcctccttgactgtcttcattttctgcggcagcgttttgtttcgttgaagcgccgtgtgcatcaaccgtttcgtgtccgagttttgcagcgtcgacaatgcttgtgattgcatgcggggtatcggcgtcatcatcaccggtccactcgacaattgtgccgtccttataatattggtatgcgttccaggcggccttttgttctttgtcagggtttttggcggtgaaggtaaactgctggaattcaccaggctgaatgccgccgttttcggcttcccacgtcacccttgttactttttcgtttttgccggtttcagtgcttgttttccaccccggcaccggttcatactgctgaaattcaacaccgtccggcatgctgagaacgaccttgatcgtggcgttgtctttttcaaccggtactttgacagtgtatgtttcccatgagcctgctgctgattcggtcggttttaccgtgacatgtgcgctgaccggcacggagaaaagcaaaaatgatgctaggattgcacccatccataatgtctttttcaacataatcaaaactcctttttattaatttttgcattgaaaactgttctgatttcctcaaatgacgccgttaatccgtgaacgcggatcttccagatgccgtcttcgcttaaatttaaatttttcgtttggaaaacaccgtctttatttttgctgaggctgaacgtgctttccttgtcatccccgaaaagcccggttttctcaacggttaattcaattttttggatatctttgacgacgtctccttttctgtttctgacggtgacttcaaacgtatttgagcccggcatgtttgggctgattcggagtgacagcgtatttccttccgtcagctgcttcgtctcactgaaaggctgcggcagcggcgcgggcggacttggaatattggtgaaaaccgccgtggtcagcagaatgagaagcccgaccgcccattcagctttcatcgaacggccgccctgctgtttcggcgcttttctaaaacgaaaatagtgaaatgccccgagtccgatcatgagaaggacgagcgccgatttcacaaggagcgcttttccgtaagccgtcccgaacaggttatccagtgtatgaacaatgaaaaagctgttgaaaaggcccgagaatatgagtagccctgctgaagcgagcgcccatggcgagaagcgccgaatggtttcccatatcaaacttttgtcaggcttcagccagtcttttccgaaaaacagcacaaacatcgcgagtccgccagtccaaatggaagcggcattcagatggatgaagttcatcgcgattgtcatatagcctgcgctcgtcgaagcggcatggccgtcgagcgatttgacgaacaatagtccggcaaaaaggaacaggctcaagatcgcgctcttcaggccttttctattcgaagagaaaacaagcaaggcgatgatggcgatgttgatcagccacagcgttccgcccgtcgtattcagaagcgtttcttttaaaagcgaaggctgaaaagccccgatccaggaaacgcctgcgtttgtttttgtttgcagtggcagctgaatgatgatggcagcccctgtcaataagagcgccacattcgtgatccgcttcagacggcgctttttgtcacccggccagccgttttcaggtcggtgccagacgagctgaaaaagagcggctcccatgaacagggagaaaccggtatacaaaaggacgcgttcaatgacgatatcggctgccggcaggcctgatgcttgattttgctgatctttcggcagcccgccttgaatgtttccgatactaaaagggatcgtgcctgatacaggatgaccgtctgcggatacggctctccattcggccgagtagatatcatcctttaacttcggtttcagcttgacggtcatgatctttgcgttttgggggtcgatttccgttttgccggaatctacccgttcacccgacgaatttctgaccgttatcgaatgaaacccgttctgaatcgcttcattgaattcgatcttaatttcttcaggcgcttttttcagctcctgattttcagcaggagttgattgtacgatataagcgtgagcaaaagcggcttttggcagcagaatggtacaaagaacagccagaactgcccagagtgttgctcttttcatcacattcatccaatctcttaacaaaatttcatgtcttcaggctgcagcagctgttcttcatcgttttctggaccagaagcgcggcatcgtcaaacgataacagctgtccgccaaagccttttttgaatttccgcgcttctgcttcagaagcgaaagggagcgcatgcggctcgcagcagttcaaatgaagatctgtatccagcaaaaagacggcagctttggcgctgatcgtcgtatccagcaaaaaatccctgcagataatctgtgatacatcatctttcactttctcatagcggagcattgcgcaatgcacgcagcaaaactgttcaatttggctgtcgtttttgacaatttgcacggcaagcctcgaacctgccccttttccgcaaacgacgcaaagctgcccaagctgctgcttcggcttgtttagcgtaattccgcctgcggtcttgatgacctgcccgttttcaacgagcggtttaatgtcgcggtaaacggtcatttcagagacgttcagccttttcgaaatttccgaaatgcgcagagattcttcttctttgatccaagccaaaatctgctcccttcttttaatcggtagcattctcctcccccgttctttatgttctgtacttataagcctagtagattgaaggaaaagaaacaagcggaacgtgataaaaaatgtgatgaaatgttgaactttaacatcgcggccaaagccgttgaatcgtcgtcaatgggtactggtcaaaccgtcctgtttctaaaattttttgtcaggaaatgtaacaggtttgcacgctttagcgatgcaatgtgaaataataatccggagcaaagctgcagaggggaggggagaaaatggggaaacaaaggcttgttttaataggaaacggcatggcaggggttcgcacggccgaagagatttcactacacggcgggagccggtttgagatcgtcatcatcggcagcgaaccacacccgggctataaccggattctgctgtcttctgtccttcagggagaaacggattggaacgatgtgatgacaaaaagccggagctggtatgaagaaaacgggattaccctttatacaggggaaacggctgtcgcaatcgatacggttaatcaaacggtggcgacagatcaaaaccgcgaaatcgcttatgacaaactgatcattgcgacgggctcttccccgtttatcctcccggttcatggtgcagacaaagaaggggtatatggttttagaacaatagacgattgccgggcattcataaacgcatcaaagcgatttaaaaaagcggccgtcatcggcgggggaatattgggccttgaggcggcgcggggattggcaaacctcgggatgaaggttgatgtggttcaccactcttcctccatcatgcagactcagcttgatccgccggcttctgccatgctccagaaagagctggagcgtcaagggatccattttcttttggagaaagatacagaggcgattttaggaacatcgcgcgccgagggtgtgcggtttaaagacgggacgaagatcagcgccgatctcgtcgtcatggctgccggtgtcagaccgaatatcgaactggccaaggcgagcggtatttcaaccaacagggcgatcatcgtcagcgactatatggagacaaatgttccaaatgtctacgccgtcggtgaatgcgcggagcataacggaacggtctacggcttagtcaagccactgtatgagcaggggaaagtgctggccaaacatatttgcggcctcgaatgttccggttatcagggctccgttcagtccgcggctttaaaaatgtccggaatcgacgtcttttcggcagggaaaatcacagaggacgactcgacgacggctattaaacttttagacgaagcggccggagtctataaaaaagcggtctttcaaggggataaaatggccggcgtcattttatacggagacaccagcggcagccaaaggctgttggaaagcatcatcaaacaaagggatattaccgttgtcaaaaaagagctgtttcaatcggaggaagacagttcagtcgcttctatggcggttcgtgaaacgatctgccaatgcaacgcggtttcaaaaggcatgatcatggaagcgatacagacgcacggtttaaagacggccgaggaggtcaaacgctgtacaaaagcttccgggtcatgcggcggctgcaggccgttggtcgaggaactgctcctccataccgccgaacatgatggtcacatatctgcggcggaacaaccgatgtgcgcctgcacttcattcacggaagatgaagtcgtgaacgaaatacagatgagaaatctttcttccgttcacgaagtcatctcggcgctcggctggaaaaatagcagcggatgccggatttgcgtgcccgcgcttcactactatttaaaaatgatccgtccggacatcgcctatgaggagcacgaagaggagacggatgccatcatcccgcaaatgtacggaggccggacgaatgccgaagagctgaagcgcattgcaggagtgattgaaaaatatcaaattcaagaggtgtacatgacacaccatcagagattaaagcttgccggcatcaagccggagcatatagagcgcgtgaaagaagaactcggcatgccgtattgcctgccgcaacagcagcggatcgccgcggttaaaacgtgcccatgcggatcaccgcagattcaaacattggcagcagacttggaaaaagcagcagaatccctcctcattccggccaaggtctccattggggtgtcgggctgtttggacgattgcgtgtacgcttcagttcatgacatcggacttctcaaagtaaacggaggatgggagatttatgcgggcggccaaggaggacagcatgcttccccgggagagctgctttcagtagccgactcggcggaggaagcgggtgaactcatgaaaggcctgcttcaatattaccgcgaaacagcaaactatcttgagaagatcgggcattggattgaacgcgccggcatcattcatatccgggaagttttatttgacaacggacttcgcggccagctgttcgaacggcttgaaaaagaaaagcggctggctcagcaagaaatgataaaagggctgatgtgaaatgacagaacgattgctaaagtactttcgcacaaagcaaaaagaagtgcaatccgaaaaaacgtatgacacccaatgtccattttgcagcatgcagtgcaaaatgcagctcattgaacagacgattgtgacaagaaaaaaatacacggcggtcggaaaagacaatccgacgacaaaggggcggctgtgcatgaaagggatgaacgcccatcagcacgcgtttcattcagagagaatcacccatccgctgatcaaaaaaaacggcgaatttgtccgtgtatcatgggaagaagcgcttcagtacatcaaagaacaagtaacagcgatccagcatgaagacggccgcgatgctttgagtgtatacggcagcgcgtccattacaaacgaagaagcgtacctgctcgggaagttcgcccgcgtcgccttgaagacgaagcatattgactacaacggcaggctttgcatgtcggcggccgcaacagctgcaaatcaaaccttcggaatggaccggggactgacaaatgccctttccgagatcccccatgcaagggtcatcatcctcgcaggtacgaatatcgccgagtgccagccgacgatcatgccgtattttgaagaagcgaagcaaaacagggcgtacatcatcgtcattgatccccgcgaaacggcaacggccaagatcgccgacctgcatttgaaaatcaagccgggaacagacgccgcgctcgcaaacggaatgctgaaaatcatcattgaagaacagctgacagacggagcttttatcagagatagagctgaagggtttgaagaggtcaagcgccatgtagcatctttatcgcttgaagacatttcggccaaaaccgggatacaaatcgagcagatcaaaaaagccgcggtaaaattcgcccgcgaggagacgggaatgctgttcacggcaagaggggttgaacagcagactgacggaacggctgctgtaagaaatttactgaatattctaatatcaacggggaaaatcggcaaatatgcttgcggctacggcgccgtcaccgggcaaggaaacgggcagggggcgcgggagcacgggcagaaagcagaccagctgccaggttaccgttcgattgaaaatgaagccgaccgcgcctatattgcggatgtttggggcataaaagctgaagatcttccgggaaaaggcgtatccgcttatgaaatgatgaagaaagttcatgaaggcgaaattacaggaatgtttttaatgtgttcaaaccctgttgtatccagcccgaccgccggctttgtcaaatccgctttgggtaaattaaagttttttgccgccgttgatttgtttctttctgaaacggcaatactcgcggatgtcgttctcccagcatcatcctatctcgaggacgaaggaacgatgaccaatctggaaggcagagtgacattaagggaagcctcaaagccgtgtcccggtgaagcgaggcatgactggcaaattatttgcgatatcgctaaagcgcttggaaaaggccgctatttttcatatcgatcggcagaggatgtttttaatgaattgagaaaagcgagccgcggcggaattgccgactattcgggcatcacctatgaacgtctgagaaaggaaggcggcattttatggccctgtccagaagaggggcaccctggaacacagcgcctgtttgaatcatccttctcccacccggacaaaaaagcaagaatgtgcgtcgtcccgaacgaaccaaaggtcaaaaaagatgtaccgactgaggagtatccccttattctgacgaccggaagggtgatgtctcactatttaaccggggtacagacgagaaggagcgctgcgctcaaggcgagacactttgaatcatttatggaaatccatccgaaaacggcggaaaagtacaatattggcgaccgggtgctggtcagggtggaatcaaaaagaggcagcatcatcgtcaggagcaaatggtcggaagccatcaggccggataccgtttttgtaccgatacattgggcggattcgcaaaatgtgaacgatttgatagcggaaacgctcgatccgtcctgcagcatgccgggatttaaggtttgctccgtgaaaattcgtccgtcagttgacaattttgtgaataaattgtcataaaaagtcataaaaagtttacaaaattaactataatttgtgatagttttaaagatgtaaatagaatacttgtttagggcgtatagtgaattgttttgaaaaaggggaggatcatagtgaaaaaaaagcagcttgtccttgtagggaacggtatggccggggtcagggccattgaagaaattcttaaaatttcaaacgaagagtttcagatcacgattttcggcagcgaaccgcacccaaactataaccggattcttctttccaaagtgcttcaaggagatacggatgttaaggacattacactgaatgattgggattggtatgaagaaaacggcattcagctgtatacaggtgaagaagtcgttaaagttgatccggagtccaaaaccgtcatcacggatacgggaagagtccagccgtatgatgaactgattttggcgacaggttctctcccttttattctgccattgcccggagcggataaagaaggtgtaacagctttccgtgatatcaaggatacggatatcatgctcgaagcttccaaaacgtacaaaaaagcagcagttatcggcggcgggctgctgggactggaagcagcgcgcggacttctcaaccttggcatggatgttaccgttgtccacctcgcgccatatttgatggagcgtcagcttgatgcagccgcaggacggcttttgcaaaaagagctggaaaagcagggcatgaaatttttactggaaaagcagaccgaagaaatttacggagaaacacgtgtcgaaggcttaaaattcaaagacggctcaacgcttgaggccgatttggtcgtcatggcggtcggaatcaagccgaacgttcagctcggcaaagactgcggccttccggtaaacagaggaatcgtcgtcaatgattacatggagaccgaagttcccaacatttacgctgtcggagaatgcgcggagcataggggcattgcctacggacttgtcgcgcctctttatgaacaggcaaaagtgcttgccaaaaaaatctgcggcgttgaaacggctccgtatgaaggatctgttttatctacccagctgaaggtttccggtgttgaggtcttttctgccggtgactttaatgaggatgacggagaagacaaaaaagcgctcaaagtgtttgacgaacaggacggaatctacaaaaaaatcgttctgcgcggcaatcaggtgatcggcgccgtactgttcggagacagcagcgaaggaaacaggctgttttccatgattcaaaaaggagcggatatttctgatacttcaaaaatttcaatcttgcagcctttgaatcaggaagaaggcatgagcttgaccgctgcgatgagcgacgatgagatcgtgtgcggctgcaacggcgtttcgaaaggaatgatcattcaggcgatcaaagagcagggatgcacatcgacggatgaaattaaagcatgcacaggcgcatcgcgctcttgcggaggatgtaagccgcttgtcgcagagattctccagcatacgctcggctcagaatttgatgcttcagcacaaaaagaagcgatttgcggatgtacggacctttcaagagacgaactcgtggccgaaatcagagaaaaagggctgacccatacaaaagaagtcatgaacgtgctcggctggaaaacggcggaaggctgttccaaatgccgccctgcgcttaactactacctcggcatgatcaatccgaaggaatatgaagatgaaagagaatcccgcttcgtcaatgaacggatgcacgccaacattcaaaaagacggcacatattcagtcgtaccgcggatgtacggcggggtcaccaattcgaatgacttgcggcgcatcgccgatgtcgtcgacaaatatgaaattcctctagtgaaaatgaccggcggccagcggatcgatctgatcggcgtcaaaaaagaggatcttccgaaagtatgggctgatcttgacatgccttctggatttgcttacggaaaaacgctcagaaccgtaaaaacgtgcgtaggcgaacagttctgccgcttcggaacgcaagattcaatggctctcggaattgaccttgagaaaaaatttgaagggctctacacgcctcacaaaattaaaatggcggtttccgcttgtccgagaaactgtgctgaatccggcattaaagatatcggcgttgtcggcatcgacggcggctgggaaatttacgtcggcggaaacggaggcacacatctgcgtgcaggcgatctgttaatgaaagtcaaaacggctgaagaagtcatcgaaatcacaggcgcatatctccaatactatcgtgaaacagccaactatttagagcggacatctgcatggatcgaacgtgtcggcttgtcccacgtccaatccgtattgaatgataaagaaaaacgcaaagagctgaatgaccgcatcaatcaagcgctgtctgtccataaagacccgtggaaagactttttggaagacggaaagacaacaagacagctattcgaaaatgttgtcacttcctaaaatgaaaaaccaacttgaggaggaattcacatggtgaacaagaacttaacaaaggtgtttgtttcgaagatcggggatttgccgaatcagcttgggaagacagtgttcatcaaggacaaggaaatcgcggtattcaagctttcaaacggcagcgtccgcgcgattgaaaaccgctgcccccacaaagggggcgtgcttgccgaaggaatggtaagcggcgaattcgtcttctgtccgatgcacgactggaagatcagccttgaagacggcaaagtccaagagcctgacacggggtgtgtgcagacatacgaaacggtcgttgaaggcgaagatttgtatatcgtttattaaacggcgcaacaagcgaaacgcaatatttcaaaagccttaagggtcgcagaacgtgacccctctttattaaaaaaacaaacgcgttcacataatcggcagatggaaggatgacagttgatggggaatgggaaagtttattttgtcggggccggaccgggcgattcaggattgatcacattaaaaggaagaacgctgatcgaggcggcggatgtcatattgtatgacaggctcgtcaattcccggctgcttgagcatgcaaaagcatcatgcgaatttgtctactgcggcaagctcccggaccgccattatatgaggcaaagtgaaatcaatgcactgctcattgaaaaggggctgaaaggcctcaaagtggtccggctgaaaggaggagacccgagcgtgtttggcagagtcggggaagaagcggccgccgtcagcgaacacggcatcccgtacgagatggtgccaggcattacatcgggaatcgccgctcctctttatgccggactgcctgtgacccaccgcgatttcgcttcatcctttgccgttgtcaccgcccatgataaatcgggcaaaccggagatgaattgggaagggctggccaagggcgtccaaaccctcgtcttttacatggggatcaaaaaccttggttatatatgcgagcagctgatgaaacacggcaagtccccccttgttcccgcaatggccatccaatggggcacatggggccggcagcggagtgttaaagggacattgcagaatatcagggagaaaataaccgagcatcagatcaaaaatcccgcgattatcgtcatcggcgacatcgtatcattcaggcagaacagctggtttgaagaaaagcctttgatcgggctgaacatcatggcagtcaaaagctgtgaagaagaacaaattccagtggaggcgcttcgtgaacaaggcgctgaagttgtggaatggccgaaatggaaatcggccgaaacggtgcctgacgatgcacttttaggtcgaatcgcttgttttgacagcctgctgttcacctcaagtgcgtcactgcgcagatttttcagccggcttgctgctttgaagatcgatgtcagggaaatgcgcggaaggctttacgcttcagatcagcatgtaaaagcagctcttgaagaacggggatttgaagcctttctgcaaacggaaatgccggtctcgggcagctgtttgctgatcggcagccgggaagccgtgcaaaattacccgcactccgggtgcgaggtattgattacacatgacagggtgatcgacagccgctttacctcgatcatcaaacgggaaattgatgagtttcctattgatatagtgttgttttcaaatcgaacatgcgtcgagctgttcgtaaacgaggcggagacagtcggcctccatccggaaaaaacggctgcccgtcttcaggcgttctgcctcactgaagaagcgggggagagagctgcagccgtagggtttcagcgcgttcatgcagtgaatgatcgcgatcgcctgccggatgtcatcaaagagatcaaccgaacagccgaatttgtctgtcagagctgaaaaaagcagggggaaccctgcttttttagcgtgcggcactgcttctgaacaacacctcttttaagtagcaaaggtctgcctctatatgcttcctcattgattcggctgcttttgcgtcatttctgtcctgcatgtgacgcagaatctcctcgtgctgattgatgatttcaagagtgcgctccggtttttcaaggtttttgctccggtagaaaaaggtcagcgaccgtaaatcaagcagctgtttttgcaggcgttcgttttcgctcgcttcgatgatggcatcatgaaattgcgtatttaggcgaagcagagcattagccgactccggaccttggcttttctggtgcttatgcgcctcagagagcgtttcggaaatgagctccagtgtttcattagaggcaaggcgagtcgccaaagaaacggccagggattcgagcgcctgacggcattggtatatttcttcaagatctttgattgtcggttcataaactgtaatttttgatttatcatctatcaataacaggccttcttgttcaagtgtccgaatcgcctctctgacggggctgcggctcacttgcagctccttggcgattttggattcatagatccgttcgccgggctgatatcctcctttaataatcatatcttttaaataatgatggacttgatcatgataagagactgcacgttggatcgaaaacttcacgctgttcacctcgtttatttttcactgcggaaatcactaatagtctagcaaaagagagaaataccatcaatctaaaattaccataatattgagtattttgtgacaaaaaagtgttgactgccattagctgtccgttataattaagttataactgtcgacagtcggcagattactttttgattattattgtaagcgctttatagatagaggggaagggggagttttttatgaaatcaagcgttgtgtcagcatgggatatgctttggagatcacaccgggaagcaaagaggctgcttttgttcgccatgcctgtcagggcgggaaaagatgccggtttaaagataaattcggaacaaaccatgaaggaagagaagccgccgagctataaaacgcctcaaaaaatcgggctgctgcttggtcctgcattgtttttcgctgtccttttgttcttttttcccgagggtctgagctatgaaggtagaatggtattggcgactactttgtgggttgcggtttggtggattacggaggctgttccgattccggctgcatcattgctgccgatcgtgctgcttccgctgacgggggcgctggaaggggcagctgtcacgtcgagctacggcgatccgatcgtctttttattcttagggggcttcttgattgcacttgcgatggaacgttggaatctccataaacggattgcgctcaatattatttctgtagtgggcacgagcacctcgaggatcgtcctcggttttatggcggccacaggatttttgtctatgtgggtctcaaatacggccgcggtgatgatgatgcttccaattggaaccgctatcattcatcaggtatcagctgtcataaagtctgaaagaaaagatttagccgcagaagaggcgaaattttcaaaagcgctgatcttcagcatcgggtatgcggggacaatcggcggactcggtacgctgatcggcacgccgccgaacattattttggcggccaatattaagaagctgtacggagttgaagtgtctttcggcggatggatggcttttgccgttccggtcgtcgtcattttgcttgtagcggtatggctgtacttgacgaaagtggcgcatccgatcaagatgaaggagcttccgggcggaaaagaattgattctcgaagaaaaaagaaagcttggaaagatgagttttgaagaaacaatggttctgctcgtcttcgggtttgccgcgtttatgtgggtgacgagaacgtttttatgggatgacaaaataccgggtattgacgatacaatgattgcgatattcgccgcttcattgctcttcttgatcccttcgctcaataaagggggcagggtattggactggtcggtatcaaaggacttgccgtgggggattctccttttattcggaggaggcttggcgctcgcaacaggttttaaagaaacgggtctggcggagtggatcggcggaaggctgacggtattggatggatttaactttgtggttattgtcatcatctcaacggcattggtgctgtttttgacggagattacgtcgaatacggctacggcgaccatgattctgcctgtactggcctcgctcgctttagcgctgaatgttcatccgtacgcattaatggtgcctgctgcaatggcggcaaactgcgccttcatgctgccggtcggcacgccgccgaatgcaattattttcgcatcgggcaaattgaagatcagcgaaatggttcgaaccggctttgtcattaatattttcacgctaattttaatcgtcggagctgtgttctacattcttccgcatttatggggagtagatctgaccgtcttccccgacaatctgaaatcgaattgatgaagcgaagccggagcttaagccccggcttttggtcatggtgaagcttgcaattgatcgttcagcagccatttaaaaagagaaaaaaatgaaactgctgaaaaaaaagatgatcagcatgaacaaccctgtactgccgcatcgatacccatttctattcatagattgtgttgtagagagtgagccgggaaaatgggtgaaaggctataaattcataacggaaaacgactggttcatcaccgaaaatcaaaaggaaatgccattttcatcttaatagaagcgctggctcagaccgcagcatttactgcgttgaaagaaccggctgaaatcggctttctgtcttcggtgaaaaaagccgaatgcaccggcaaggccgttgtgggagacaaacttgatctatactttgaagtttcccgctataaacgggggtttttattcggcaaaggaaccgcctcagtaaacggaaaacctgcagtgaaagcagagatcggaatttttatggagcaaagtgaaagcgggggagaagattgatagaaataaagcctgtcgcgtttgtggaaaacttgcggactttcccgaaggatgatcattggggcgatgtgatttctgaaattaagttggctgaaggcatccatccggacgctttaaaagggatcgaagaattttcccatttggacattatcttttactttcatcaagtaaaagaggaacacattcaatataaggcgaggcgcccgagaaacaataaaaactatcctgagacaggcattttcgcccaacggggaaaaaacaggccgaacaggctcggcgcgaccgttgtcaccctccttgaaaaatccgggagcaagcttgtagtgaaagggttggatgcgattgacggaacacctgtaatcgatatcaaaccggtgatgaaagagtttctcccgaaaggacaaatcatacagccgaaatggtcggaagatttgatgaaagtatattggcatgcagctgattgatagaaaaaacctctcaacaccttctgagaggttttttcatgcttatacgataaaaaagaaggatatcagaccaatcttgaagatcggaagtcccatgaattgtgcccaatcggcaaacaaaatgaaagcgctttattatatgatgtcaataagggggtcgcaaaaatgatcaacgagaaacgtcctgctcaattgctccaatatttgctgcgtgtcagagaggcgacaatgcatcagctgattgatcattttcaattatcgaaacggcaaatctgctatgacctggacaaaatcaatcattggctgaccggcaagcagctgcctgaaatcgaatataaaagaaagaacaggctggccgttccggaaacattgcttgaattgcggttctccgaagcctgttcagacatcggccgctcgtttatttttacgcaggaagagcggatcaaggccttgtacatgtttctgtttgtccgcagggagccgatttcatccgctcatctgacacagctattgcaggtcagcaaaaatacggtcatgaatgatgtgaaaaaagcgaatgaggcgctgactccgtttttagtggcgatcaaatatacaagacagcgcggctatcatttaataggaagcgagtttgataaaagagttcccgtcatgcaccacctttcttctttcctgcaaaagccttacggcaaagaaatccttcattatattttaaaaatttccggctcgcgcgatcacaaacaacaagaatttaaaagagcggttgaacttgtctcaaaagaatacgggcttcaactcgtcgaagaaaggcttaatgaatttatctactttctgatgatgtattcgatcagagtggccgaaggaaaaattgtccgttttcaccaggaggagggtgagcttttaaagcaaagtccgctgaaaaacgcagccgtaaggcttgtgaatgagcttcggattcccgttcatgaaacggaactttgctacattttgatccagctgctcggtctttcattcggacagcagccggcacatgatccgctttatcagctgtgtgaaaaacttgtatttgaatttgaatcaagagcatgcatcacatttcccaggaggcgcgaggtggcggaatctctttaccggcacttgaagccggcatatttcagaatgaaataccgcattccgattcacaatcccttgctcagcaaaattaagaaagagcataaagaactgtttaccatcgttcaaaagctgatgcggcaccttgaagcgctgttgaacaaaccggttccagaggaagaaatcggctttatcacaattcattttggtgcattgcttgagcagccggtgcagtccgggtcatccaaaaagacggcagtcgtcgtctgtccgagcggtgtcagctcatccttaatggtcaggcgccagcttgaatcgttattttcagagattgtcgttgagaaagcgatgtctttgcaggaattcacacctgacgtctttgatcattatgatgccgtgttttccaccgttgagctgaaaaccaaaaagcgatactacatggtcaggccgctgatgacgcccgctgaaaaaagcaggcttgtcaatgaagtgtatcaggaaatgttcggtgtgaagcaaagggagcttttgacagacgaatttcttcacatcctcaagaagcatgccagtatcatagacgaaaaaggactaagagaatcattgaaaaatattgcatttgttcaaaaagtgacggaaacaagggggaaacgaccagtgctgaaagatcttctgacagatgaaaccattcaaatggccgaccaaatcaaaggctgggaagaagcgattcaaacagcggcaaagcctttgcttgataaggaggtgatcttgaaggaatacacggatgccatgatcgacaatgtcaaaacgatgggaccttatatgattatcggccccgagattgccatccctcatgcaagacctgaaaagggcgtccaaaaggtgggaatgagtctcctgaaactgaaggagccggtctattttttggatgatgagcagtatccggtaaggcttttgttttgcattgcggcggttgaccatacgacacatctgaaagcactttcccaactgacccggcttctcagcaataaagaaaatcaggattccttaaaggaaaccgagtcgttggagcatatcaaacgtttaatcgaagcctattcatccaattaaaaacaggagggataatatgaagatattggcagtttgcggatcaggactcggaagcagttttatgctggaaatgaatattaaggatattttgcaggaaatggggttaatggagatcgaggtggatcattcggatttgagttcagcgtctcctgatcaagcggatttgtttatcgttgccaaagatatcgcagaaggagcggcccacctgcgcgatatcgtcgtgcttgaaagcattatagacatggatgaactgaaaacaaaactggttaaaacattgcaggaaaaaggagtgctttaatcacagaaaaggaggaactgcaaatgggtgaaagagcactaaagctgatgatggatgtgttaagccagccggctgtattaattgcagccatttctcttatcggtcttctgcttcaaaaaaagcctgccaatgaaattgtgaaagggacgaccaaatcgtttttaggctttatcgtgatttcagccggggcgggcatccttgttggctcgcttgagccgttcggaaagatgtttcaagcagcctttcatgtgaacggcgtcgttccgaacaatgaagcgattgtcgcgatggcgctcaatgaatacgggacggcaacagcgctgatcatgtttttcgggatgctgtccaacatcttaattgcccgttttaccagattaaaatacatttttttgaccgggcatcacacattgtatatggcatgtttaatcgccgttatactggcggtggcgggtttgaagggcccgtttttgatcggcgtcggagctgtttcgctcggcttgacaatgagtttgtttccggcgatggttcagccttttatgaaaaagataaccggcaatgataaggtcgcgttcggccatttttcttcaatcggttacgctgtgtccgggttaatcggcaaagcggcaggcaagggctcgcgctcaactgaaaaaatccggtttccaaacggcctcggatttttaagggacagctctgtcagcattgcgctcactatgaccatcttgtacgttttgattgccttatttgcaggggcgggctatgtggagcgcgagttgagcggcggtacgcattatcttgtcttctccgttattcaagcggtcacatttgcggcaggggtgtttattattctttcgggagtcagactcgtgctcgcggagatcgttccggcttttaaaggcatatctgacaaactcgtaccggattccaagccggcactggattgtccgatcatttttccgtacgcgccaaacgccgtattaatcggctttttttgcagcttcattggcggcatcaccggcatgctgattctcggagcggccggagccgtcatcgttcttcccggagtggttccccactttttcacaggagcttcggccggcgtcttcggaaacgctgcaggggggatacggggagcggtcttggggtcttttgtcaacggtctgattatcacgtttttccctgtgttcctgctgccggtcatgggtgatttaggctttgccaatacgacattttccgataccgattttgccgcaacaggaatcgtgcttgggcatgcggtgaaactgctgggatctggaggcgttgtaattggaatcgcagcggtagtggttggcgcagtcttgttcggctttaaacgcggaaaggcggaaaagccagatcagaaagtcgaagcataaaggagtgggcaatgatgtcagtaagggaaatcgatatggagcgttttcgtgatcaaatcaggctgctgacattgaaacagcttcatcacctcggctttggacattatggtggcagcttgtcaatcgccgatgtgttggccgttttgtatggaaaggtgatgaaaatagatcctgccaatccgtcgtgggaagatcgggacttctttatcctttcaaaagggcacggcggccccgccttatatgcagcgcttcatctttccggctattttgaagaagatgtgctctatacgctaaaccaaaacggcacagctcttccgtcgcaccctgaccgaaatttaacaccgggagtcgatatgacgaccgggtcgctgggccaggggatctcggctgcagcaggagtcgcgctgtcgcacaagctttcaggacgcgctaaccgcacctttgtcattgtcggcgacggggagctgaacgaaggccaatgctgggaagcgatccaatttgcggcgcaccataagctccgcaatctttatgtgtttgtggatgataataaacaacagctggacggcccgacgaaagagattatcgatccgctggattttgtcagcaaatttagagccttcgggttttattccgaaagggtaaacggacacgaaccggaagcgatttatcgtgcggtcaaaagaggcgaagcccagcgggaaaggccggttgccgtcatccttgatacggtgaagggaaagggcatcccttattttgaaaaaatggagaacagccaccacattagagcaaatgaagagcaaaaccgcatgatcgaaaggatcattttgacgcttgaagaaaaggaagtgagggcatgaatgaggcggcaaatgtagagctggacgctgttgaaatgaggcaggcatacagctcagccgtttatgaactggctcaagaaaacacggacatcgtggccttggaagcggatttgatgagctcgatctccatggacaaagtcaaacggcgcattcccgagcaagtgatcaattgcggtgtcatggaagccaatatgatagggattgcggccgggctttcgttaaccggaagaatcccgtttgttcacacgttcgctcagtttgcgacaagacgctgttttgaccagctgtttgtttcaggtgcatatgccaaaacaaacattaagattctcggatcagattcgggaattacggctgaacataacggcggaacccatatggcctttgaagatttgggactcgcccggctgatcccaaacgcctttgtttatgaagcaagcgatgcggcaatgctcaaatttttgatcaaaaaggctgcggcagagtacggcattcactatatcaggacgatcagaaaaaaggctgtcaggctttatgatgaacacgaaacattcgcagacggaaaagcaaaagttctcaaagatggcagcgatgcggcgctgtttgccagcggcatcatggtcgccgaagctttgcaggcggctgaactgctaaaagaaaaaggaatcgatgcagcagtgatcgatatgtattgcatcaagccgattgatcaagaaacggtggttcgttatgcacaaaaaacgaatgcgattgtcacggctgaaaaccataatgtcataggcggattgggaagcgcagttgcggaagtgctgagtgaacattatcccgcgccgcttaaaagaatcggggttcatgaagccttcgggcaggtcgggacaatcgattatttgaaaaaatcttaccgtttgaccgcagaacacattgcactggcggcggaacagctcgtttaagatttctttgtcctggccgatttttatattagaatagataaaagcctaaaaaaagtggaggtatcttaaatatcgtgtcagtcagtcaaagaaatcgaatcgatgtgaagctagtagctctggatatggatggaacactgttaaatgacgaacaaaccatttctgatgaaaacagaaaagcgattaaagaagctgaggaaaaaggggtttatgtcgtgcttagcaccgggcggacgctgatgacgtgccgggagttggcggagtcgctcgaactgtcttcttttttgatcacggcaaacggcagtgaaatctgggattcgtctttcaacctggtcgagcgccagctgcttcatcccgatcatgtccaaatgatgtgggatttgcgcaatctgcacaacaccgatttctgggccgccagtgtcgataaagtgtggagaggcgagtttcctgaggatatacaagcgtatgaatggctgaaattcggctttgatattccggatgacgacgtcagaaaccgggtcctggaagagctgaaaaagaacaaagaattggaagtcaccaattcaagcccgaccaatattgaagtcaatgccatcgggatcaataaagcggccgctttggcaaaagtgtgcgagcgcctcggctttacgatggaacatgtgatggcggtcggagacagtttaaatgatatcgccatgatcaaagaagccggtttaggcgttgccatggggaacgcccaggaaatcgtcaaagaaaccgcggactggattacagattccaatatcgaacacggagtcgcaaaggcgatcaggcattgggtattgtcctagccgaaaaaagagccgatttgcggctcttttttttgtgcaaaataaaaaatattcatggactgaagcaagctgaaaaaccttgtgaaatcaggtttttcagctaaagtttttaggtataacgatttattttatgtgaggtttcctaacaatatgatgccaagcgggcaaatccttgatataatcaattcaagtttgattattcggaattaatgttccgaaaatcggaacaaaacgagggatatactaaaattcgaccgaatgtgcatcaatatataggggggatttgatgaatcaagttgatttaaactgcgatcttggagaaagcttcggcgcttataaaatcgggctggatgaggagattctcgagtttgttacatcagccaacatcgcttgcggatttcatgcgggagaccctggcgtcatgcgcaaaaccgtcaaaatggcggcggaaaaaggcgtgaaaatcggcgcgcatccgggacttcccgatttagcgggattcgggcgccgcaatatggcgatcacgcctgaagaagcatacgatcttgtcgtgtatcaaatcggtgcgctttcaggatttctaaaggctgaaggcgtgaccatgcagcatgtgaaaccccatggcgcactatataatatggccgcgcaaagccgggaactgtcggatgcgatcgcgcgcgcagtttatcaaacagacccggaactgattttattcggtttggcgggaagcgaacttgtgcttgccggtgaaagagccggtttaaaaacggctcacgaagttttcgccgaccgtacatatcaagaagacggaacgctgacttcccgccgccagaatgatgcgctgattcaagatgacgatgaagccgtcggccaggtgatccgcatggtgaaagaaggcaaggtccgcagcctgcagggaacggatgtcagccttaaagcagatacggtgtgcattcacggtgatggtgcacacgcgcttcattttgcgaaaaaaatccgccgcgaactcagagcagcagatattaaagtacaagctttttctacatgatgttgacaaaaggaggaataccatttgaaacaaaataaaaaaacaaaagcgccggcaggcaactggacgttgcttttgggcgccgcttttttaatggccacatctgcaatcgggccgggatttttaacacaaaccacagtatttacacaatctttggccgcaagcttcggctttgtcatcctcgtttccatcattttagatattttcgcccaaaccaatgtgtggagaattattgcggtttctgaaaaaagagggcaggaaatcgccaacctcgtcttaccgggactcggctattttatcgcctttcttgtcgttctgggcgggcttgccttcaacatcggcaatatcggaggcgccggtctcggcatgcaggttttattcggcatttcgccgcagatgggagccatcatcagcgccgtcatcgcgattttgatctttgtcattaaagaagcgggaaaagcgatggaccggtttacgctgatcgcaggctttgtcatgattttactgacggtgtacgtcgctgtcaccaccggacctccggtaggggaagcgataacgaagacggtcatgcctgataacattgattatcttgcgattataacgcttgtcggcggtacggtcggcggatacattacatttgccggcggacaccgattgcttgatgcgggtgttaaagggaaggatgcgatccctgaagtaacgaaaagctctgtttccggcattttgatcacgtctgtcatgaggattgcgcttttccttgccgtacttggcgtcgtatcaaaaggtatgcagattaatccggataatccgccggcatcagtattccagcatgccgcaggaaatgtcggatacaaaatcttcggcctcgtcatgtggagcgctgctattacatccgtgatcggtgctgcttatacgtcggtatcattctttaaaacgttttctccgaaaatcgaaaagaattcacgcggcattataattgtctttattattgtatcaacgctttgctttgtaacaattggaaagccggtcaaccttctcgttcttgccggcgcattaaacggcttaatcttgccgatcgcactaggctcccttttaatcggcgcacataagaagaatgtcatcggcgactacaggcatccgatctggcttacaattccgggcattctggtcgttattgtcatggccatcatgggaggctatacgttaatcaatgaaattcctaagttatggggatgatctcgttgcatgtaaatgaaatgcgtcctgacgaagtcagggctctgattcgaaaaggggaaataacgggtccgacagccggcatggccgggggttttacccaggcaaacctggtgattttgaaaaaagagctcgcttttgagttcttgctgttttgccagcgcaatcaaaagccgtgtccgattcttgatgtcacggaccccggatctccggttccgtccatcacggcgccggacgctgatatccgcaccgattttccaaaataccgcgtatacaagcgtggcgaattggcggatgaagtgacagatatctcttctttatgggaagacgacatggtcggttttttaatcggctgcagctttacgttcgaacaagcgttaatgaataacggaatccctgtcagacacattgaagaaaagcgaaatgtcccgatgtatcaaacgaatattccttgtgtcccggcaggccgttttcaagggcctatggtcgtcagcatgaggccggttccggaagagcaggcggtgcgagccgttcaggttacatcaaggcttcccgccgttcacggagggcctgtccatatcggcagtccagaagccatcggtataacagacatcgcaaaacccgatttcggcgatgcggtaacgataaaaaaaggggaagttccggtattctgggcttgcggcgtcacccctcaggcagtcgcaatgcacgcaaggccggagctgatgattacgcattcgcccggccatatgctggttaccgatgttcgggatgaacaatttggtgtgttataggatttcaaaatcaatacagagcggtttatctgtattgatttttaatttaaggggatgaaaggcaaggtgaaacagaattgaaaaatctttcgaatgcgacaatgtctccgctcggcgactccgcggttatcatccagcttggagaggggataagcgaacagacgcaccgtgtcgtcagcgcgctgacaaagcggattgaaaacgatccgtttcccggttttattgagtgtgtgccggctttcacgagtgtgaccgttttctatcagccatttgaagtataccgcaagatggagagcggcaaggctgttgattctccgtatgaaaaggtaaaagccctcctcgaccatcatctccaagagctcacaatggaagaagagacagatcagcgcacggtggaaattccggtttgttacggcggccgtttcggccctgatttggaggaagtggccgacatcaacggcctgactgcacaggaagtcatcgatattcacacctcgggtgagtacctcgtttatatgatcggctttgcgccgggcttcccttacctaggcggaatgtctgaaaagatagccgcaccgcggcggtcatctcctcggacttcgattcccgccggttcagtcggaatagccggcatgcaaacaggcgtctatcccctttcaacgccgggcggctggcagctgatcggcaatacgccgcttgaattattcaagccttatgaacagcctccgagccttctgagagcaggggatatcgtgaaatttgtcagcgtgacagaagaggagtatcacgcgctgaaggaggggaaatcttgagcatagaagtgttaaagccgggtctgatgacaacggttcaagacttgggccgcacaggttttcaaaaatacggcgtgcttgtcagcggtgccatggatgccgattctttgcggattgccaatctgctcgcggggaacagccagaacgaagctgcgcttgaagtgacgctgatggggccggggccgtctctccgctttcaaaaacctgctcttatagcggtgacgggcgctgacttttcactgatggtaaatgacgaagaagtcccgctttggcgcccggttttcatcaaagagggcagcgtgttgacattcggcatgtgcaagcgcggaagccgtgcatatatggcagtggccgggggaattgatgtgccgcctgtaatggaaagcaaaagcacatatgtcagagcaggactcggcggctttcaaggaagggcgcttcaaaagggagacgtgttatcgctaggcagcccgacgccgttgtcggaagcgctgcacagaaagctcgcagacgagggcaaagaacggggctttgcggctccgaagtgggctgtcgaccgcaaatattttctcccgctaaaaaagaacccggtcattcgtgtcatcaaaggcgatcagtttgcttgctttacctcatcatcacaagagcgctttttcgcgggtccattccgggtgacggctaaatccgaccggatggggtaccgtcttcaaggagaggcgctcgaactcactcagcctctggaaatgatctctgaagcggtatcattcggaacgattcaagtgccgcccgacggcaatccgatcgttcttctcgcagacaggcagacagcgggcggatacccgagaatcgcccatatcgcatcagctgatttttctcaggtcacgcagatgatgccgggcgagcaggtgcagtttcagcttgtcagccttcaggaagcagagcgcgtttacatcgaacgggagacgaaaatcagcgaactttctgcccgattgaagcttgaatacatgttatgataggtgtgatgtgtatcaggagggggaaggcatggaacataaaaacaaaacagtcgtcaaagccatgaccctgctcaatctgttcctgacgagagaaaggctctcgctgggcgacatgattgagctgacaggcatgccgaaaacatctgtctaccgcatggtttgttctctcgaagaaatgggttttctcgaccgcgacgagaacgggatgtatagcttaggactgctgtttttgcaatacggccaccttgtttcagaaaggcttgatattcgaaaaatcgctctgcccatcatggaagaactccgcgatgacgtggatgaagccgtccatttaattgtaaggcagggaaatgaagcaatgtatatagaaaaaattgagggcacgcagaccgttcgcctctatacagcgatcgggaggcggtcccctttatatgccggagcctgtgcgagaagcattctgacgtttttgcctgaagaggagcgggatgcctatatcgagcaaacagagctggtgccgatcgcttccggcacgatccgggacaaggctgagctgatccgcattgtggacgagtcgtaccggagcggctgcacggtcagtcattcggagctcgaagactacacctccgcgattgccgcgccgattttcaatcataagcgcgaagtcgcagctgggatcagcatcgccgggtttgaagcccgctttcagaaagaccgtcttccttatttgaccgaaagagtgaaaaaggcggcgcttgacatctcgagaaaattaggtttttaggaaaaaagaaaagtatcctttcgagcctctgccgagtacatatatggtagctgccgcgaaaaaacggcatatcggagggggaaaggatatgacgcttcaatatacggctctcggcgactctttaaccgtcggggtcggtgcaggtttgtttgagccgggatttgtacagcgctataaaaggaaaatggaagaggatttgaacgaagaagtttctttgattgtatttgcgaaatccggtcttgagacgtcggaaattttagcgatgctgaacgagcctttcatcatggaacaggtcaaaaaagcggacgtcatcacgataacgggctgcggaaatgatcttctgcaatcgctggagatatatgaaaaagaaaaggatgaacacgtctttttggaagcttcctcccactgtcagaaaaactactcaggcatgcttgagaagatcagagaaataaagggagaaaaagatacgcgttatctcgtccggcttctcaatttatacaacccatttccgtcaatcgaattagcggacaaatggatttccggctttaacaggcacttaaagcagctagagtccgctccgcaaatcaaggtgatcgatacttatgctgtctttaaaggacgcgaaaaagaatatttgtcaattgaccgtgtgcatccaagcagcagagggtatgaagcgatgtcggaaaagctgagagcggcgggctacgggcggctggagggctgaatatgatgaagaaagaccattccaatcaggaatggtctttttttatgcaattcttcagcgagcagccgaaaacagactaaaaaatgaaactattaaattttgtcacacggctcctgccaaagtgccgttttctttcgattgagcagtcatctgtaagcgttttaatatagaaacagggagccgacattattcgacatcatttttttatcacaggctttaaaggacaacaaaggagggttatgaaatggaagatagacaaaatcaagatttcaaagtaaagattcaacgtttcggaagctatttgagcggaatgatcatgccgaatatcggtgcatttatcgcatgggggatcattaccgcattgtttattccgacgggatggatgccgaatgaagcgcttgcttcattggttgatccaatgatcaaatttttgctgccgctcttgattggatacacgggcggtaagatggtgtacgatcaccgcggaggcgtcgtcggtgcgactgcagcgatcggcgttatcgtcggcgcggacattccgatgttcctcggcgcgatgatcatggggccgctgggcggctacctgatgaaactgacggacaggcttttcaaagataaggtccgttccggatttgaaatgctgatcaacaactttacagccggaattctcggcttcattctggcggtgctcggctttcttgcaatcggtccggtggtgctcggcttaaacaaaacattggcggccggcgtggaagtgatcgtcaatgcgaatctgcttccgctcgcaagtatttttgtagagcctgcgaaagttcttttccttaacaatgcgatcaaccacggtattttgagcccgattggtattgagcaggccgcccagacaggaaaatcaattttattccttttagaggcgaacccaggccctggtctcgggattcttttagcttacatgattttcggaagaggcacatcaaagcagaccgctccgggcgctgcagtgatccatttcctaggcggtattcacgaaatttatttcccttacattctgatgaaaccgctgttaatcctggctgcaatagcgggcggagcgagcggtgtgctgacgttttccatctttaatgcggggcttgcggctgttccttcacctggaagtattattgcggtgctggcgatgacgccgaaaggcaaccacatcggcgtgatccttggtgttctcgtcgcagcagtcgtttcattcattgtagcttctttgattttgaaaacgtctaaagccggcgaagaagatttgacggccgcggcggaaaaaatgcagcaaatgaaaggcaagaagagccaggccgtttctgcattgacttcggctgacgaagcggaagaatcagcggctccgtacgaaaatgtcagcaagatcatcttcgcgtgtgatgccggaatgggctccagtgcgatgggggcatcaattttgaaaaacaaagtcaaaaaagcagaactcgatatcgacgtatccaatacatcgatcaataatctgccggaagatgccgatatcgtcatcacgcataaagacttaacggaacgcgcaaaagcgaagcttccaagcgccagacacatatcggtggaaaacttccttaacagtccaaaatacgacgaactgatcaatcagcttaaaaagtaaagtttgagaacccgtgagcctgaaaatcaggctcacacaacatgtatgaaagagagtgatttcccaatgaaaccagtacttgcaaaagaaaacattcatctcaatcaatctgccgcaacgcaggaagaagcgatcagactggccggaaaggcgctggttgacgccggctatgttaccgcggattatatcgagaaaatgttggagagggaaggcctcacttccacttacatggggaacgcaatcgccattccgcatggtacggaagacagcaagcaggatgttcttcattccggaatatccgttatccagcttccggaaggtgtcgaatacggcgatggcaatattgctaaagtgatctttggcattgccggaaaaaatgatgagcatttggagattttgtcaaagattgcgattgtctgctcagaagcggacaatgtcgaacggatcatcaatgcgaaaaatgaagacgagttaatggcggtttttgaagaaggtgaccaggtatgattgcactgcatttcggtgcggggaacatcggccgcggatttatcggagccttgctctgcaaatcggggtatgatgtcgtgttcgccgatgtaaatgatgccgtgatcaatgaactgaacgataagggccgctataccgtcgaaatggccgatgccggaaggaagcaggaaacgatcggaccggtccgggcgatcaacagtgcgacccagcttgacgaattgtatgatttgatagcgaaagccgaccttgtcaccacagcggtaggcccggcggtgcttaaattgatcgcagagccgattgcagaaggtttgaagcgtcggatgaaaataaacaagcagcctttaaatattatagcttgcgagaatatgatcgggggcagcgctcatcttcgcgaggaaattttcgcccgcttaactgaaacggagcgcgccgcaatcagcgattcagtcggctttccgaactcggcagtcgacagaatcgtgccgatccagcaccatgatgatccgttgaaagtaacggtggagccttttttcgaatgggccgttgatcaaacggaattcgccggaaaagtgccggatattgaaggtgtgacatatgtagcggatcttgcgccattcatcgaaagaaagctgtttacggtcaataccggacacgccatggcggcgtatgccggctataagaaaggtttgaagacgataaaagacgccattcatcatccggaggtccgccaaacggtggcaggcgcgctagaagaaacaggccggtaccttgtccaaacatacgattttacacaggaagagcaccgggcatatatgacaaaaattatcggccgctttgagaatgaatgcctgtcagacgatgtcacccgtgtggccaggtcgccgcttcgcaagcttggcagggatgaccgtcttgtcggcccggcccggaagctttgcgatctcggctttgaacctgtccgccttgcagaaggcattgccctggcgctgcagtttgattgtgccgatgatccggaagccgttcagcttcaaagcatgatcgctgaaaaaggctatgccggcgtgcttcgcgacgtatgcggactcgaagaggatcattctttattcaaactggtaatcagccatttgaaagcatagctttagatagaatcgggagagggcggcagccgggcgggggctgccgaaaacagaatgtatgaacagggcggcgcagatgcaacctaatctagaaacatcagctgtgagctgatgtttcttcacttcttgaaaagtatttgcacagattttaataaaaaattaattagtttgaattgaagattttttgacagcgttttatgatagggataccgtttcaaccgccggaacccctttcacccccccccccccgcaaaaacgacaacaccggaggcggcgttttatgtatatgacagcaagggaacaaaaactaatgaaataccttttgcatcaaaaccgttatgtcaaagtcaatgaaattgccggctatatagaagtcagcacaagaacggtccaccgcgagctcaaagcggttaaatccgttctggacaagtacaggcttcagcttgataagcagccgggaaaaggcttgaaactggtcggagcctacagagacaaacagcggcttcttgaagatctgtcccgggacagtcatgtcgaatacagtgccgatgaacgaaagcttttgattttatgcgcgatgcttgaaacgggagagccgatcaagctttatacaattgcccatgacttgcaggtgacggcggcaacgatcagcaacgatcttgacgagctggagaagtggatcgctccattcggcctttcgctgatcagaaaaagaggctacggtatagagctgagggggccggaggacgccaagcggaaaatcgtcggaaacttgatggccgacaagctcgatgttcagcagtttctggaaacgatcgaaatgaatattaaaggcaagaacgaagcgccggagaaaatattcggtgtcgtcagccgggggaaattgctgaaagcggaaaaagtgctgtttcagatgaaagaaaagtatggactttctctttccgacagtgcatacatcgctctggtcgtccacttgacgtttgcgatcgagcggatacagctcggtgaaatgatcaatatgaatgaagaagaattgacggatctgaagcgtacgaaagagtttgaactggcgcttgcgcttgcaaaggcgcttgaagatgcgtttcacgtgaagatacccgaagctgaggcggggtatattacgatgcatttaagaagcgccaacaaaagcttcaaaatcgactacagagcggaagatatcgagctggatactgcgctcagaacgaaaaagctgatcgatttcatctcgcaaaaaacgggcatgaatttaaccggcaatcattcgctttatgaaggattaatcgcccaccttgaaccggcgatcatccggatcaaagaaaagatgtcggtgcataatccgttaacagagcaggtcaaaaaagattattttctcctatatatggccatagaggaaggcgtcgaaatatttttcccggaaatccggtttccagatgaagaaattgcttttatcgtccttcactttggatcggcgcttgagatgagcaaacaaaaagtagacatcaacgcgctcgtgatttgttcgagcggaatcggttcatcaaagatgctggcctcgcggttgaaaaaagagcttcctgaaatcgcttcctttgagatatcctctctgatggaactgaagacgaaaaacactgatgcctttgacatcatcgtttcaaccgtgccgatcccatatgaaaacattgactgcgtcaccgtcagtccgctccttgacacggaagatgtgaaacagatcaaacaccagctcacccgaaaaatcccgctcatccttcggaaaaagcggatggcgcccaaaaaaccggagccgtttccagatatgcttcagattgcgcggaaaatcggccattacgcggccggcattcaacatatactgagccattttacggttgaaacgatggaagctgaatcaagcctggaacatacggtcaaacggatttgcggaaccctggaagatcaaggcctggttaaggatgcagggcagatggcggatggactgatgaaaagagaagcacagggtggcctcggaattcccggaacaaccttcgcgctgtttcatttaaaaagtgaagcggccgcggttcccctctttaaagcttatgatctgtccaaaccgttcgagatcaaagggatggacggaagcgccatgaagatgatgcggatgctcatcatgctggcgccggccgatctgtctccggaaggttccgagattctgagcttcatcagctcttcgatgatagaaagtgatgagagcataaaagcataccagaccggagaccgcgagcagctgtacggcatgctgaacgtgctgtttcaccggtttatacaggataaagagtggtgagagccccgggttaacccggggctttcttcatttttatcgcacatggtcatgtttaaacaaaaatttctccggttaaaagtctagtaacatcagctaaagggaggaatcacaaatggatttgcgcaatcagcagacaaacgggcagccggcgcagacgcaagaccgccagcccggcatcgaaagcgtcatgaatccgcgtccgatctatgaggatgaaaattacaaaggaacggataaactgaaaggaaaggtcgcgctgatcacaggaggcgacagcggaatcggcagagctgttgccgttgcctatgctaaagaaggcgcggacatctcgatcgtctacttgaatgaacacgaagacgctcaggagacgaaagcgcgcgttgaaaaagagggcgtcaaatgcctgctgcttcccggcgatgtcagggatgaagctttctgcaatgacgcggttgagcagacggtgaaggagctgggccgtcttgatattcttgtcaataatgcggccgaacagcatcctaaagacagcattaaagagatttccagtgaacagctcgagaaaacatttaaaacaaatttcttctcttatttctactttacaaaaaaagcgattgattatctggagccgggcagcgcgatcatcaatacaacatcgatcaacccttaccggggcaatccgcagctgattgactacacggcaacaaaaggggcgatcaatgcgtttacacggtcgatgtcacaggcgctcgtcaaagacggcatccgtgtcaatgccgttgcaccgggaccgatttggacgccgctgatcccgtcaacgttttcaggggaggaagtggcgaagttcggtacagatacaccgatgggccgtccaggtcagccggtcgaccatgtgggctgctatgtgcttttagcatctgacgattcttcgtatatgacagggcagaccctccacgtcaacggcggagactttatcacgacataaaagggggaagctcgtgtgaaggtgacaaaggaagatgtaattgaatactacgagaaagcgggcattgtgctgaacgacgatgataaagaaaacatccaaatcatggactacggattaaataagctggataagctggggcttcagctgttcgtctatgtcaacacagaccgctactgcgccaaagagctcgtattattccctgaacaaacatgccccgaacaccggcatcctcctgtagacaagcagaaagggaaggaagagacattcaggtgcagatacggaaaagtgtatttgtatgtagaaggagaaaaaacggaagccccggccgttatgccgccggacgaggatattgaacatttcaccgtttggcacgaaattcagctcacgcccggcgaacagtttacgattccgccggacacgaagcattggttcaaagcggggagtgaaggtgcggtggtcacggagttttcttcaacaagcaccgatgatcacgatgtgttcacagatccgagaatttagcgaatgggagtccatctcattcgctttttttcgctcgctccatcacatcaaagccgatgaagtgccgtccgtcatgatcggcaaaataaaattgaacaccgttcacacaaagtgttttgaccgcttcctgtgccgtcggtcgaaaccgccgaacgtgcgtcccgtttaggtaagccggttcaagtttatattttctgccggtcagcgttccaagccgcgcgatttccggagcctcgtcccccggaaattcgacaccgatgatccgctgatggcggtcaaagtctgcagacaaagccgtgtcgccgatatcatctgttgctgataccgatccggcccgcctttccgttaaagcaatgtagcccatatcagcctcggcatcaaacgatatgaaaatattcacgtcaaaaacctccattcaattgtttaatatacaagacattgtggaaaagtaacagtggagacgatacaaaggagggaacctcaaaatggatcagcagcaattgaagaacaaggtgcttgatattctcgatcatcataaaatcggttcgcttgcaacggttgaaagcggcaagcctcattcccgctacatgacctttttccatgacgggctgacgctttatacaccgacaagcgatgagacgcacaaggcggaagagattgataacaatccgaacgtccacgtgctgttgggttataacggcgaaggattaggcgatgcataccttgaaattacaggtacggcaaagctcaaccattcaaaggatttaaaggacaaaatttgggatgaaaggcttgagcaatggtttgacggaaaggacgatccgaacttgaccgtgcttgagattgagccttcggaaatcagactgatgaatgaaggcgaaagcaccccggtcacgcttgacatgtagcactgtgctcaatcagttgtcataaagggcgaactgtagtataataaaaaacaggaacacgcaaaagagcaaataaatggaaagtaaacttcttttttctttcttagaagatgctaatttcttcctctgacccgcccctaacaggatagagggaaaaaagactttttgtttcacaattcacactggcgcggcttcggagccgcaaggacgaatgagaggtagggctttcgttgtcttgtatcagaaattccatggtgtttactttcgctcggaacgatagatgctgatcttttacgaaattcaaatgaccgcctttggcagcggataataatttatttgctcgaataaatatgataattgagaccgcttcggcttttgccggagcggtttttgatttgccgaaacgtttccgttttaaaaacagtcttacctatagactggaggaaggtaaatggactttttaacatccaaggtgctattgattttttgttttctgttgttgatccattccatcgaaacgctcgcttacgctgcccggctgtcaggcgcgagagtcggatttatcgcatcggctctgtcattatttaatgtgatggtcatcgtctcgagaatgtcaaacatggttcagcagcctgtgacgggaaagcttgttgatgtcgcgggggcggatgcgctttccctcgtcggtagccaatttcggtttttgatctttggttcaaccgtcggcacaattttcggaatgctgcttctgccgacattcgtcgccgtattttcgagagcgattgttcatttggcaggagaaaatggctccgttttgcaagtgtttcgcaaggcgttttcaaaaaatagcttcaagcatgcaaagcattatgcaaaaagaccgagcctggaatatgtgaaagactttcggttccgctatataccgaaacggctgtttgtcttgaacatggtcattacggcgatttatacaatcggcgttcttgccgctctttatgcgggcgtccttgtgcccgaaaggcatacgaccgcggtgatggcctccggccttgtcaacggggttgcgacgatgctgctcgcgctgtttgtcgatccaaaggtgtcggtacttgcagatgacgtagcaaaagggaagcggagctatacgtatttgaaatgggcttcgatcacaatggcagcatcgagggtggccgggacgatttttgcccaagtactatttattcccgcttcttactatatcgcatggatgacgaagtggatgtagtcgatttttgacgaaaagatcaaaattcgatcattttcattacattatgaaacaaatgaaaacaaaatattatctttttcgacagggttagacagcttgatctttcttttattaattgcccgctgtttcatcctgtgatagtcttatgtgtggcggtgataaaagtggagagggttagagtaagagtaagaaaaccgaaaagaaaaaggcgaaaaatcataaagcgcctgtttacattaactttgctggttatcatagcagcagcgggttatacctactttgaatacaaaaaaggcttatctgaatctgacggagattttaaagaagacggacagtttgaatttaacggggaaggctctgatcttgatgaagtgaacatcctcgttcttgggatcgattcaagaggggaagaccattcaaggtctgactccatgatggtcatccactataataaaaagcagaaacagcctaaattgatttcgattatgagggacagctatgtcgacattccgggatatgacaagcaaaaagtcaatgcggcttatgcatacggaggcccggaactcgtcagaaaaacattaaaagaatcctttgatttggacattaactattacgctgtcatcgattttaaaggttttgccaaaatcgttgatgcggtggcgcctgacggcatcgaagtcgatgttccgaaaaaaatgtcatacggaatcggcatgacactgcagccgggaaaacaagttcttcacggtgaaaggctgctgggctatgtccggttcaggcatgacagagaaagcgattttggacgggtcagaaggcagcaggaagtcttttcaaagcttcaaaaagaagcggtgagcatcggaaatatcgcacagcttccgaagctgtgggggctcgtcgatccgtatattgaaacaaacattccgaacggcgtcatactctccgtcggcaaagactttttgcttggaagcgtaaaagaaaccaaaagcttcaggctgccggttgacggatcatttacgaacaaagacgatccaaaatacggggcagtccttgatttagaccttgaacaaaacaaggaagagctgaaacgctttttaaatgagtgatcaaaaaatccgccgggaaacccggcggattttactgatcatatttttttagtccccggtcataaaggaaattgccgaatggaacaaatgcggccacaagaccggcagccggccatttcacagaccacctcagcacaaaagttgcatacaacagaacaaacaaatacaaaataaacaatccgccgtgaaccgatccgacaatcgtaacggccatcgggtaatccgcccaatatttaagcggcatggcgatgaacagcaggattaaaagcgacatgccttcaataaaacccatcaaccgaaggcggccaatcggcgtttgcagcatagtatacctcctgtggagtgatagtctacctttatactataaaccaaaaggggacaaatatgacaggtttttctccgattgatttatgcgtctgccggaagcttcattaaagcgccgaagtattgctgggcagtcgtaaaacaaataaatgcggtcaattccgttatttcttcttctgaaaacacttcttttaaaacatcaaactgcctgtctgacacgcgctccctctgcgccaaaaagacctctgcaaaccccatcgcaaagctcgttttctgctgattcggaatctcgggcttccccttggccttgcaatattcacacccgtttccctgagccagcacacggcgcacctgctccttcagttcctttgataaaaagccatctcctgacagctcctcagctaaagccgtccagcttgacatcaggctttcagagtgtccgagcagccgctgaaacggcgtctctcctctgtctgaaaaattgattcttgtcatatgatgatcacctcttcataatcatatataagcagaagagaaatatgaatttcgaacgaaagaattttcgtgaaaatattaaaataatgaaatagaatggagggaataaagttacatatgaaaattgatgatctcgattttaaaatcatagccgaattaaagaaagacagccgtttatcgatgcgggagctgggcaggaagatcagcctttcggcaccgtctgtgaccgaaagagtcaggcggctcgaatcgttcggcgtcataaaaaaatatacgctggacatcgattaccaaaaggtcggtcttcccgtttcctgcatcattgaagcaacggtgaaaaacggggaatacgagaggtttaaagcgtatatcgaacgcctcccgaacattgaattctgctaccggatcgcgggagctgcctgctatatgctgaaaatcaatgcagagagcctggcgaagatcgaagcgtttatcaatgaaacgtctccatatgcccaaaccgtgacacacgtgattttttcggaaattgaaacaaaggaatcgtgaacattagagatgcatctgtatcatctgttataatataaggatgcatgaacaagaaagtgatgtgatgatggacgtgtctaaaacagttgttttagcagaaaaaccttcagtcggccgtgacttggcccgcgtgctgaagtgtcataaaaaaggaaacggatatcttgaaggcgaccgctatatcgtgacatgggcgctcggccatctggtcacattggcggaccctgaaggatacggaaaggaataccagtcttggcggcttgaagacctgccgatcatccctgagcctttaaagctcgtcgtgatcaaaaagaccggaaaacagtttcaggcggtaaaatcgcagctgatcagaaaagatgtcaaagacatcgtcattgcaaccgatgccggccgggaaggcgagctcgtcgcccgctggatcatcgaaaaagcaaaggtcacgaagccattgaagcgtctgtggatttcatctgttactgacaaagcgatcaaagacggatttaaaaacttaaagaacggcaaagactttgaaaacctttaccattcagctgtggctcgagctgaagccgattggatcgtcggcatcaacgcgacgagggcgctgacaacgaaattcaacgcccagctttcctgcgggcgcgtacagacgccgacgctggcaatgatcgccaaaagagaggaagatattaagaactttaaacccgtcccttatttcggcttgcgcgcagcggtcgacggcatgacgctgacatggcaggacaaaaagacgtcacagacacgcacgttcaacgcatctgtgacgtcgcagcttgcaggagcgctgcaaggcaaaccggccgtcatcgtcgacttgaaaaaaacggcgaaaaaaagctttgctcccggactttatgatctgactgagctgcagagggacgcccataaacgcttcggcttttccgcaaaagaaacgctgtccgttttgcagaagctctatgagcagcacaagctcgtcacctatccgcggacggactcaaggtttctttccaatgacatcgtcccgacgctgaaagaccgtttggaaggcatgcaggtgaagccttatgcccagcatgtggcccggatcctgaagcggggggttaaagccaataaaagctttgtcaacgatgcgaaagtatccgatcaccacgcgattattccgacggaagagccgcttgcgctcggcgcgttaagcgaaaaggaaagaaagctttacgatttgatcgcgaagcgcttcctcgctgttttaatgccgccgtttgaatatgaagaaacaaaagtgtttgccgaaatcggcggagaaacctttacggcaaaagggaaaacagttcagtcgcaaggctggaaagcggtgtacgatttcgcagacgaagatgatgacgaggaagaaaaggatcaaacccttccaaaactcgcaaaaggcgacacgctttccgtccggtctttgacagagacgaagggtgaaacaaaaccgccggcgcggtttaatgaaggaacattgctgtctgcgatggagaatccagccgcatttatgcagggagaagaaaaaaaccttgtgaaaaccctcggagagacgggcggacttgggacggtcgcgacacgcgccgatattatcgaaaagctgttcaacacgttcctgattgagaaaaaaggaaaagatatttacattacttcaaaaggaaaacagctccttgagcttgttccgtcagatttaaaatctccggccctcaccgccgaatgggagcagaagctgtcaggcattgcgaaaggaaagctgaaatcttcagccttcattaaagaaatgaaggagtacgcaaagcagacgatcagagaaatcaaaagcagcaatcaaaagtttaagcacgacaatatcacaggaacacattgccctgactgcggaaaactgatgctgaaagtaaacggcaaacgcggcacaatgctcgtctgccaggacagggagtgcggccatcggaaaacggtcgccaaacagacgaacgcccgctgcccggtttgccataagcgcatggagctgcgcggccacggggaaggccaaacctttgcctgtgtctgcggccaccgcgaaaagctctccgttttcgaaaagcgcagagccaaagacaaaaattcaaaagcgtcaaaacgcgatgtacactcttacatgaaaaagcaaaacaaggatgagccgatcaacaatgcgctcgccgaacagctgaagaagctgaagcttgatcaataaaacgggaagcctgccggggacggcaggctgttttaatttgtccaaatatcacaaaaagctgctgttatgacgcgatgatagaaggagattcactgcgcggaaaaaaccgggaaattcatgtagccgcgcccaggaaaatcggattgaaacatgaggatattctggatgccgatcaatgttgaaatccttgtcagccgctcttgtataaagaccgactccgcctttggaaaatcgccccgcacttttgtggcaggggaattttagcgaagttgagcacagccggaaaacgaagcatgatatctcgattttctcttttgctctgtcgggtttaagaaaagaattgatgtacaatcaataggtcagaaagcctgtctaccgccggttttttttatattaaaaaagtatttacaatgctcgtaaacgggagtatgatctctctataataatccaaaatcgcttaatctaaaaaagagcgggggaaccatttagaggcgtacagctccggggtgaatccttttaaaggtaggccaaactctcgtgagcccgaatccgtcagctaacctcgtaagcgttaagagagagggagataacctgggaataaaaatccgattccgcaggggcttttgcctctgcgcttttttgtgcgaaaaaatactgaaaaaacagcaaagaaggagaagacaatgatgtatagtgcaataaagcggtttttaatcgggaagccattgaaatcaaaagagcttagagaacaaaagattacaaaaacaaaagcattggctttgctttcctctgacgccctgtcttccgtcgcttacggaacagagcagattctgatcgttttggcggctgtcagttccgccgcattatggtattctctgccgattgccgcaggcgtcatgattttattgacggcattaattctttcataccggcagatcattttttcttatccgcacggaggaggagcttatgttgtatcaagggaaaaccttggagtgaacccggggctggtcgcaggagggtctcttcttgtcgattatattttgacagtagccgtcagcgtttccgcgggaaccgacgccattacatcggcagttcctatgttgcatccgtatcatcttctgatagcgattgtgctggtgcttttgattatggttttaaaatttacgagggctgacagaattcggcttcaatattggcataccctgtgtatttatttgtggccgctcttctgattctgatcgcggcaggcagctacaagctgcttaccgggcaaatcgagccggcggagcatgctgcagtcggcacgcctgttgccgggctgtccctgtttctcctgcttaaagctttttcttcaggctgttcggcattaaccggcgtagaggcgatttccaatgcgatacctgcttttaaagatcccgcgccaaaaaatgccgcaaatacccttgcgatgatggggatattgctggctgtcctgttttcggggattacaatgcttgctttcggttacggcatcacgccgaaaagcgaagagacggttgtttcgcagattgcatcggaaacattcgggcggtctttcctttactttttcattcagggcacgacttcaatgattttagtgctggcggcaaataccgggttctcggccttcccgcagcttgcgtttaatttggcccgggataaatatatgccgagaatgtttacggtcagaggagaccgcttagggtattcaaacgggatcatctttctcggtattgcatcgattgtgctgattgtgctgtttaacggacagacggagcatctcattcctttatatgcggtcggcgtgtttataccgtttaccctttcgcagacggggatgtgcttgaaatggatgagggaaaagccggacggctggattgcaaaaatgatcattaatgcagcaggagccgccatctccgctgtcgtgctgctgattttattcattacaaagtttgcgcttgtttggccgattgtcatcttcatgccgattgtcatttgggccttttatgtggtgaaaaagcactatacagcggtgagcgagcagctgagaataacaggcaagcctttggagccgatcaaaggaaatatcgtcattgtacctgtcgcgggtgtgacaagcgtcgtcgaaaagtcggtccaatacgcaaaaaccttgtcagatcaagtgattgcggttcatgtatcatttgacaaagaagaagagaaaaagattgagaagaaatgggaggctcttcaaaacggggtcaggcttgtaacgctttattcctcataccgaagcttgatccacccattggaaaagtttctggaaacagttgaagccaaagcggcgagctacaactactctgtgatggttctcgtaccccagttcattccgaaaaaaagctggcacaacattcttcacaatcagtccgcgcttttgctgcggctgaggctcctgtggaaaaaagacatagttgttgccacgcttccataccattttaaaaagtaaaaaacctgcagagccatgcctctgcaggctgtttttttggcgggtacgctgcaaaacgtttcagcagaaatggaaggaggtatggaaaaaacaaaggaggacgtgatatggcaaacaaaaccgcaggaaaaatagctgcagaactgctgaaggaatggaacattgatcatgtttacggcatgccgggcgacagcgtcaacgaatttatcgatgaattgcggcatgaagaaaacagcctccgcttcattcaagtgcgtcatgaagaaaccgctgctctcgctgccgcagccgatgcaaagctgacaggcaaaatcggcgtctgcctttcgatagcgggcccgggcgccgttcatctgctgaacggcttgtatgatgcgaaagctgacggggcgcctgtgcttgcgattacaggacaggtgtcttcggatgaaatcgggagagattattttcaggagatcggtcttgaacgaatgtttgaggatgtggctctctttaatcagcaggtgcattcggctgaagccctgccagatcttttgaatcaggcgatccgtaccgcatacagccaaaaaggggccgccgttctgagcgtatccgatgatctgtttgcagaaaagattaagcggaagccggtttatacgtctgcgctttatatcgaaggcgatcttgaaccgaagaaaagccagctgatgcagtgtgcacaattgattaaccaggcaaaaaaaccggtgattttagcgggacggggaatgaaatcggcgagagacgagctgctcgagtttgcagataaagcggccgctccgatcattgtcacactcccagcgaaaggggtcgtacctgatcggcacccgcatatgctcgggaacctcggacacatcggcacaaagcctgcatatgaagcgatggaggaaagcgatctgttgatcatgctggggacttcatttccgtaccgcgattatctgccggaagatgccccggctattcagcttgacaacaatccggcgaaaatcggcaaacggtatcctgtcaccgccggccttgtctgcgatgcgaaaaaagggctttttgaactgacgaaaacaattgaacggaaatcgaaccgcgcatttttggaaagctgtatacaacatatgaggaagtggcgttatgaagttgaaaaagacgaacaggtagcgacagagccgctgaagcctcagcaggtgattgcaagacttgaggacgcggtcgcagatgatgcggttctgtccgttgacgtcggaaatgtgacggtttggacggcgcgccattttaatatgaccaatcaggattttttgatatcaagctggcttggcacgatgggatgcggtcttccaggcgcgatttctgcaaagctttcccatccggaacgccaggttgtagccgtgtgcggagacggcggtttcagcatgtctatgcacgattttccgactgctgtcaaatacgaactgcccattgttgttgtgattttaaataatcagaacttgggaatgattcaatatgaacagcaggaaaaagggcatgttaattatgcgacggcgctcgaaaacgtcgattatgccaagtttgccgaagcctgcggcgggaagggcttcagcgtgacaaagcacgaagagcttattcctgctttgaaaagcgcctttcattcacaaaagccgtcgattatcgatgtggcaattgaagacgaaccgcctcttccgggaaaaatatcctatacacaagctgtaaactacagcaaatatatgatcaaaaaactagttgagaaaaaagagctcgacttgccgccgctgaaaaaaagtttaaaaaggattttttagtatgatgccaagggagatcgtcccttggctttataacggtcagatgttaaaattgaatgggtaatattggaatggccgcgtatgttttctttttgcatcaaaacccgtctcaacactgtgaaaagagaggggattgtaacgtgtatcgtttgccaaaaaccaccttcagcaccgttttcatattagcagccggattgctgtggatgtccatcgttcctcagcaggccttcgctcatggttttatcgaaaaaccggggagcagagcggctctgtgcagtgaggctttcggatttctcaatctgaattgtggaagcgtgatgtatgagccgcaaagcctggaagcgaaaaaagggtttccgcatagcggcccggcagatggacaaattgcatccgcaggcgggctgttcggcggaattcttgatcagcagtcggaaaatcgctggtttaaacatatcatgaccggcggagaacacacctttacctggacatataccgccccccacaatacgagccaatggcactactatatcaccaaaaaaggctgggatcctgacaaaccgcttaagcgcgcagactttgaactgattggcgccgttccgcatgacggttcccctgcatctcgcaatttatctcaccacatttatattcctgaagaccgcctcgggtatcatgtcatacttgccgtttgggatgtggctgatactgaaaacgctttctatcaagtgattgatgttgatctagtgaacaaataaagcctggacttttcttgatctgtttggaaaaccgatttgtgaatcagcgggttttggtgcaaacagagaaaataagcgatcaaaaaccccggctctccaaaatgaactgacccgttaaaatgagacttagaaaaaacacctatgctgcctgtcccctgtattccagtggggacaggtagtttaattttgcctgaattcgtacatgattatatcgatacatgtattgatttacaatttgtactactttagaattggatatagatgctctactttgagcgttaaatccttccgactttagcgaggagtgaaaggattcaatgacggcattatcatggcagtttccttttcgagacatgcttgtggtaatgcctttttctttggccaaattctgatatgcatgtgaagtatagacagatccctggtcgctatgaagaagtaaccctactggtttacgtaattctacagcttccctcaatgtgtctaatactaggttaatatcttggctcgtacctattttgtaagccactatttcgttgttatataagtccataatcgttgataaatataacatagtcgagccataaggtaagtaggtaatgtcggttacccatttttcatttaatcggcttgctttaaaattacgattgagagtgttcggcacaataatattactctcaccacaaatgtacttttgtcgcttcttcttaacttgacactgaatctcaaacttttgcataattttttgtacagttttgcggtttacatttatcccatactttctgtttaagatggatttaattttacgatgaccatagtgatagaagtttttcttacacagcttgattactagctcttctaatgaagttagctcaacttttttatacttctttttccaacggtaatatgttgacttaggtatgcctaatactccaagaatatcaattattttaaaagtggctgagagttcttctacaacttggacaatgactcgtggctccaactcctttcgatctcctggtacttttttataattgccaattgagcctctagctgtttattctttagttttaattcttctagctcactcatttcctccgattctttaccgtaggaatattgttttccaacttgttgcgaaaatcgataggtttggcctgttttgtaccatcgcatccatgttttaatttgagtcttattttttatccccagttgttccattatttctttgtttgtcattccagcttgtttcattttaattacttcccattttacttcttctgcgtaatgtactcttgtgcccatagaaaaacaccctcctaagaatcatattgtattaatacgattcagggggtgttttttccttgtctcatttatttgggtctctccaaaaacatgccggggtttttgagattcgttatttctttttcttcattgcggcagccataaacggcagcagggtgccgaacagcatcgtaccgccgaagaaattcccgaggtaaggctgtccgatcaagtagcagacggcaaatacagccgcagcaagaacgatcatgatgtagcctggataaaacctttttttaaaacttgtccgctgggtaacccggaaaaatatcagcccgatgacgagcgggacaatccatagataaaacagtataaatactttcatgttcaaaactccatattttttaatctatcataccagattgcggcgtaaaatgcgtgtgacaaatcccggactcatttgctgcgggcctcatattcctctttcagaagcccgtatacgaaatggtcggcgaagtggtcgtggagccactcgcattgtctgaggcagccttctttcgtgaagccgagcctttccggaatggcctggctttttacgttttgaacagcggccctgatttcaatccggtttaaatcgtattcgctgaaaagcgtatcgatcagcgcccggcaggcatccgtcatcattccttttccttgaaaaggctccccgagccaatagccgatcgaagtcgtgcggttgatccagttaatgtaatggagtccgatgattccggcaaattggccttgatgccatattcccgcttgaaacccgttgtttgcagcggcctgtttcatgctttcttcgataaaagcttcggtatcttccagctgctttgtgccgtccacccaaaacagccatttccgcaacacatctttagactgttggatctgcatataaacggccctggcatcttttggttcgagcatttttaaatacagatcatcacgtaccattaatttaaacatccagaatccccctttttctcagtataatataaaaaagccgaccgaggccgacttttaaccagaaaatgtatcgtaaatcaggaaaatattgagggcgacgattaaggcagcgatcagccatgagacggctgttatccactttgcatttttcaggctccccataatgcgtttattgctcgtaaataagataagcgggataagggcaaaggcgatgccgaatgacaggacgacctggctcaagacaagagcggttgtcggattcacccctgaagcaataatagcgatcggcggcaaaatcgtaatgaaccgtcttaaataaagcggaatcctgaaattaatgaagccctgcatgataatatctcctgaaagcgttccgacagacgaacttgataaaccggctgttaacaggccgacgccgaacaatacggcggaaagcggactgaccatgctgctgaagtggctgaaggccacatcaaggtcttcgacgaaaatgccgttcttataaaacagtgcagcggctacgatcagcatgctcgcattgattgctccggcaatcagcatggcgatcaaaatgtcgatgaactcaaagcggaatatctttttcttttccgcttccgtttttccgaccactcttcgctgtgtgagagcggaatgaagatagatggcatgcggcatcaccgtcgctcccaagattcccgccgccagcaggatgctgtcagcaccatcgaagcgggggacaaacatgccctccaaaaccgatccgatatcaggttttgcaaaaaacgtttgaaaggcaaatgcgatcacgacgatgaaaagcattcctgttatcgccgcttcaagcggtctgacgccgcgcctttgcagttccaaaatggcgaaagatccggcggcagcaataatcgatgcttcaagcatcggtatgccgaacagcaagtagagcccgagagcagctccgataaattcggccaagtccgtcgcgatcacgacaagctctccctgaatccacaagccgatggagaccggtttggggaattcttcccgggcgacttcgggcaggtttttacccgttgcaattcccagtttggctgacaatgactgaatcagcaaagccataatatttgaaaaaaggattacccataaaagcaagtagccgtatttcgaaccagccgcgatatttgtggcgaaattgcctggatcaatataggctatagccgcgataaacgccggacccaaaaaagggagcagccttttgaagcctttgctttttccatccagtgcatcttgggcttcttttgatatttgcgagtgtttggacaaatcgtgactgaccattttattcacctatattctcagttgtttttccttgtacataaaagtttccttagtgcaaatttatatcatcatcatatgcccgcaatgatcaattgtcaaccataagatgctatagtatatgcgagaatggtttcggccaaacaaaaaaaccagcaccgctttcgggcgatgctggctggaagttatgcttgagaacccattcttccgcggaagatcaggtttaaaatgaagacgagaattgcggctccgataatcgccggaaagatggcgaatcccgcaatatcaggcccccacgtaccaaacagcccgtggccgatccaagctccgataaagccgatgaccatggagcccggtgcaccgtgggctccgattgcacctccgattaatccgatgacaatggctacgattaaagaaacgagaaatcctaacattgtctttccaccctctttcaattgatttatattaaatgtttagcccgtctcgggcgtctataaacgcttgaaagcatattgagaaagacggatggctattcctcgagaagcgaagcgcctgcgatgcccggatgcgtcatttcataaggatccagaatgagatccaattcttcctctgttaaaacatcatggagcaaacacagctcgcgcactgatcgtcctgtggcgatcgcttctttcgcaattcgtgcggcggcttcatagccaaggtgcggattgacagccgtaatggtccctacgcttttttcaacgaattccttcagcctgatctcattcgcttcaatcccggtgatgcagtaatcggtaaatacgcgaaatccgttgttcatgattttaatcgactgcagcaaattaaagacaagcacgggctccatcacgtttaactcaagctgacccgcctctgatgcaaggcagatggtattatcgttgccgatcacctgaaatgcgatctggttcatcagctcaggcatcaccggatttactttgccgggcatgatggaggagccgggctggcggggcggcagccggatctcggctagacctgccctcgggccagacgccattaaacgtaaatcgttggcgatcttggacatgttcatcatgccgactttcaaagcagccgatacttctgtgtaggcatccgtgttttgtgtggcatcgacaagatggtctgcgccggtcagctgatagccgctaatatctgagaggtgcgcgacaacgttttgaatatatctcggatcggcgttcaaacctgtgccgacggccgtggcccccatattgacttcatagagatgatgctgcgactgcctgatccgctgaatatcgcgttcgatcacccgggagtaggcttcgaattcctggccgagcctgatcgggacggcatcctgaagatgggtgcggcccattttaatgactgaatcgaattccgccgcttttttgcggaaggcatccaacatatgctccatcgtcgataagagccgttttaagtgattcaatgtggccagatgaatggctgtcggaaacacatcattcgttgattgggccatattgacatgtgtgttcggacttaaatggaagtaatcccctttttctttccctaaaagttctaaacctctgtttgcgataacttcattcgtattcatattcattgaagtgccggcgccgccttgaatgggatcgacaataaaatgctcgtgccagagcccttccgctatttcgccggcagcttttacgatgacttcgccaagctctttatataaacgtttaatatccatgttggcgagagccgccgcttttttgaccattgccaaagctttaatcagctcttcatcaatctgatagcctgtaatcggaaagttctccacggctctcatggtttgtacgccgtaataggcgtcaacgggaacttctttttcacctagaaaatccttctcgatcctggttgctttcgtatccatggcaaaacctccgtaggttgtttcttatgatgtattgtgcctcgatccgccatgttttaatttgcttttaaaaaaaggaaaatcgtcttccgacatggggctgtcaagtaataaaaagcctgttttatctaatgacatacgctcatttgcatgccaaaaaaatttaaaggaaagatatgaagaaacagacaaatggtcaaataattatgtttatttattattaacttaattaaatttctttacttcatttatctatttgtagtaaatttccttatataaaattttcgtatgagaaaggaagatctatgatgggacatgtactgatgattaatttcccgggggaagggcacatcaatccttctatcggcgtcacaaaggagctgcaaaggcgaggggaaagcatcgtatattatgcagttgaggaatacgctgaaaaaattaaaaaaacaggcgcagaagtccgtttatacccggatttcagagaggttctatcacccgggaagaaaaaagaaaagatggactttgccgaagtggtttacaatatgtcaagtaaagtcaatgagatcgttcagttcatctaccgggaagtcaagagtgaatcttatgattatgtgatatatgaccatcacttcttagcggggaaaattattgctgaaatgcttgagctgccgagcgtttcgttatgcacgacatttgcaatggacgagcagtttgcaaaaacgtttaccccgcaaggcgaccttgaaagctcgccttattttgaaaaattgaaaggatccctcggcgaattaagtgagcggtatcctgtcagtctcgacaagccgtttgacgtattctcctgtccgggggatatcacgattgtctttacttccagagcgtttcagcctcatgccgaacgatttggaagtgactatttgtttgtagggccgtcgattgcgagcaggcaggatccgggaagcttcccgttcgccgagctggagggggaaaccgtcatcttgatctcgatgggcacgatctttaatcagcaaaaagagctgtatcatatgtgtatcgaagcgctgaaagactttgacggcaaggtggtcatgtctgtcgggaaatcaacggatcctagggatctcggcagcataccggatcattttatcgtgaggccgtatatcccgcaattggaggttttgaaacaagctgatgtatttgtcacacacggcggtatgaacagtacaaatgaaggcctttactttgatacaccgctcatcgtcatcccgatgggggcagaccagtttttcgtcgctgatcaggtggaacgtacaggcgccgggatcaagctggacaaaaatgaactttccccggctgttttacaaaaaacgattaaagatatgcttgaaaaccgctcctataaagacgacgccgccaaaatcggccgctcgctccgcaatgccggcggctatcaaaaagcagcggatgccgtattggagttggcggggagaaagtaagacgctccaaaaacggagcgtctcgctagttcatcctgatcttccgctcaacactgccgtcttttttatggacgacgacggcggttcctttattttcggcgatttctttcgcccgttcgacggcttctgcttttgtatcctttacttcgctggcccgcttagcgtcttcggctttgactgcccagcctttttcatgtttgatgacatgctcgcacttttccgcaagctccggcctgctgctcgaaccgctgtcaccacgttttgtttcatcggctttttctgcataggatttaagctcgcttttgcttctgttatccgcccattccttcgcctgactcgtcgcaatcggaattgcccggctttcgtcgtatccttcgtcaaccatcgcattcgcaatttcaatagctttctttttcaccggtttgtccaaatgtttcaatgaagcaggatagtcttccattgaccatggcatttggccattcctcctttttcataaagttttacccgctggatgccgatcaaaaaacacggattcatcagatgaatcattgtatactataaaaaaacacaaatgagagggcgaaccttccgtgcgctacgacaaaacagatttggaaaacgaactgaaaaaaattgaaaaatgggaaaaggaacagcagaaagcatggttttgggaaaggatcggccggctgccgttcaaagttctggacaagcttacgccggcattcattcaagataaaatcggcctgctgctagacgaaatcggcggctttattcaaaatggaggccaatatttgacgtccgaaaagcatctgatccgccagtttcaaaaaaagctgccggatgaaacgatcgaaacgattgaagatattcaatgggctcctttggaagtgatggatcaaatatgtgaaaatctcgggaaaaacagggcgaataccgcagcagtccaaggagcgacaaccggtgtgggcggcttgttcacgcttgccgtcgatattcccgcaatcctcggcctttctttaaagacattgcaggacatcgcggtatcttacggctacgatcctaaagaaaaaacggagcggatgtttattattaaatgtctgcagctcagcgctgctgatattgtcgggaaaagggcgatcattcaggaactcagccgataccatcaaccatcaggctcccgtgaaaatatgatttcgcaaattcaaggctggcgggaagttgtttatacataccgcgattctttcggatggaaaaagctgtttcaaatggtgccagtagcaggaatcctttttggtgcaatctcaaatcgttcgatggtgaacggtgttgccgaaacagggatgatgatgtataaaaagcggcgcatcatggaaaggcttgcggagctggacgcgacagaaacagagggataaaaaggctgccgtttgataacggcagcctttcttatagagttacgctttttctgtaaagcgaggcagtctgaagataatcgcgcaaatgccgcagacgccgattaaaatcggataaaaagaataaggaaggatgctgataggcgatattttcgcgatttgtgcagctgacagcatttgtgcaccgtaaggaatcaatccttgaaccgcacaggaaaaaatatcaaggatgctcgccgatttcctgttgtcgattccgtacctgtcagataaatcttttgccagcggccccgctgtaatgatggcaatcgtattgttggccgtcgccaggtttgccgcgctgacaaggccggcaatgcccgcttcagctcctttttttgaacggattctccgcgatacaaattgaaggagaaacgcgatcccgccgtttcgcttcatcatttccgccattccgccaatcagaagcgataaaatgatcagttcagacatcccgccgatgccttcggttatcgccgtcaaatacgtatgaagcgtcaggcttccgtcggaaattccgattaccccggctaatacgatgccgccgaaaataacggccataacattaaatccgagaagggcaaatatcagaaccccgagatacggcagcaccttcacccagctgtaagtcccggcttgtgctccgggatgccctccggctgagaacaccatcagcagaatgaccgtggcaaccgcggcaggcagaacgatcaggaaattcgttttaaacttgtccgacattttcgtcttttgagtgcggacagcggcaatggtcgtatcggaaataaatgataagttatcgccgaacatcgcgccccccacaaccgcagcaaccgaatatgccgccggaacgccgatttcagcgctaatccccgctgcgatcggagcgagcgcagcaatcgttccggttgacgtgcccatcgacacagagataaacgcagcgatgataaataaaccggcaaccataaactgccccggtacaaatgaaagcgcgagattaacggttgattcgacggcccccatcgcctttgcggctgatgaaaacgctccggccaaaataaagatcatcaccatgatcattatgtcggggtgcccggcgcccttcgcaaaccactccgtcttttggctgagcttctccttcctgttcatcgccagtgagacaaccgatgccgcaagcgccgcggccacgattggcaggctgtaaaagtcgcctgtgatcaagcctgatccaacgaataaacaaacaaataaaaacagcggcaaaagccctgaggcttttccgttttgattttgcatgatgtacacctcttctgtaggttcaaaccgttttttcaccaatatccaacactttaaaaggcgcacgcgcaaaagtcaaatggtaaaataagttctggagaaaatcaaatcaaaagcgggggaagccgatggatcgcaaaacgaatcttcttgaattgacaaaggaagtcgcagaaaagcacgccaattttcttgtttcggaagtgaacgaccattgtatgcgaattgccgttttggagggcgaatacgtatggcatatccatcccggctcagatgaactgtttattgttttggaaggggagctgttgatcgattttcaggatcgccccacagaagttctgaaagcgaatgattccctgctgattccgaaaggcgtcattcaccggacacgcgctgatgtcaggtcggttaacctttgtatagaaaaaactaatgcggaaaccgtcccgttcgcggaagggaatgtgctgaagctgatacggtgcaaatcagccgaacaaaagcttcaagcattcagcgaggcgcaggccaaatgggctccgctgcaaaacgtcagcggattcatcaggcagtggggcggatggatggaaacagaagacgggccggaagccgtcgtcctggcgctttggaaatcgaagcacgattatttgaactttatggcggaacatcatgatgagatatatgaaagaacgcatcagaaaggcacattcgaatccatcaacattacgctgtttgaagatcctgccgagatatctgaaacgctgcagaacaatacgccggctccggtaccggaatggacggtaatgggcagcggacgattgcgcgatccacactctctttcgtgaatgtgctatttgtgtttactctttttgaaatgtggaatgtaaaaaccataacacttcaaaaggaggaatcaaaaatggcaaacaataatgacgacaacaaaatgagcagggaagaagcaggcagaaaaggcggagaaaaaacaagccaaaaccatgataaagaattctaccaagagatcggtcaaaaaggcggagaagctacaagccaaaaccatgacaaagaattctaccaggaaatcggcgaaaaaggcggggaagccacaagccgcaaccatgacaaagagttctaccaggaaatcggcgaaaaaggcggagaagccacaagccgcaaccatgataaagaattctaccaagaaatcggtgaaaagggcggagaagccacaagcaaaaaccatgacaaagaattctaccaggagatcggtaaaaaaggcggagaagccacaagccgcaaccatgacaaggagttctatcaagaaaacggcgaaaaaggcggacgccaaagaagaagcggttaatgtgcggtgaagagaggggctgacaaacagcccctctctttttatgaagatgcctgccgctgccgcttgaacgcccatattaaattattataaattattgatcttctgaagagatttccggtctgttttgttatataatttacagatgatgcatcaaattgtagttataaaagtttgaatgctaaaagttaaggactaaagtactggtgggagtgtaccgaatggcagcgttgattaaattttttcagcatcctggggtcaggcgtttttcagtttttgttgtattggcgggggttttatatctgttccgcagcatgatgaatctcatattgctcacatttatctttacgtttttgatgaaccgtctggaaaatgtgatccgcggttttttaaaccgctttattaaagtcagccagagactgattatttcttgtttgtatgcggctcttgccatcgcgctttcgatcggcggtgtggtctattaccccgtaatcgtcacccagattcagcagctgatcaaacaaggaaagcatatcgcttctcaccctgacagcattccttttctcgatatgatcaccggtatgttcggcgatatcaatttgacatcctatttggaaaagggtcttaactttatctatacatatatcacggatatcagcacgtttggcctgcaggtggttatgtcattggttctcagcatgttcttattgatcgaaaaagacaaagtcatgagcttaatggataaatttaagacgagcaaaatagctattttctacgaggaaattgcttactttgggaaaaaattcacgagaacgttcggcaaggtgcttgaggctcagtttattatcgccaccatcaattgcgcactgacgaccattgccctcgccattatgggttttcctcagcttttcggccttgccgtcatggtgtttttcctcgggctggttccggtcgcaggcgttgtgctctcccttattccgttaagcattatcgcctacagcatcggcggaatcgcttatatcgtatcactggtattggtcatcatgatcgtccatgcgatagaggcctatttcctcaatccgaaattgatgtccgcaaagacggagctgccgattttcttcacgtttatcgtgctgattttttctgaacattttattgggatttggggtttaattatcggtattccaatatttgttttcctgcttgatatacttgatgttacaaatcaggagaaaaaccgaacagcaggcacacgaaaatagcatatatttgtaaatcgaaaaattcggtttacatatttcgaattttcaggtataactgttatataacgaaatagcgccacacgtttaatcctttagtaggagtgggggacccgatcatttggggtgaatttttctgttcccgtgcgaaccgaaagacggacatctcttcgtccgaacccgtcagctaacctcatcaacgtgaagagagtcatgtggaaccaattttaatggtaaaagcccgtgggagatctctcatgggctttttttagaaaggggagatatgttatatgaagttagcaacaaaaattattatcgctctattgctcggtgcagtcgtcggtattatactgaacgtcacttcaccggatttattcagcaagcttaatacatttttattcgggccgctcggcacgatcttccttaacttaatcaagatgctcgttgtaccgattgttttcttttctctgactttaggggtagcaggacttggagatccaaagaaattgggcagaatcggtgccaaaacgatttctttctttttaataactactgcaattgccattattatcggacttgttttagcgttggtcatcaaacctggaacgatcggaacatatgatacaagcgctgcggaatattcagcccagaaagcgccaagcatttctgacacgcttttgaatatcattccgacaaacccggttcaggcaatggctgaaggaaatatgctgcaaatcattgctttctccattttggtcggtctcggaattacgatgctgggcaaaaaagcggacgctcttctcaaagtggttgaacagggtaacgatctgatgatgtacctggtcaatcttgtcatgaagttcgcgccgtacggtacgttcggcttgattgccggggcaatcggaagccagggctgggacgccattaaagcaatggggctttatatgatcgtcgttattctggcgctgttcattcataccatcgtcacatacggcgcagcgattgcgcttctggcaaagcggaacccgctcacattctttaaagatttttcagaaggttatgcttgttgccttcagtacgtccagcagcaacgcgacgcttccggtttcgatggatgtcgctcaaagaaagctgaaagttccagagccgatctcaagctttgtccagccgctcggagctacgatcaacatggacggaacggcgatcatgcaaggggggcaacagtctttatcgctcaggtgtacggcaatgacctgtcgctcacacagctgttgatggttgttctcacggcagtgcttgccagcatcggaacagcgggtgttccgggtgtcggactcattatgctcgccatggttcttcaaacagttggccttccagttgagggaattgcgctaatattgggaattgaccgacttctggacatgattcgtacggctgtcaatacaacaggcgatgcagcatgtgcggtcatcgtcaccgagacggaaaagaaacacggcaaaatcgaagcccctcatagtgaagtgtccgtgtaacttaagaaatgatataatcaaacagtgccttttcggcactgtttatttttttggaaagaggagggggctatgacaaagcagcctgttttacatatagaaaatgttgataaaatcatagacggcaaaacgatattgaaagatatccgcttaacggcggatgaaggggagatcatcggtctgcttggtccgaacggatcaggaaaaacgaccctcatcaaattgatcaccggtttaatcaaaatgaagagcggatcaattgtcataaacggctttccgattgaccgccaatttgaaaaagcgatccagtccgtcggagccattgtagaaaatcctgaattctatccgtatctgacaggctatgaaaatctgaagcactatgcaaatatgcacgctggaatcggacgggaaagactggaggaagtcatcagcagagtcggccttgaagatgccgcagaagacaaggtcaaaacatactcgcttggaatgaaacagcgcctcggtattgcccaggcgattcttcaccggccaaaactgctgattttggacgagccgacgaacggattggacccggcgggaatgaaagatttccgcgaacacttgcgtgaactcgccgaagaagaaggaacggcgatcctgtttgcgactcacttgctgaaggaagtggaagatttatgcgaccgggtcgtcatccttcaaaaagggaaaatcaaatcaactgtcgtccttaatcaagcggacgagaaacaggaaaaggcgatgctggaggtacagcctcatgacaaagcgcttcagtggctgaaagaccaaggatacgaagctcgcaccgaaaaaggcctgcttgccgtaaaggtggagaaagcgcaaattccggctttaaatcaacagcttgtcgccaatgatattgacgtctattcgatcgctccgtttaagcagtctcttgaggatgaatatatggcgcggacgaatggaatagaagagaggaatgctgatgtttaaactgattcaaaacgagcatgttaaattgctgaagcgcaaagtaacatttgtatcgctggcgctgattgtagtctttcaatttctcctcgcgctcatcaccaaaagaatcctgatgggcgccggggcagaggatcattttatcggctatttttcattcaccccaaacctgaatatcctcttgcaggggctttcgattgtggtggcggcttcaattatatcctttgaatatgataaaaagacgatcaagtttttgctgatccgccctgtcagaagagaaaagattctcgtttctaaatacgtgacgagcgtgctcgcaagcatttggctttttattatttactacggattttctatattgttcggcctgctctttttcggcgtgaagctcgacgaaaaagcggagccgctctttatcaatacggtgaaaatgatcgggacgcagtggtttgaagtatggatgatggtttcatttgcgtttttatgctcggcattattcaaaagcagcgcgctcagcatcatggtgtcgattgtcgtgctgtacggcgccaaaatgcttgtgacgattatggcgtatttggaaaagccgctcggcaagtttttattgttcgccaataccgatttaacgcagtacgccggagaggcaaagccgctttttgccgggatgacgcctttattctcgctcttcatcgtctttatccatctcgtgttttttctcggaacggcatggtggggcttttgcaaacgcgatatgaaggtataaataattgtccaaagtgtgacaaaaggaatgacatttttgtgaaatatgtcgtaattaccgtgtgaatctcctattctcaattataattttaggaagggaatgggggatgagacatctatgaaaaagtttattacggcgttgccgattgtattgctgctgtcattttcatttgtttcttttgcctttaactttgatcatctcgtatattttagacttgcgctcggactattttcgcttgcaggtttgtttctgttatataaattgaaaaacggcgtccgcctctttatggcatacctttatggaagctggatcgtgctggccggaatcgccgcatatgaagaaccgcttttttccgatttcttcttcggcggcctcacgatcacgatgggctacttaacctacatgctgatttatctcggtatgaaggttgaccgccgcggcggtcaagccgtttagtcaaaagcgcacctcgctgaaggtgggcttttttgttttgccaaggctatcatttgcacaacgagccgagaacgaactataatacttattaaatctatcggaatttggtcaggaggatgccggcgtgtgttcaatatttgtgaaaacggaaaggcagcaggaatggctcgataaaatcggaaaattggcggatgaatttgagaaaacagcagcgtactatgacgaacatgcacaatttcccgcagaacatattcaaaagctgcgggattcaggctacacagcgctgacggtcggaaaagattacggaggagaaggcatttcgctctacgatatgcttttgtttcaggaacggcttgccaaaggagacggaccgacggctctcagcatcggctggcacttaagcgtgatgggggaactggcggagggaaacagctgggaccgggatgtgttttcatcgctttcccatgaagcattaaagggcgcgctgatcaacagagcggcaagtgaagcgcagacaggcagcccgacaagaggaggacgccccggaacccatgcagtcaaaaagaacggcggctggattgtaaacggccgtaaaacattcacaacgatgtctccggttctcgactattttcttgtcaccgcttggattgaagagaagcaaatgatcggcgttttcttgatccataaagatgcggaaggcttggcaatagaagaaacgtgggatatggcggcgatgaggggcacgggaagccacgatttggtgctgaccgatgtccgtctggacgaatccatgcttgttgaactgttggctggtaaaagaaccgataaaatcaacggctggctgcttcatataccggctgtctatttagggatcgcacaagcagcgagagactatgctgtccaatttgcaaaagactatcagccgaacagcttgaaaggtccgatcaaagaggtgcccgctgttcagcgccatatcggcgaaatcgatctggaactcatgaaagcccgccactttatgtatcatgttgcagagctttatgatgatccggagcgccgcgcccttttgacaggtgagcttggagcggttaagcacacggtaacgaatacggccattgatgtcgtagacaaggcgatgagagtcgtcggagcgaaaagtctcgcaagaacgaacccgctccaaagattctaccgcgatgtccgggcgggcctccacaacccgccgatggatgatgcgacaatcgccaagcttgcaggaattgcattcagcgaatagttttgtcattctttaagctttagcggggtgtcgatccgctaaaagaagccgttcaaaatcagcggcttcttttttatgtttgttttgcttttgaaatggccaaaaggcggttctcgtgtctgcggtcgatcttgtcataaatgacttccatttctttcgggttcttggcgatttcttttttatattcttcgacaagctgatgaaaggttttaatcttccgttttgacatgtttatccgcctttcttgatggattggtattcgctttcagttcgcttaaagacaattcgtagaggtggcgctcttcttttttatatatgccaagctggataagacgctgaatgagttgtttctttctcatttccaccgctttctttaattgaggggccatgtgatcacctcgtcaaccattagtgatattgataatcattatcaattaattgcattatactaaacctgatcaccgaatgtaaagcgacatcttcgaaagaatattgaataaaatcgaaaaatatgaattattatccaaaagaatatataaaaaaagaagccgacaagggcttcacaactagaaaaaataattgcaaaataggaacaaaaaacattctaccggaatataaaaaacgaatcaagaactttttatgaaatttcgacattttaagtttcccgggaaatactcgtgtcgaattttttaaagctcattcttttatgaaacaaattttgctgctgtcccgtcttgtataaaaaggacatgggggtgctcccatgtccggcggttcagacaaaaaatcaggactttaaacgaattagctaatatgttcagccaggaattcattcacttcttcaggcgttttggcatttgcgctgtgaaggtgtcccgttttttcgccgtttttgaaaatcaacaggcttggaatgcccatgacctggtacttgtcggcaagttcaggaaggtcgtctttattcagctcataccagtcattttcctgataagcctcaagaatgtctccgatgaacatgttcatgcgtgtgcagtccgggcaccagtcagcgtaaaatttgacgatgatttctttatcggattggatcaattcattaaattgcgcttctgttgtgatttttttcaattgcaacctctccttttcaatgccattttaatataaaatgaaaaggatttacatacaaatgctttttatatgctgtttttagaccgtattaaaataattagatcattttcccgggaaagtgataagatagtaaagatgaatccagtggggggagtacgaattgaagacaagattaggattggtatacggcggaaaatcagcggagcataacgtttctctgcaaaccgcgctggccgtcacgaaagcattagatactgaaaaatttgatatacacccgatttatataacagaaaaaggcgagtgggtgagagggccgcaactgacagaaccggtttcaaatgtgaaaatgctgcaatttgaacagacgggccagacattttctccggctgtgttgaaccgcgatatgtttcctggcgaagctgatgcaaaagaagactctatcgatgttgttttcccgcttttgcacggaccgaatggggaagacggcaccattcaagggatgcttgaactattgaatgtgccatatgtgggcaacggagtcttggcttcctctgcgggcatggataaagtggtcatgaagcatctgtttgcacaggcaggtcttgaccaggcgaaatacgtttcatttttgaaaaaaacttggagtcagtctaaagaagaatgctatgctcaagtggaaggggaacttggctatccgtgctttgtaaaaccggccaaccttggatcaagcgtcgggatcagcaaatgcagaagccgtgaagagcttgaccaagcctttgagcttgcattccaatatgaccggaaaattgtcgttgaagagggcgtcatcggacgggaaatagaactcggcgttttagggaatgatgaacctgtctgctcagtcgcgggggaaatcgctccgaagaaagacttttatgactataaagcaaaatatgaagacggcgatactgatttgattattccggcttccctgacagaagacgaatacgaaacaatgcgcagcatggcggtcaaagcgtttcaggcgattgacggttcaggccttgtgagagcggactttttccttacaaatgaaggcagggtcctgatcaatgaagtcaatacgatgccgggattcaccccgttcagcatgtttccgcttctctggaagcaatcaggggttgagtacgctgaactgattgaaaagcttgtcgctttggcaatcgagcgccacgaagaaaaacagcagattaaacatacattttaacgggacggagcggaccgaatccgggagctttcatggagaaaggcgctgaaggcggttcgcccttagatacagctgcagacactatccttatttgtggtagtgtctcttttccttgcagaagaaagagagggacatacatgataacaagaacggtaaaagaaattgctgaaatgtcggaaggcgttttgacgaatgaagcttttgaagggcgtctcatcaaaggcgtctcaaccgattcgagaaaactggcgaaaggccaactgtttattccgcttgcaggcgagcggttcaacggacacgtttttgcagagcaggcttttcaggaaggcgttgcggccgtgctgtggaaccgaagtgaaccgaatcctccggaagggaagccggtcattttagttgacgatacgctggaagcgctgcagaagcttgcgaaggcatacaggaatcagctggacgtaaaagtcgtcggcgtgaccggttcaaacggaaaaacgacgacaaaagacatgattcatgctgttttgggcactgagtataaagtgcataagacagaaggaaactacaataaccatatcggcctgcccctgacgattctggcgatgcccgaagacacagaagtcgccattttggaaatggggatgagcgccaaaggagaaatcgattttctcactcgtctggcgcggcctgatattgcagtcattacaaacattggtgaatcacacctccttgaactcggatcaagagaaggaattgcagaggcgaagctcgaaattgtcaatgggctttcaaaagaaggcacactcatttatgtcggagatgaaccgctgctcaccgaaaggctgaaccagccgccttacgatacaaagacgtttggagaggatccggctttcgattatcagcttgaggatatgacacagactgaagaggggacggcattccgcgtgagaggaatcgaaaacgggttcttcatcccggtccttggaaagcataatgtgaaaaacgcattagccgcgattgcggccggagacctcttgaatgtcagccgcgctcacattgcagaagggctgactaaactgaaagtgaccggaatgcggcttgagctagtaaagacgccggacggcgttgcgatcattaatgacgcctataatgccagcccgacatcgatgaaagcggcgatcgagcttgtcgaacagatgaagggatacggcaagaagattcttgttctcggcgatatgctggagctcggagaaggagaaaaagcgtttcatgaagaaatcgggcaggcggtcaacccggactcgatcgactttttatttacgtatggagaactcggtgcatatattgcaaaaggggcgcttaaacatttcccggaacaccgcgtccttcatttcaacccggaagaaaaagacagtttgaaaaagacactgaaagaaaaagcgaatacaggggatttaatcctcgtcaaagcgtccagaggcatgcgccttgaggatgttataaaagatttgtaagggaactttgaatcataaagtcgttttttatgtgatgatcagtaaaagaaaacgggtgaatggtcatgataggatgtttatgcattcacggatttaccggagcgccgtatgaattggaaccgctggcttctcatttaaaacaaacggcagattggcaagttgaaatgatcacgctccccgggcacggtgagatgccggttttaaaaggcgtctgttttcaggaatggatcgcttgtgctgaagtggagctcatccgcttgttgaaaacgtgtgatacggtatttttaatcggattttcaatgggcgggatgattgccggctatttagccggaaaatatccggtcagccgccttgtcctgttgagtgcggccgcccagtacatcagcccgggacagctgatccaggatttgaagaatgtgatcaaagattcactgcaaggcaagctagaggataatctgctttacaaaaggtacaaacaaaagctgacaagcactccggtgtcttctgcatttcagtttcgcaagctcgtcaagatgacaaagcctgcattgaaaaacctccggatccctgtgctcattgttcagggggagtgtgatgccatcgtgccggtgtcaagcgcgtattacttgtatgaaaccattccttccgaagaaaaagagctgtgcctcttgccggaatccaagcaccatgtctgccttgaagaaaactcctctatcctatttcaaaccgttgaggcgttcctcaaaaaaacgccgattgaatctataaaaaaataaataattgaacggaaatctgcaaaaaataatccgggatgctgacagggaaaaaatgaacgtatgctgtcgaaagcagcacatgcctgtgttacaatgtgtaaaggacgccttcgggcgggctttagttgcgcggacggacggcttcgcccgaggttcataggagactgccgaaccggcgagagagcacaccgctcattctcatcttgttgaaaaacgtataatggaatggtaatataacatgtaaagtaattcgggctttgcataagtatggacctgtcctttgcacaaagggcagtttttattgataaaacacgattactgaaacagtaagcagaaggagtttgaatacattgacaataacgtttcaagattttcaattaagttctgatctcacaaaagcaatcaagcgtatgggatttgaagaggcaacaccgattcaggcacaaacgattccactcggccttgcaaataaagatgtgatcggacaagcgcaaacgggaacaggaaaaacggctgcatttggcatcccccttgttgagaaaatcaaccccgagtctcctaacattcaagccattgttatcgcacctactcgtgaactagccattcaagtttctgaagagctatataaaattggacaggataaacgcgctcgcgtgctgccgatttacggaggacaggatatcggacgccagattcgcgcgcttaagaaaaaccctcatattatcgtcggcacacctggtcgtctgcttgaccatatcaaccgccgcacaatgcgtcttcaaacagtgaacaccgttgtgcttgatgaagcggatgaaatgctgaacatgggattcatcgaagatatcgaatccatcctttccaatgtgcctgctgaacaccagacattgctgttttctgcaacaatgcctgctccgattaagcggattgcagaacgtttcatgaccaacccggagcacgtaaaagtgaaagcaaaagaaatgacagtatcaaacatccagcagttctacctagaagttcatgaacgcaaaaagtttgatacgctgacacgccttcttgacatccagtctccggaattggcgatcgtattcggccggacaaagcgccgtgtcgatgaactgacagaagcgcttaatctgcgcgggtatacagctgaaggaattcacggagatttgacccaggcgaagcggatggttgcactccggaaatttaagcaaggcgcgattgaagtgctcgttgcgacagacgttgcggctcgcggccttgatatttcaggtgtaacgcacgtctacaacttcgatgtgccgcaagatcctgagagctatgttcaccgcatcggaagaacgggacgcgcgggcaaaacaggaatggcgatgaccttcattacaccgcgtgaaaaggatatgctgcgcgccatcgagcagacgacaaaacgcaaaatggaccgcatgaaagcaccgactctcgatgaggccattgaaggacagcagcaggtgacggttgaccgcatccggacgatcatcgaggaaaataacctgaacttctatatgacggctgcagcggaattattggaagaccatgattctgtgacagttgttgcggctgccattaaaatgatgactaaagagccggacaacacacctgtccgtttgacggaagaggctccgctcagaacgaagcgaaacaaaaatcaccaccaccgttcatcaaaacgcagagacggcggcggctacagaggaaagaacaatcgttcatcttatgataaaaagcgttcttcgaatgacagacgccaaaaaaaatcatataattcataatcaaaaggcggatccttttttacggattcgcctttttttaaaaactaaagcctttaaacgaaacattttcagaccgaagaccgtaaatagaatgagattgggggaatcgagttttgagaagcgagccgaaaaatcaaatcagccgtgatggcgttaaagtctggagaatcacggcttgtatcacatcattcgttttaatgctggctgcagcaggcctgattgccgccggggtgatatttaagtggccggtatggatcggcattttgtcagcggccgtttggctggggatttcatttgtcatcattatcatgattccgaatatccgccacagagtctggcgctacgaagtccatgagaacgaaattgatattcagcacggcatctttgtggtgacccgcgtgatcgttccgatggtcagagtccagcatgttgatacatcgcagggccccatcctcagaaaatataatctcgcctccgtgcaaatttcaacagcagcgacgacccattccattcccgctttggatgttgaagaggccgatcagctcagagattccatttccaggctggcaagggtgactgaagatgatgtctgaaccgagacgcatgcaccctgccgccgtcattctcaactttatcaaaggccttgttgagacggttaaaaattttatcattccatttggcgtggtgatttttttaaatcaatcgcaaacagtcaaaatgatagcgatcgccgcggccgtgctgtttttcattgctttggttgtgacgagcatcatcaagtggagcaaatttacataccgtatcgaagaggatgaattgcgaatagaggaaggcttgatcaataagaaaaaaaggtatattccgatcgaacggattcaaacgatcaacacaagcgcaggcctcattcaacaaatgttcaagctggtgaagcttcaagtcgaaacggcaagcggaggaacggaagcggaagtttccctggtcgccattacccaggcagaagccgaacgtattcagcaagcgcttttcgaaaggaaaaaagcggcggaagacacggggaccgatgtcccggttccgctggaagaaactgctgaagaggcggaggaagcggaagagccggtaatgatgtacaaaatgaccggccaggagctcttaaccgccgcttcaacctcaagcggcatcggcgttattatttcaggggtattcgcttttttcactcaagtcgatgatttctttgatttggattggctgtatgaccgctttgcttttttgaacagcgcaggtgccgccgtcatcgcattggccgcctttgttgcccttttcatcgcatggctgctcagcatcgtcgggatgcttttgaaatatgcgaattttactgtcgtgcgtaaagagaaagaaatcgtcatttccagagggctgattgaaaagcaacaaatcacgattccgctccagcggattcaagcgattaaaatcaaggagagcctgatcaggcagccttttggacttgcagccgtcacgatcgtcagcgcaggcggaaacgtcctggaagaagataaatcagccatcttatttccaatcatcagcaaaaaaataatcaatcagcgtctcggcgaattcattccggattatgcgccggaagacgatttgaaccgcttgccgaaacgcgcgctgcgccgctatatcctgcgcgcatcctggccggttctcgccgtcgttccgctttccattctgtttccgccatggggctatttgtccgctgtattgattcctttttactggatcatcggctatttctcataccgcgatgccggatggaagatcagcggcagcaaaatcatcatgtcatcgcgcttcatcggcagaacaaccgctgtcattcaacgcaggcgcatgcaggttttcgaagtcagccgctcgtatttccagcgcagaaaacagcttgtttcgattcatacatcaacaaaatcgtctgttttaatggagaagttttcggtggctgatgttgaggagaaagattcggacgatatcattgcatggtattcatatgaaaaaagagtgaacggttaaaagccgttcactcttttgtttaacaatggcggagccaaggcgagtccgcccagcagaccgaagatgtgcgccatcatattgatattttggtttacaaacgtcatcaaaaccgaaatggcgaggatggtgacgatgatttgggaattggcgctccccatcagctcttttctaaacagcacgatgtacaggtacacgccgaacaagccgaaaatggctcccgaagcgccgacatgcatatactccagcggttcgatgaaatatgtgccgatattgccaatcactcctgctccgatataaacgatgagaaacttgagtttcccgagcattcgttccagcccgggggcaaacaaaaagatcgacatcgaattaaagagcaggtggccgaaaccggcgtgaataaagattggcgtcacaaacctccaccattctccgttcgctattccccagttaaagccaatcaataaatcagaccacatctgtacggccgtaaacggaaataaaaaaagaatccaaatggcaagctgcagggccaatatggcggatgtgaccgggtagagcctgataaacgtctgaaaattttctgttctgataaacatgcttatgatttaagcccctttacaatgatctcgtacatatatagtaacacgtttatgaacaggcagcggcgattagtacggacgagaaaatgattttggaaggttgtcatgctagtctgcatattgtctgagacacgctcatatattgggtagtgcaataagggagacgagtcgttgcaggcttttatggtacgcacgccgatacagccggccctgttcttatggcgtaccgttaaagtcgaacaagcggtttcttcctttttacatcaatgattaaaaaggggttgaaaaaaggtgagaaaaagctttgttttgcttttaacggggctgcttgtaatccttatgctttctgcctgcggccaaaaatcgcaagaagatgttgtgacggggctcgacaagaaggcaaaagaatacacgtcctataaggcaaaagcgaaaatgaccattgaaacgggaaatgaaccgcaggagtacaacgtggaaatctggcataaaaaaccttctctttaccgggtctatttggaaaacccgaaaaaagaccagagccaggtgatcttgcgcaatgaaaacggcgtgtttgttttgactccgtcgctgaataaaagcttccgctttcacagcgactggcccaataacagcagccaggtatacttattcgaatcgctcgtaaaggatgtcaaaaatgatggggaagcttctttttccgcaaaggattcaaaatacatttttgaaacgaaaacgaattatcagcataatcagatgctgccgactcaggaaatcgttttccataaaaagaccatggctccttcatcggttaaagtgatggataccgaccgcaaaccgatggtaaaggttgagtttacaagctttgaattcgataagccgctcgataaagactcttttgatgaaaagaaaaatatgacgctgtctcaaattgacgtagcgacaagcgctgacgtgtcagactctttcgctgtcaaaacgccgctcgatgtgcctcagggcgtgaaaaagcttgaagagaaagagatggcgactgaagacggcaaacggatcgtcatcacatatggcggtgaaaaatcctttacattgattcaggaaaaagcccgcgtcgccaaaacatccacttccgtatccatgaacggagagcccgttgacctcggcttcacggtcggcgcactgacggataaatcgttgtcatggacatatgacggagtcgataccttatctcatcagaagatctttctcaagatgaacttctgatggttgcaaaaagcatgcagggacagtcttcgaaatagactgtgccgtatccggcagcctgttttccgcccggaagcggaaagcaggcttttttatatttgcgtcgcaagcgtatgatttcgacagcttttccgtaaaatgtataccgtgccagcaatttttcttttgttcagggctgatgatcccgtgcaaaatttccctttctccgaactttttagtatgatgggaaggacgagtgaaacaaggaacaggaagtgtcatgatgagcttaaaaccattctatagaaagacatgggccgaaatcgatttaacggctttaaaagaaaacgtccgcaatatgaagcggcacatcggcgagcatgtccgcctgatggccgtcgttaaagcgaatgcctacggacacggggatgcacaggtagcgaaggcggctcttgcagaaggggcgtccattcttgctgtggctttattggatgaagcgctttcgctgagggcgcaggggattgaagaaccgattcttgtcctcggtgcagtgccgaccgaatatgcaagcattgccgcggaaaagcgcattatcgtgactggctactccgtcggctggctgaaagacgtgctcggttttctgaatgaggccgaagctcctcttgaatatcatttgaagatcgacacgggcatgggccgccttggctgcaaaacggaagaagagatcaaagaaatgatggagatgaccgaatcgaacgataagctcaattgtacgggcgtgttcactcatttcgccacggcggacgaaaaggacaccgattatttcaacatgcagcttgaccgctttaaagagctgatcagccccctcccgcttgaccgtttgatggtgcattcgtcaaacagcgccgcgggtctgcgcttcagggaacagctatttaatgccgtccgcttcggcatcggcatgtacggtttggcgccgtcaaccgaaataaaagacgagctgccgtttcgtctgcgggaagtgttttcgcttcataccgaactcacccatgtgaaaaaaattaaaaaaggcgagagcgtcagctacggggcgacatatacagctcagcgcgacgaatggatcgggacagtccccgtcgggtatgccgacggatggctgaggcgcctggccggaacggaagtgctgatcgacggaaaacgccaaaaaatagcagggagaatctgcatggaccagttcatgatttcccttgccgaagaataccctgtcggcacaaaggttaccttgatcggaaagcaaaaagacgaatggatctcagtcgacgaaatcgcccaaaatttgcagacgatcaattatgaaattacctgtatgataagttcaagggtgccccgtatgtttttggaaaatgggagtataatggaaataaggaaatccgatcttgcctgatccatcctgaaaattgatgaattaacggaaaaaccactttgcttgccaaaagaataatgatatgattatgaatggaatggataaaatggtggatccctaagtttggtggaaggggatggttttggctgaatcccgcgccaccactggaatattgattcccttggccgaaactttaatatccaaactggatgggggcctcctgccagataaccggagccaaaatggactggtttacccagccaccaaaatggattttccccaaccccaaaatccaccaattccggaatccatgaaaccccggtatatggagaatggccagaaccatttggacatctcttctgaaggctcattttgcagagtatgaggctgaaaacacagtagagcgcttagtaagcggaggataatcatttgattgttaaacgcggcgatgtttattttgctgacctatctcctgttgttggctcagaacaaggcggggtgcgcccggttttagtgattcaaaacaacatcggcaatcgcttcagcccaactgctattgttgcagccataacagcccaaatacagaaagcaaaattacctacccacgtcgaaattgatgcgaaacgctacggttttgaaagagactccgttatattgctcgaacaaattcggacgattgacaagcaaagattaacggacaaaatcacccatctcgatgatgaaatgatggaaaaggtcaacgaagccttacaaatcagtttggcactcattgatttttaatattgatgaaagttgctcgaggcgaaagagcaactttttttgtgttcaaaaataacaaacgatataatggaactgttagtccaaaaaatgttatcagatgtagtcagggggatgaacatgtcgaatcaagcggtgttaaaatttatctcggaacaccaaaatgtactcgccgggaatttggcggatattctgaaagacttaaacagcaacatgacaaacgtgaagctgactgaacacatgtatgagacgatcagcaatgaatatattcatatcctcatgaatgagtccggggacgggaatgaaaaatcgatcgacaccatctaccagttctcttcaaaagccgtacagctcggcgttccgctgaagctgctgtcgtcgggattatcagctttttggaagcacctttactatgaaatgaacaaggatgtgccggaagatcagcagtgctatgatttgatttgggaaatcgataaatttatcgaaccgatcaacagcgaaatcttgaatcagtatgcgatctcctgggagaaaaccgttgctctgcaaaaggtcgcattacaggagctctcggcgccgctgatcccggtttttgaaaatattacggtgatgccgcttgtcggcacgatcgatacggagcgggccaaaaagattatggaaaacctgttgagcggcgtcgtcaaacaccggtctgaagtcgtgctcattgacattacgggcgtgcctgtcgtcgatacgatggtcgcacaccacatcatgcaggcttccgaagccgtcagacttgtcggagctaaatgcctgctcgtcggaatccgcccggaaatcgcgcagacgattgtgaatttgggaatcgatttaactcaggttattacaaaaaataccctgcaaaaaggaattcaaaccgcattagaaatgacagacagaaaaattgtttcattggaggaataatctttgagggtacctaacattccaattttgaagctgtataactgtttattggtatccattcaagtagagctcgatgaccaaaccgctctgaaattccaagaggacctgctgaacaaaatatatgaaaccggttcgaacggagtggtgatcgatctgacttcagtggacatcatcgattcattcatcgccaaagtccttggcgatgtcattacaatgtcaaaactgatgggcgccaaagtcgttctgactggcatccagccggctgttgcggtgacattgattgaactcggcatttctttggacgagatcgagacggcgctcgatctcgaaaaggggctcgagacattgcagcgggaattgggggaataaatatggcagaccaatcctgtgtgaagattttgactgaatgggacatagtggccgccagacagcttgggcgaaatgtcgcaaaagaactggggttcggcacagtggaccaggccagaatcacgacagccatctcagagctggcgcgtaatatttatttgtatgccggaaaaggccgaatctgcatcgaacaggttcaggaagaaggaaaaaaggggttgaaaatcgtagcggaggatgaggggccgggaatcgctgacatcaaaaaagtgatggaagacggtttttcaacctcaggcggcctcggagcgggcctgccgggagtaaagcgtctgatggaccaatttgaattgcattcggacgcggaaaatggaacggatatacaagccgtaaaatggctgcggtaggagggaaggaatggatttcagggaagtgattgagcagcgctatcgacagctgcttagccgttatatatctgaattaacagagacatccctttatcaggggcagaaattcagcagaaaaacgattgaacatcaagtgccgccggaagagattatcagcatacaccgaaaagttctgtctgaattatatccggatcttccagaccatgtgttccattctctcgattttttaattgaagtgatgattggatacggtttggcctatcaagaacatcaaacattaagaggaattcagcaggaaattaaatcggaaattgaaattgccgcgaatgtccagcaaacgctgcttgagacgacggttccgaaagttgaagcgctcgaaatcggtgcggtcagcattccggccaagcaaatgagcggtgattattatcattttgtgcgcgacaaggaatcgattaatatcgccattgcggatgtaatcgggaaaggaataccggctgcgttatgcatgtcgatgatcaaatatgcgatggactctctgccggattcgggcacgtctccttcacaggtgctgaaaaacctgaacagggtcgtcgaacaaaatgtagacccaagcatgtttattacaatgttttatggcaactatcatcttcaaaaacacctatttacgttttcatctgccggtcatgaacctggcttttattattcttgcagggaaaataaattttacgatttaaacgcaaaaggcctcgttcttggcatttcatcaaattacgactatgagcagtacgagcaaaaactggatattggcgatatgatcgttcttttttcagatggtgtaactgaatgccggacagacagcgggtttttggagcggtctgacttgcagaacctgattactgtacatatggagaaaccggctcagcaaatggttgacaatatatacgaacatctgctcaagcttcaggattttcagcttcatgatgattttactctcattgttttaaaaagaaaggtttaaagcttctcttcgctgggtaataaaccagtagctcattaagagaaccagaggtgatattgtgaatttggcagttgatacgaataaaaatgaccatgtgatagaagtaaaagttgcgggcgaaattgacgtgcacacggctccaacactgcgggatgagctgatgccgctcgcggaagaaggaaaagatctcaaagttagtctgaaagacgtttcatatatggacagcacagggctgggtgtattcgtcggcatttacaaagcggtaaacagaactgggggttctttagtgcttgaaaatctgtcagagcgtttgattcgtttgtttgatattacaggtttaaaggacatcattgacatttctggaaagtcagagggtggattataatgaagagagcagctgattacattgaaatgaagtcacctgccaaaccagaatacgtaggaatcattcgtttaaccctgtcggggattgcaagcaagatggggtattcttatgatgacatcgaagacttgaaaattgcggtcagcgaagcgtgcacaaacgctgtgcagcatgcttataaagcagacaacaacacaggagaggtctccgtcagattcggcgtgttcgaagaccgcctcgaaatcgtcgtcgccgatcagggagacagttttgatattcaggataaacagaaggagctcggaccatattcccctgagcatacggtagatcaattgtcagaaggagggctcggtttatatttaatggagacgctcatggatgaagtgcatgtccagattgactcaggcgtaaccgtctcgatgacaaagttcttaaacagggagcgagttgatgatggcacaaccgtccaaaactacgaaactaactaaaaccgaagtcgacacgctgattaaaaaatatcaggagaaccaggatgaagacgctcagctgacccttgttcaaacatataaaaatctggtggaaacactcgccaaaaaatattcaaaaggaaaaagctttcacgaagatctatgccaggttgggatgctcggattgcttggagccatcaaacgctatgaccccgatgtgggaaaatcgtttgaagcgtttgccattccgaccatcatcggagaaatcaaacggtttctccgagataagacctggagcgtccacgttccgagaaggatcaaggagctcgggccgagaatcaaaatggcggtggatcatttaacgactgaaacgcaaaggtctccaagagtcgatgagattgccgagtttcttgacgttacagaagaagaagtgctggaaacgatggagatgggcaaaagctatcaggcgctttccgtcgaccacagcattgaagctgatgcagacggcagcacggtgacgatcttggacatcgtcggctcgcaggaggaaggctatgaaaaggtgaaccaaaagctgatgcttgaaagcgtattacacgtactatccgaccgtgaaaagcaaatcattgagctgacttacattcaaaacaaaagccaaaaagaaaccggcgaaatgctgggcatatcgcaaatgcacgtctcacggctgcagcgcaaagctgtcaaaaggctgagggaagcattggctgaagatccgtatatggagcttaaaccatgatttggactgagtcgaatgaacacatgcaagcgcttgtttatcagcttcctaaagaaggaaaagccgtctgcggtgacagtttttatttccatgcgactgacgaaaccatggtgtgcgcactggctgacgggcttggcagcggtgcgttggcacgcgaatcctcttcggtcatcagcgaagttgtcgaagagcacggccatgaagatgtcgaaagcttgatggaacggtgcaatcaagcgctgaaacataagcgcggtgcgaccgtttcaattttaaaagtcgattttcgaacaaggacgatcgcttacagctctgtaggcaatattcgctttatcttatacgctccttcggacaaatatatccaccctctccctgtgacgggatacatgtcgggaaaaccgcaaacatacaaaacattcacctatacgtatgaaaaaggatcaagattcatcatttattcagacggtttggaagtacccgccctccggacttatttaaaacagcaccatacaccgggagatatatcgaatcagcttgaatcatacacacgaatgggaaaagacgatctcacctatatcattggacagcttttttaaggaagctgccctttgatataggtgtttttccgtttcttttggtacactaagaagacaacattcttttggaggctacaatggatactttagcgtcaatcgtcaaacaaatcgcaaaagaaacggggcttgcgccaaagcatgtcgagagtgtcattcaattattagaggacggcaacaccgtcccctttattgcgagataccgaaaagaacaaacgggctccatggatgaagtccaaatacaaactatctccgaacgctggggatacattcagcatttaaatcagcggaaagacgaagtcatcaggctgatcgatgaacagggcaagctgaccggacagctgaagctggatatagaaaaagcggacaagctccaggaagttgaagacttatacagaccgtttaaacaaaaacgaaaaaccaaggcgacgatcgccaaaagcaaagggcttgaacctttggctgatttcatcatctcgctcccgcgtaatgaagatgtagcagccgaagcccgcaagtacataaatgaagaaaaggaagtcatgagcgccgaagaagcgcttgaaggagcaaagaacatactggctgaacggatctcagacgaaccggaatacaggaagtggatcaggcaggagacttttaaaagaggaacgctgaagtccgcggcaaaagatgccgaagcggatgagaagaaaatctatgaaatgtattatgaatacgaagagccgattcaaaaaatcgttcctcatcgcgtactcgcagttaaccgcggcgaaaaagaggagattttgagagcgtcggtcgagccgccggcagaccgcatccaagcttacttggaaaaacggattttacaacaaaagcaaacaagtgctcaagatgtcctgaaaagcgcgatcgaagacggctataagcgcctgattcagccgtcaatcgagagggaaatcagaaaagaattgacggaaaaggcggaagaccaagcgattcacatatttgccgaaaatctgcgcaagctgctgctgcagccgccgatgaaaggaaagctcgttctcggcgtcgacccggcattccgcacaggctgcaagctggcagtcgtggatgagacgggaaagatgctcaagatcgacgtcatatacccgcaccctcccgtcaataagaaaagcgccgccatcgaaaaagtaaaacgcatcatcgaagactttcaaatcgaggtcatcgcaatcgggaacggaacggcatcaagagagacggaacagtttatcgccgatctcttgaaggacatcgacagaaaggtgtactatctgatcgtcaatgaagcgggagccagcgtctattcggcatcagagcttgcgagggaagaattccccgatctgcaggttgaagaacggagcgccgtgtcgatcgcacgcagactccaagacccgctcgccgaactcgtcaaaatcgatcccaagtcggtcggggtcggccagtaccagcacgatgtcagccagaaaaaactaaacgattcgctccgctttgtcgtggaaaccgtcgtcaaccaggtcggcgtcaacgtgaatactgcatcagccgcgctcttgcaatatgtggccggactatcgaaaacagtcgcggccaacatcgtcaaaaaacgggatgagatcggaaaattcacgagccggaaagagctgaaagacattccgcgcctgggcgcgaaaacgtatgagcaatgcatcggctttttaagggtgcctgacggcgatgaaccgctcgaccggacaggcatccacccggagagctataaagagacgagagagctcctgaaaaagctgggcctttcaacagcccaaatcggcacaaaagagcttcaggacaaaatcaacgaactgaatatttccgaagcagctgaacagctggggatcggggaaatcaccctgaaagacatttgcgcccagctgacgaggcctgagcgcgatccgagggatgaagtccctaaaccgctcttaaaaaccgatgtgcttcaattggaggacttaaaagaggggatggaacttcaggggacagtgcggaacgtcgttgacttcggggcgtttgtcgacatcggcgtgaaacaggacgggctcgtccacatttccaagctcagccattccttcgtcaagcatccgctcgacgttgtgtcggtcggggacatcgtcaccgtatgggtggaagatgtcgacgctgcaaaaggaagggtctccttatcgatggtaaaagatcgataggacttgaagtcagcccgccggaagctttattttccggcgggcttatcttttacatcgcgattttcaacaggatgcggtggacgacgcctgcaatatgtgccggcgtctgaaccatgccgccgttgatccactcttcaaaaatgccgaccgctccggatactagaaatgtaatttccatttcatcgcatgccatctcattacctgattgctgcatcatgctcaattcttcgaaaatcttctgcttgaaaaaatctttaaatttattgatggtcaaaatgtttcctttcggtttcgtcaataaagtgaagattgcagcgttttgataaatatattcagtcgttttttcgatgaaggtgagcagatggtgcggatcttcgcttggaaaataatcatcgtaaaatttccccagctgatcaaacaactcattctcgatttgttcatacaaatcaaaaacatcccgataatgaagataaaaagtcccgcgccctaaatcagcgcgcctcgataaatcggaaacggtaattttattgatttctttctcatggagcagctttaaaaaagcctcttttatcgctctttttgttttaattgaccttctgtcctccatcggtgacctccgtttataaacaaatttacgtatgttgttcattattgaacatctcaaccccaattgccgattgaacaccccatttgccccaaattataatgaacatgtgtttattaatcaataggtgtttattttttaaaaccttcaaatatcaatggcctatcagccgataagttaatcaagcggtttcagctgttttcctgtaaaatgaatgatctttcacttttgcgaataaagtggtgaagtaatgaaaaacagcaaggacaaggctagcaggcggctttttctgccgactttcttaaaatacaaagaaatcaatctacctgcaaagttcatagaggaagaataaaacatcaatgagaacgattataaaggcgagatggatcattgcggcgctctggattgcaatggccgccgtcttattcatcacggcgcccgatatggggcaattaacaaaggagaagggccagatagcggttcctgaaggctatccgtcttcttatgcgaacaagcttctcgaacaaatgtcaaaagacggggatacgaacaaatcggttgtcgtcgtatttcaggacaaacacctcctgccgaatcgggaggcggctttaaaaaaagcgatcaccactttagagaaggattcctcccttcacgtctcagatattacatcgtactttaacgcggatgaggatattcaaaagcagctgttgtcaaaggatcgaacgacgctgctcgtgcctgtcacatttgatgcaaacaaaatcagtgcggccgaatttaaagcaaaggtcaatgaaaagcttaaaactttaaaacttgactacgagatgaccgggcagccgctcatcgatgatgatgtcatgacaagctcgcaggaaggcttgaagaagaccgaatatatcacggtcggttttattttaatcgtgctgattctcgtattccgttctgcggttgcgccttttgttccgcttttggcggtcgcgctttcataccttgtgagccagtccgtcgtcgcctatctagtcaaatacgctgattttccgctgtccacgtttacgcaaatctttatggtggcgatcatgttcggaatcggcacggattactgcattcttcttttaagccgttttaaggaagagatcgcccgcgggaaagacaagatcgaagccattctgacaacgtataaaacggcggggagaaccgttctgttcagcggaatcgccgttttgatcggttttacttgcatcggctttgccgaattccagctttacaagtctgcggtcgcagtagcggtgggtgtcgcggtcttgattttggcgcttctgtcgatcgtgccgtttttcatggctgttttggggaaagtgctgttttggcctgtcagaggaaatatcgggcacccgcagtcaaagctatgggaaaccgccggccgtttcgctttcagtaagccgctgatcagcctgttgatcgtagcggccgtggccgtgccgccgatcttgatgtataaaggaacgctttcctacaacagccttgacgaaatcggagatcaatacgaatccgtcagcgcatttaacaccatttccgacaagttcgggccgggagaatctttgccggtcacggtcgtgctcaaaacatcggatgcgctcgataccaatgacgggctgatcgcgattgaaaaaatcagccgcgccattgaacagacaaacggcgtcagcaaagttcgcagtgcgacccggccggtcggaaaagggctgagcgacctgtacgtcaaaacacaggcgaacgagctgaataaaggccttgaaagcggcaataaaggtctgaaaaagattaaagacgggcttgcagaagcgagcaagtcaatcgcggatcaaaagccgcaaatcgaagcgtccggaaaaggaatcaaccagctgatcaaaggaaccgaatcgatccaagccggaatcagcgacgttgaagccaacatgagaaagctgaaggaaggaacagaccaaagcaaacaaggcgtcgcccaggcgaaaaaagaaatccaaactgcgaaaaaacagctgacggcgcaagtcgatcaattaaatggacaaatcgaaacctacaaagaaatatcgaaaatcttaaaagcggcattgtctcaagccgaaaatgcccaaggcataacggctgacgtgcaaaagatgattgagcagacaaatcaaaatttcaaaaatcttgaaagcgaaattcccgaagtgaaggagaatccttcttatttggcgatcaaaggctcttacacagagcttgcatcggcaatcaagcagggatcacagaaagcggccgtttacacgaagcaggcggcaaacgcgaaaaagcagcttgaagcagcagatgcatttatcgcaaaagcgcaggaagagcaaaaagtgtacacaagcaaaatcgatgctctgataaacggcctcggccaaatcgaaaaagggcttgaagagacatcgaaggggcagggacagctcgccgattcgctgcctaagctcgaatcaggcgcaggtgaggtcgctgaaggccaaaagcagatgaaggaaaaagtcggagaattcgccggccagctcgatcaattaacaaaagggctgaattcaagcgtggacggcctcgaaaaaatttcaagcggtctgatgggagcaggcgactacctggatcagctgaaaaacgcatcggatcaagaaatgtccggctggtttgtccctaaagaagtgctgaaaaacaagcaatttcagcaggtgtttaattcctatatgtcagacgaccgccatatcacgacgatcgatgtgatattggaagacaatccgtatggaaacggagcgattgccaaggtcaaagacattgaagcatcagtaaaacgggctcttcccgacacgcatttgcacgatgcatcgtttggcgtcggcggcgtttccagcatcaacgccgatttgaagcagctgtcagaccaggacttcagcaacacggtgatctatatgatgatcggaatcttcctgatcctcgtcctgctgttccgttcaatcgtcatgccggtgtatttggtcggatcgctggtcttgacgtactttgcatccatcggtgtaaccgaatttattttcacggcgtttttcggctatcccggcctcaactgggcggtgcctttctttggctttgtgattttaatggcgcttggtgtggactattcgatcttcctgatggaacggtttaacgaataccggggaacggatattatgacggcgatgacggaatcgatgaaaaatatgggatcggttattatttcagccgctgtcatcttggcgggaaccttcgcggcgatgctgccgtccggcgttttatcgcttctgcaaatcgccacccttgtgctgacgggtcttttgctgtatgcattcgtcatgctgccgctgttcgtccctgtaatggttcggatcttcggctcagccaactggtttccgtttaaaagaaaagaataaacggctcgtccatccgcagaagaaccattcgcccatgctccccgaaatcgggcggtcagctccatttggggagtaacgggcgccattgtgtgagatgataaaaggaccggtgaagatgatgaggaaacagaagaaaattccattcggactcggatgaacactgctcatcagcagtgtttttttctgtaaaaataccagcactgattcagcaatttaatctggtaatgatctttttcataaaaagctctctgcatctggtttttgagccaattcggcattgctcatccctcctcaggctcttatcataagagtatgggtgtcgtgtattagtttatgccgcccggaatttgtcctgttcaatgtttttaaaaatgaggtggacccaagcaatggatgaacaacaactgcagcagctgacagaacagctttcgctcacatactttaaaaaaccgttccggcaccgcgcttacttcaacagccgcctgaaaacgacaggaggcaggtatttgctgaattcccacaatatcgagctgaataaaaaatacctgacagaacacgggcaaaaagagcttgaaggcatcatcaagcatgaattgtgccattaccacctccatcttgaaggaaaaggctacaagcaccgcgacaaggattttagaacgctattaaaggaagtcggtgcgccgcggttctgcacgccgctcgaaaaagagaaaaagccgcaaagaaaagtacgcacatacaagtgtgaagcatgcggacaaacgtttctccgaaagcggaaaatggatacaagccgttacgtttgcggcaagtgcggagggaaaataaaagaaatcataaaaaagggttgactgatcaggcttgtctatgataaattataaaagccgtcgcaagacgagccacaaagacaaattgttcttcttgacacattttgtcgacatatttataataaaatgagtctgatcattccacagtagctcagtggtagagctatcggctgttaaccgatcggtcgcaggttcgaatcctgcctgtggagccaatggagaagtactcaagtggctgaagaggcgcccctgctaagggtgtaggtcgcgtaagcggcgcgagggttcaaatccctccttctccgccattaggaaaatatgatgctgacttcatatggcccgttggtcaagtggttaagacaccgccctttcacggcggtaacacgggttcgaatcccgtacgggtcatttctcatatgttgggctatagccaagcggtaaggcaacggactttgactccgtcatgcgttggttcgaatccagctagcccagccattatatttgagccattagctcagttggtagagcatctgacttttaatcagagggtcgaaggttcgagtccttcatggctcaccattgttttttcacgcgggtgtggcggaattggcagacgcgctagacttaggatctagtgtctttacggcgtgggggttcgagtcccttcacccgcacttaaaaaacaacatatcatgcggtcgtggcggaatggcagacgcgctaggttgagggcctagtgggtgaataacccgtggaggttcaagtcctctcggccgcataccagagataccaagggttttgacgcccttggtgtttttttgtttcttcaagttttttgattcttgtgaccaaatagtgtccaattggttaaaaataagtcatttaacttgtgagctatttgaggaggaaagacaattctgtgttgttatgttatgtagctcctttggatcaaaggagtttggaatctgtttcggtttattaggattaatcatcaaatttctcatagagggaagaaactaaagttaaaagaaaagcaaactatataaaatagtttgcttttctttttgttatgaattaacgtctttttctttctctttaataactaataaaacaccaataagaattaaaaacgaacctatccaaaatgtcccgcctattttttctcccagcagaagccatccaagtaaggttccaactagaggctgaaaaaagaaaaagagacctccacttgaagcatttaataattgcaatccacggttccataataaaaaagcacaagctgttgaaacaattcctaaatacaaaagaccacctagaattttagggtcaagcagttgtgacgtgaaaattgcggtaggttttacaaaaggagttagtgccacaatggcaacaaaagttgaatacgttgtcacaagtaaagacgaatagctgttgggcacgagtttgataagcactgacattagcgcccatgtaagtgctgcagcaagcagagaaataccaccaatctgattagaagtatcaatatgaccgtttccaacaataaataatacgcctatagtcgctaaaataattgaggttcctttttttatattcaatggttctttaagtaatagacgagcaaaaataaccatgaacgctggtgtggaagacgtaataatcgcccccatttgtgctgaagataacatcgttccatattcttgcgtaacaattgaaattgtgttgccaactattccaatgacaacaattaataaaaggtcacgtttatgaattttccaagattgtctctttattaaaccaacgataagaagtgtaaggatggcgattacgtacctaatccaaaccaattcaataggcggaattactgcgacaacaaccttaaccactacatacatgccgccccagatactagcggctaaagctaaatatatagaacctaacagggtatttttcatttttttgttccctccgattataataggcatagcgcccccccgtatttataattaggtcaataaatgccctaacggagagaagtagtcactttactccattaatcagcggagaagtgctactggaacatcattttcaatagtggagctaaaaacatgttttttcacctcaactttattattgcacttattatacaatgtctgttattaagcggcaaacacctctatttatatagtgggagttgtttgaagtaagccgtgggattttcttgaagtgtgttttcttagacgaagataaaattcaatacgtgacacagaagtcatgtttgttttagtctgaaaacagttccccattttgtgaccaaaaagaacataaaatgataagtataatgagtatctgtgaatgcttgatatgacaggcttttgtaactgatgataagctttcactttatattgagggcctagtgggggcaaccccgtggaggttcaagtcctctcggccgcataccagagataccaagggttttgacgcccttggtgtttttttatgtctacttcccacgaattagattgcaccggaaatcgaacgatttagggctgtaattgaaaagtacgcccgtgaggaagttgtttttgaccaagtgaatattatcgaccgattgcgccacgctaaccatcttttgcgccatccaatatcgtgtaatccaccactgaatatcataagttgcaccaccgcttataaaaaagccgccaatcatcattcaatacgaggttggtggcttcttaaaataggaattcagcaatctctggcttaaggggggtgattatcattagtctgtaaggaggtattgtctaatcctccgcccatggctgagaatcactccccggcctttcttatgaaaatcctttttatattggacggataggtaaatcccagcagctaaaaatgccagcgcatatttgtacaagaaaaagatggtccacatatcatctttaggaaaaatcatgtcacatagaataatgaccaacagcatataggaactacttttcaaatagattttatttgtccgttcgtcgtcttttccaagctttttataaaatacatagaccaaaatcccgctaccataaaccaataaaaaaccaacaacgatgagaatattccaatttcccggagattgttcagcccaggaccttaaaggggaaaaaattgtgttatggatacctgagaaaaacttacttatcattttgatcatttcctttcacataagtaaaaatttcgtttacatcaacattaaaaaattcagcaattcgaaaagccaacagcagagtcggaacataatttcctttttccattacgaaaatggtttgtttggaaaccccgactttctccgctaattcttgctgagacattctggcaagtacacgatattcataaaccttatttgatatcgaatcaccaaagtctttcttcacgaccatcacctcttgaatcaaattataaacttactttttacaaaagtaaagtaaacttatacaaaaggataaaataattttatttttgtttaggttactttgatataacaagagccaaattgcagaaagaacctgacgaaattcttgttccgtcaggttcacattttgctctggtgtaattcatggtttttaatggggcattttatggttttcggtggggcaaagaccggtaagaatggtgcggtcgggtgataatattcactagaaaatcaactttgataagctttactgaaaagcttactccataattaataaaaaacaatcaaattttgtgtaatcgattaaatagatgcaatgaaaataagctttcataaaccatgataagctttcactttattgagggccacccccgtgggaggttcaggtctctcggtttaacaccaaataataccaaagttttaattgcctttggtattatttttttgcggaaaatcggcaaaaaatgtacagcattgtccaagtctgcaagtatatttggcactaaaaaagtgctgacctctgcacaaaaccgttgtgcgagtctgcacttttattctcaagatacactgcctattatcatcgattatgggaagtttatttaatccgttcttagttgcgctgatacttggcttttagaagctttttttaagtggctaaaaccaacaaattttttgctttcttcatcccatagtcggaactttaacgacttaagacttgttgccagtgtaatggttggaacgttttgcaatggttcaatgttgttatgcacttcttcaagcttatagtttgggactctcgggcttaaatgatgaacatgatggaaaccgatattgcctgttagccattgcatgacttttggaagcttataaaaagagcttccttcaactgctgcttttacatattcccaatgctcatcttcttcaaaataagaatcctcaaacgtatgctgaatataaaacatccaaattccgagagatcccgatatcataaaaattggcgcctgaaccagcaggaagttttgccagccaatagcccagcataaaagtgctgtcaaagcggcgattcccaagttcgttacatacgtattcatccgttctttgcgttttgcccctttacgattaaaacgattggtaatcccgaagacgtaaatcggcccaatcataaacataacaaacggatttctgtataaacggtacattatttttgtcttagttgaggcttccttatattcttcaacggtcagcaaccaaatatcgcctgtacctcgtttgtccaggttgctgcttgtcgcatggtggatagaatggtcgcgtccccaatgatcaaaaggatgcaaagttagaattcctgtgattgttccaaggattcgattcgcctttttgttcttaaaaaaggaatagtggcagcaatcatgaaagatgatgaaggttctcactaaaaaacctgccgcaacgatagaaatcgctaatgtaaggaaataagaaatcgacaagctcttatatgctaaacaccataacaggaaaaatggtatcaatgtgttaatgatttggtaaatgcttttttgtaaatcggacttttcataaggtgtaactagttttctcaaagtctttagattttggtcattcatttttaaaagtttccccttccctgatgagtttctaagtttacgttagtccaagcgtcatacatcatataagtatcgttcttagccctctttattggaaactcgaaactgatttccagctcaattttatgaaaattatacccggctctttatcgggccaaactctctccctgcttccctatgggaattgtttttttttagaccgtgaacattgattgtttaactaacaaacatgatgaacaagaaacagcagagctttttaaagaaaatcaattttagcaaagaaaaaggtttgaagacactcgtgattcattttcacggtgttttcaaaccatagttcttagccctctaagatatgttgtaaattttatgcggaatgattgacgcctatcgcttctgcactgatatccacgcgtttaagaaataatgccatgaataaaacaataataggaattgcaattatttccgtttcctgttatgataaaggagaattatttttgttcggtgtaaaggatagtatgaatattgacttttcgtcttgatgatactttgggcaaggatagtaatacaatgtgcggtaacgcactaggaggcaacaaaaatggaacaaggtacagttaaatggtttaatgcagaaaaaggttttggatttatcgaacgtgaaaatggagacgatgtattcgtacacttttctgcaatccaaagcgacggattcaaatcattagacgaaggtcaaaaagtaacatttgacgttgagcaaggtcctcgcggagctcaagctgctaacgttcaaaaaactgcttaattttcaatcgtttatacaaacaggctctctatgtagagcctgtttttttatgttctctgtataatgcttaataagaaaacctactcaacgttcgagtagggagatggtgcaaagcaataaaaagaagatttcaagcttaaaaggttgtttacagtataacatactggattgacaatatgcggaatgtatataaattatttatttttcttttcgaatacaactacttctcattctttctttttggttacatctccttcatgcaaagttcaacagtatttttccattcaaacccggctgttcataatgcttcaaggcatcataaaaatcttcaaaatcatatattttttctggggcattgatgaccattcttccgctctcaacaagcttaatcacctctgagaagcgattgcggtattcagaaacagaatgtctctcattccaaagtcttaaggcgaataattgcggtgacacatggtatacatcgtgtagctttcgccaatcgtttggtatacctgacaatagaccataactgacaaacgtcccttcaggttttaatgccctcgccagcagttcgccgctttctcctcccacagagtcaattgcatggtcaacaccgatgtcgcaaccatcagaaatcttttcatatatagaacctttggaagcgtcgatggctctccatgccccgagtttttgaagtttttctatcttgcggctgtttcttgtcatgacaattaaacggaatcccagtattttggaaatttgcgcaaacaaacctgcaatagatgtacctccgccattcattaaaacaatttcattcggctgaacacgcaatgattccgtacaaattagccaggctgttaatggattaatatacagttgactggcgtcgttatcacttattgatggaggaagttctatagcataatcagcttttgtggttacatattgttgccaagttccctctcctcttacagggaggaccctttttccaatcaatgatggtgatacatctttgccctgatctatgacaatccccacaccatcatatcctgcaacagccggcagcttaattctatgagaataggctcctctaattggaagcaaatctgatggattaattggactggcaatcattttgacaagaatttcatttggctgaagaggaagcttttctccggcatgtagctgtaatttttgaagcggatcaccgaattccttatatattaatgaaacattattcatgatttgttattggctccttaggttaatacttctataaataaagttgcacttatttgagattatgtcaatattgtctttcttttaatatattgaaggggggtatgaataaggaggaacaaaatagggaaattctcaactaaacttttaaaggcttggctcgcaatccccagatggttcagaatgtttacgctaagtgctatcacgatatatattttatggtcatttttctttaatgggataaaaaatatatttaggttagatacctctacattagttataagcttaatagcatccggaatcatattgatgattttcaataaaggttctgtgaaaaagtagggagcggcattaaaaacattccttatcgtcatgtacgagcgtctgtaaagcgacccaacacttttccagcaaacggcataaacaaatgaagggccagccctcctaaacaaacggttaataaagttccgatgccaatcggtccttttaacatgacggccgctgtcaagaagacaaggtaaatgatggttctcgaaaaaaatatattggttcctgttaattcttttatgatgaatgttagacggtcaattggcatcgaagcaaaatttgtgtataagtatgtcgcggttcctaatcctgtaacaaccaagccgatcccaaaacaaaccgctttgctgtaccattgttctggtgtcacaaaaaaatgcagcaaaaaaagccacatgtcaatgccgataccggttataaacgctgttagcagccccgaaacttccggtctttgtctttttaaaaccgaattgcagcctattaatagcagagcaatgatgacttcccaacttcccacagtaagccccgcatgtacggccagtaccaccaaaagtgcgtcaaaaggcgaagcgccgagatctgattgaatcgtgaaagcaataccaagggttaagattaaaattcctattacataaaaaagatatttcactttgactcgacctctttttgttttttattgcaaatgcaacaatattccggtatatttaatgtacgctaattatattgcatttgcaacaaaaagctcgaaaggggtttatgatgaaggatattctgcgtgaaattggaatgattgcccgagcattggattctataagcaatatcgaatttaaagaacatgacctgacaaaagggcaatatttgtaccttgtccgaatatgcgaaaacccgggaatcattcaggagaagctggctgagatgattaaagtagacaggaccaccgcagcccgtgcaataaaaaaacttgaaatgaagggctttattgaacggagagatgatgaacataacaaaaaaataaaaaaactttttccgacggaaaagggaaatgaggtatttccttttataaaaagagaaaatgaccattcgaatcgtgtggcattagagggattttccgagggggaagcggagatcatcttcaatcttcttcaaagagtaagaaaaaatgtagaaaaggactgggaattcgtgaaaaaggggaacaagagaaattattgacacgtaaaggagcggcagattgaaatgacagtaaatataaaaaggtgtacccttgaagacttacacaagcttcaggaaattggttatgaaacatttaatgagacatttaagcatcagaattcgccagaaaatatgaaagcctacttggacaaggcatttaacttaaaacaattagaaaaagaattatccaatagctcttcgcaattcttttttgtttattttaacaacgaaatcgctggatatttaaaggtcaacaccgatgaggcccagtctgaaaaaatgggtgatgaatcacttgaaatcgagagaatttatatcaagaacaactttcaaaaacacggcctgggcaaatatctgttcaataaagctgtggaaattgcaaaggaactgaataaaaagaaaatctggctgggcgtatgggaaaaaaacgaaaatgcgattgctttttataagaaaatggggtttgtacaaaccggcgcccactctttttatatgggagatgaagagcaaacggactttatcatggccaaaacaatcctataactttttaaaaggaggatgacgatgtatattccaaaatattttaaagtcgaaaatgctgatgaaattttggattttgtccaaaaaaactcttttggcacgattgttacgacagaacaagggaagccaatcgcgactcatttgcctttagggctcaataaaaaaggcgatgattactatatcactggccatatcgcttatggaaacccgcaggtgggaactttggaaacctgtaaagatgtgcttgtcatgtttcaggggccgcacgcatatatttcttcttcctggtatgggcatgaggatgttccaacatggaattatcaagccgtccatatatacggtaaagcaagcattctagagagagatgaattaatagaagaattaacaatcatgatggaaaaatacgagaagcatcgggaaaatccaattttatgggataacctttctcctcaacttttggagagacaactgaaagcgattgtcgggtttaagattaaggtggaagacattcaggctgcatataaattaagtcagaaccgaaatgatacagactacatgaacatcattgatcaattgcaaaatgaaggagatccagattcggagcaattggcagcagcgatgaaaaagaggctggaaaattagatataaatctaccttcaaccctttcgtataggaattaaaggtcggaatcagagcagtcatatttgcagcatcataaagagcgagaaatgaaaaggcaggccgaatgatttgctttttttatgtcgtgtagagttgtttattgtgaaaagggcgaataaactttgtcgaggacctaatggggagggggacaaccccgcgggaagttcaagttgtctcgaccgcatcataggaataccaagggttgataagcccttggtatttctttcttccacttgattctagtgagcaacatgtgaagggcaaaaatcatgtaacatgacaaggcgatggaaagctatctctattattatggagagtttcgactctattattttgttgtcatcccgtttaaaaaattattgggttaaaatagggatttcactaagcaatttcttcaaatgaatagaatcccacggcaaatgctcggttatacctaatccaaccacatccgtttcggaagagagttctttcagaagatgaagcaggtacggcatttgcattgttccctcaggagaaaaatttacaggtgcttcaggattggcgaataataaagaacgaaacgccttcggatcaagcacgtctaaatcaaggtgtattgccagatacttgatgttgctttcttttatccattcttttataggttcggtactggtcattaactttttagttccggcagttctaatcccaagtctttgaatcacttcagtgtctggttctgtgggagctataccttgtctttgaagttcatttgatatcacttttgtttcttcttctgtaggagctgctaatcccgcaataaagacattttcaggtttcaggggaattttcacatgttttgcgaactcttcatctccttctcccaaaagattcccgagcggtaatgtatgaccgttgtcataaccggcatatctaactaaatcgctatgagcgtcaatccaaattaaacctaagtccccgccgtatcgttcgtttaaataagcaaatggtgcttgttcgactaagcagtcaccgccaaacatgacaatgcgatccggcttatgagcatgaatgatatgctgagcagcctccaattgttccagcagttgttttctcccgtttatcccgttttcgttttcaagcggagttccatcataaggttgaaccggaacatgaataaggggctgatcattttcaggagccagccaagcaagcagttctgctccaaaagagtagttgggattgtttcccccttgccattgcggcattaacagacgaattgtttttttagccatgttttagtctcctttacttcaaagtaaggttagtataaaatgaacgcaaataaaaaaatagtacgcactttaatgacaggtactatccaaaaggagagtgtaaaaatgagtatggcagaatataaaggtaaagtgaaaaatattcaagatacaccttttggatacacattgtctgttatcggcggtaaatggaaaatggttattatttacctcctggcagaaaatcaaccaattcgcttcaatgagttgaaaagacaaataggggctattacttataaaacattgagttcacaacttaaagaattggaagcggatggactggtgaaacggaaagagtaccctcaagttccccctaaggtcgagtacagtctcacggataaagcggaatccctattgccggttttagaagggttatgtgaatggggtttaaaaaaccaataaagttaaggtttcattcttactggagagggaagaatcaaaaagcttcgttctattgccaacaatccttttgtttgtctggaaatgtcaatatagattaactgcagaacgatgtgtcggttgcttcttaagagagggcctttagtgttgctaaaactgggtgcttgcaatatagctttgtcggcacatgaatgttccaagtctaaaagggttaccttaattcaagtaaagagcggtattcgcggcagcctgcttaccatgatacgtgattgaactttttaacagaataaatttattatggtatatttaaatataacgtaaaaattgaaatgaggaatggcatgaataaaatcgaaaaacataggaaatttagagcgaagatgattttcaaagtcataatggtcatgatcggaggaatcatagcggcatatggattggaaacagtgctgattccaaacagtgtatctgatggcggagtgacaggacttagcattgttggttcacaactgtttgatttgccgcttgggattcttatcgcggttttaaacataccgtttgtctggctgggatataagcaaatcgggaaaagctttgcgctattgtccattatcggaatcgcatcacttgcagcagggacaagttttatgcaccacactccagctataatcgaaggggataccttgctagtcactgttgtcggggggatcatccttggatttggaatggggctggcgctccgcaatggcggagcattggacggaattgatatgcttgctgttttgttatcgcgaaaattgccatttggaacgagcgatcttattctattctttaacctttttgtgtttatttttgtttccgctgtatttggcttgcagggggcattgctgtcagtcattgcctactacatcgcgtccaaagtcattcatgttgtcgaggaagggttaagcggatctaaaacttttcaaatcattacaagcgaacctgaattaatggttgagacaattcgtgatcaattgggccgaagtgctacatataaagaagcttacgggggtttttcccacgagaaatttaaagaaatcacctgtgtcatcaaccgcttagaagacaccaaattaaaagaaatcattaatgaagttgataaaaatgcttttgttactgtatatgacgtagctgaagttaagggcagtaattttagaaaacctaatattcattagcaaaaatttttgagggccttcctaagaaaaaacataccacgtcttgttggtatgttttttttgtccttcgaagcgatttccaataaattgatgatcagtcatcggaaaatagacaccgcagaatacatgagcagcaggcacataaggactcgaaatacccggtcgtgctttgcaaatacccttttaaaaacggagccgaatcccgaccataatagcagcgccagccacccgagaacaatggctaatgccaaataatagattgtcgatttcaaggaatggttgaacggcaaaacgaacgcgctcattacggttaagaagaacaaaatgcttttaatattgatcagctgaaatataaagccggatataaaagaggagcgggcttctgtggaatcctgttttttatttttggtaaagccgacttgcaaagccaaataaatcaaataacacgcgccggcaagtttaaaataaggctctacaacgggaatccaattgtacaggctgattgtaaaggcaccgctgagaatcccaagtactgcaaaccccgccaagataccgctgctaaaacgccatgaacctgtaaagccgaacctttgcgcttcattcatcattaaaatattgctcgggccgggcgtaatggatgtcataatcacatacgaaagaaaagctataatactcatttaatcaccttcatttgctaatgtcatagtgggcagtttttattgtatgataatgataactataaataaaattgaaatatcaaaatgcattattgattttttcgatagatcaagtgttaaggagacatcgaatggaaatcagacatttaatcacgtttcagaccatcgttgaaatgggaagttatacgggggcggcttcgaaattaggctatactcaatccacgatcaccactcatatccaggctcttgagcatgagatcggcggggctttatttacgtatgaaaaaaggaatttaaaactgactcagttaggaagggagttaatgcctttagccgaagaattgctgtcaacccataatcagatcaagaatttgcagagcgctcacgaagtgaagggggtattgaaagtggctgcgcccgagtctttaaccatttctaggctggggccaataataagggagtattcgttgaaatatcctcatgtcaaattgaaactgagcaacggtacatgcggacaaaaccaagtcgacttattaagcgggaatgtggatgtcgctttaatggtttatcccgaaatcgagctggacaaatgcattcgctacacgttggctgaggagaagatcgtccttgtcggcagcagtgaagggcctgaggatttagaagaatatcaaaaacatttttttataacgaatgaagaagactgcagctatcgaaccatgtttgaaaaatatctcttgaaaaacgatattcattactttccaacgatggagttgtggagcatcgaagcaataaaacaaacggtcatgagcggactcggattttctgttttgccttacattacggtgaaagacgaagtggaaagcggtaaactgaaaatccttcctcattctcaatacctcgacccgctttattcccagatgcttatcaaaaagaaaaagtggcagctgcctgctgtggatgcttttgcggatctggtattgcattcgtttcgtgaacctcgattaataggataaaatgaatagtgaaagattcacttgaattccttattttgcagattagatgtgctatgatacaaaaaaagggcgggaatacttttgcgcgaatttgcacctaaagtttttcaaacgacagggattattggttttattttagcttttgtccaaattccaatcggctggtttatcggatttttcttttccggtttgttcttcatgatgttgaaatcaaacaatgaaaaatcgggaaccttcaacatgatggctgggattgcgtgtttattgtattcattctattgtttgtttacgcaagtgttgtgattgatattataaagaaaaaaataaaaagcaggtggatgtcacatttataatcatgagttttaaatacggagcgtgatgaaatgaaagaaaacagccttttccattctgtaccccaaaatctatttgtcttttatctaattccatcgtgtgcatttggaaaccaaaatgggtgatttgtaattgcgaaagttgaaactgttgcttgccgctaatttgatttccaccgtaggtaccggcatcacttcctatttgattgtctggctgctgattgatcaattgaaacaatccgttttatatgggttattgacgatggcaacgatgattttagtgttttttgcctcaccctatttagggagtttggtggatcgatattctcgaaaagcgatattcctctatatggaaattacaggaatagtggtcttgggcgttttttctgttctatgcaatgtttccgccgtgttggacatcacccttgttgtgatgctgattttttatcatacagcttacgattcgataaagtatcctgctttagccgctttaacacaggaaatgttcaaaaaagaggactatagtaaagtgaacagcagtcttgaagttcaggggcaggcggcgctgatgattagttcggggctggctgccatgatgatcggcaagatggatgcggcagttattttggttatgaacatctctacatttatagcagcttccatcctcatctaccaacttccttatcaaagaaatgctgaagcggaagagcattccaatacaatgaaaaatgaatcttactggaaaaacttcagatcctcactccaatatttatgttatcgaaaagttttgtttgttcttttattgacttcttttataccaagcatcgtgattattgtcgcaaactacttggatccggttttcatttacgactatttaaacgaaggtccgtcagttatcggcattgccaatattgtttacgccattggagctatgggtgcgggctttgtcgcatatcaaatatcaaagaaatggtctgatatgcaaggtgttatattgtttatggcagtatttgctctagcaacaattgcgatcttcctcgttccgaatgccgtgacatttatagtggcaagcctcttttgggggcattcaaatgctgcgatcagagtatttagaaaaagctatatgttccatcatgtcgataatgcatatatgggacgtgtcaattcgttgtttaatgcggtaaagctgttgggacaagttgctttaataggcatcttgacgattacagtagtgccggcgggtcaaactgtttacggatacttcgttttattcatcattgtaattgctgctcttttaacaacaacttatttatttaacagaacttataacaaagataaagaaaagcgggtatctttatagagtagcttcccccgtagaggaggcataaaaaagcattgctgtttaaatacgatacttttttatgccaagggagcccccgcgatgatccctaggcttcattcaccgctaagaattgcaaccggacgcgcccagccggccgacgctttttcaacttttacgggaaaagccatgacataaaatccggtggaaggcaattgatccaggttggcgagcttttcaatttggcagtaaggaatggtgcttcctgaataatgaccttcccaaataatcgacgggtctttttcctgttcaaagcgcttggcggtcatgctgaatggagcgtcccagctccaagcgtcagttccgacaaggcgcacgccccgttccgttaaaaaaagcgttgcttcgcgccccatcccgcagccgctgtccaggtaatcgctttgcccgtatttggcaccggccgacgtattcacaagaacaatatccccgggcgcgagtttatgattgatgcggtgaagttcttgttcgatttcttcaggggttacgatatgcccgtctttcagatgtctgaaatccagcttaacgccggggccatgaaaccagtcaagcggaacttcgtcaatcgtcatcatccgcttgccgtcatcagtaacagaacggtaatggtatggagcgtctatatgcgttccggcatgcgttgacattttcactttttccagcgaccagccttctcccccgggaagatcttgcgaagagaggccgggaaagctctggaccatctgtttggctccttgcttatgatccgcatattcgatttcagggataaaccccggcgggtcagacggaatatcgcctcttagcgataccgacaaatctacaatttgattgattttcatctgttttcccctttctgcctaagcggctgaccattgaattgatgtgcggctgttgtctttttaattttacagcaagagccatacaaaaagcccgcagaactttctgcaggcgattcgcattttttctacacttgccgtgacttaggttttctcagcttgtaaatcgcgatcagcatgataaaccaaaccggcgtgacaaataaggaaacacgggtgtcctgcgccagtgcgagcacaatgaggataaacgcaagaaaaccgagaaccacataatttgaaaacgggtaaagcggcatcttgaatttgtttcttttcgctaaatccggtctagttctgcggtatttcaaatggcagatgacggttattccccaaataaagatgaagcatatcgtcgagatgcttgtaatgagcgtaaacacttgctcaggcatgatatagttcagcatgatgccaatcagaataacgaccgctgagaaaaacaatgcattgcccggcactttgcgggaggtcagtttggtcatagcgccgggcgcattatgttctttcgcgagcgagtatatcatccggcttgtgctgaagactgcgctgttgcttgccgaagccgccgatgtcagcaccacaaagttgatgatgcttgcagccgcaatgatgccgaccgctgcgaagacttggacgaacggactctcattaggattgatgacattccacggatagatgctcatgattacaaggagcgcaccgatataaaaaagcaaaacccgaacggggatattgttgatcgctttaggaatgaccttttcgggatctttcgtttcccccgctgtcagccccacaagttcgatgcctacaaacgcaaagacaaccatctggaatgaaaggagaaatccgtgcagtccattaggaaacatgccgccgtggctccaaaggttgtgaaaggcggcagtgcccgaatgggtagaaaatcctttgaagatcatgaaaagtccgatcgcgatcagcgccaatatcgcaatgactttgattaacgcgaaccagaactccaattctccaaaaagcttgacggtggccaggttcatgatcagcaaaatgatcagggcgatcaatccgggcagccattgcggtacatcaggcagccagtattgggtataaagcccgaccgcggttaaatcggccattgcgagcgaaatccagcaaaaccagtatgtccaccccgttataaatgccgccatgtcgcctaagtagtctcttacaaagtcgacaaacgaatggtattccaaattggataagagcagttctccaagagaacgcataatgaaaaaacaaatgattcccgtaatcagataagcaaataaaatcgacggtcctgcaaaatggattgatttccccgaaccaagaaacagccccgttccgatcgccccgccgatggcgatgagctgaatatgcctgtttttcaggcctctcgataatttttgttcgtgtatatcgttgtcagttacatcttctgtcactttatgtatgcctccattttttgtttttaagcctgatctcccgcatgttttaaaatctattataacattaaaatttgaagtaattgatcatatcggcttgtgggatagagttcatctgttatcgtcgataacacttcaagcagagacatcattcaaaagtatgccgcaaaagatgacagagttataccggtttcccaggaaaactcagatccgaacaaagggaagaaacagtacacggcttgtttttaatggttttgtcattgagaggtcctaaaacgccaagctgctgcgctcgtccgctttcgtgatacaatataagcacctgagagagcatgatgttttaggagggacaaaagctgaacaaaaataaatttaaacgcagtcaatcggttttttcggcaatgctgatcctaatcgcggtgtatgttctgtatacattgtttgaaaatttaattcttgatccgcaatcaacgtcctttctgagccataaatctcacctccgagactcctttcacctcccgatctggctaaaggtgatgtatgttcatgtcattgccgcttgtttggcgatggtttcgggagctgtcaacttctccagcggcttgttggccaaaagccgcaaaatccaccggcttaacggctttatttacgtcgtctcggtgatggtagttacgctatcatcaggctatatggcaccccattctacgggaggtagagccgtcagcatagcctttaacatggtgaacatgtattggccggcggccactgttatttccgtcatcaaagcacggcgaaatcagtttacaaagcatcggaattggatgattcgcagctatctattctgttttaccaatctgtttattcatttcatcacgtttgtgtgccgaagcggattcggtttgccatacgatatcagctacacgataggcgtttacggggcgattgcactgaacgtggcggcagctgagttcgtcattcattttacacgcagaaaagcggtggacattttgcatacagctggattcgataaggtatagataattcgctgtgccaagggtatttgagcccttggcattctgtttttttagctcttacaaacaagtacagggctataactgttgcggcaggaaccatttttctcttgatctcttatttttatgtaagtttaagctgggtttaaggtcagtcatgtaaactttgaaggataccgtatatggaggaatagaagcatggatgacagaattgaaacaaaagagccgatgccttcattaatcggcttgatcacgaacccggcattgcagtttgaaagaatgaaaaggcggccggcggttgctctgccgatgtttattgtattcgttttatcggttttatctgcttatctttatatttcaaaagattttcccgatacgtatacctactttggaatgatcatatttttatgggagtttttaaagacggggatctatttgtttgtatcagctttaatattatggctgatcgcgacaatagggggcggaaaaacaaactttgtgacgatgttttcgttggcgtcttttgtaggctttgccaaaatcattggcgacgtgataaacaatacagtttatcgttttgcgaatgtgccggaagggacttcgtttacatctttgcacgatgttttttcggccgtcgagccttataaaagcatattgggcgtgtttgatatctttatggtttgggcgcttgtgttagcggctgaaggtcttcagaaagcgggtggagcttcgaaacgggcttcatggatcgccgttgcagttttatttattctcaagtttttgttcgcttgtttttttggtttgtttgccgcattgtttgaggatattttttagaatttcgattcggattatttcaatatacaaaatcagtttctcgcgaggtttatatcggtgttttttttctctatccgctaaaagggagcaagggctacggagcaaacctttatatatggtttgctctttttttgtttctcatcattgatttgcgcaaaccggcattctggcgactcaatttccttcgcctccctttccggtatttttcagggtagaataaatgaagtgatgttttctttaaaaaaaacacgtctttccgcaaactatttttcgcactcccgcgtctatcctaatgtaacagccgtatatacgtatattcgaaaaaggagttctttattgcaatgaagaaacaagcagccagagcgtctcttgtcgcttgcataacagaccggaaagaagacttttaccggctggcatacagctatgtgaaaaatcaagaagacgccttagatattgtccaggaatcaatcaaaaaagcgctcgattccgtcgattccgttcgcaatccggatacgatcaaaagctggttttataaaattttggtgcggacggcaatcgattttttgcgcaaacagaaaaaactaaaggttatggatgatcaaacgatcgagtttttaagccagggcaaggaagatacctaccgggatacagatctccatgaggcgcttgatgagttgccgcaaccctaccataccattattgttctgcggtttttcgaggatctcaaactggaagagatagcggaaatcacaggcgaaaacttgaatacgatcaaaacgcgcctttacagaggattgaagcttatgcgcatccaattgacgaaggaggatctttcttaatggataagaaattggaacagctgagaaaagcatatcaaaacgtccccattccgaaggagctggatcaggttgtcgagactgcgcttcagcataaaccgaagaagaagagaaggatagtggtatggcccgcatcaacgctggtcgcggcggctgtactattggctgccgtcgtgaatatcaatcccggagcagcgcaggccatgtcgcagatacctgtcatcggcaaggtcgttaaagccatcacattcaccgagatcaaacagaaagatggagaatcgagcattgacgtgaaaacaccggctctttccggcttgaataaccgggagctcgaaaatggcatcaacgagaaatatgtaaaggaaagccatcagctttaccgggaattcatgaaggagacgtcccggaataaaaaagggcatctcagcatctacagcgattatgagacagtcacggatacgaaagatttgatttcgattcggcgaagcgtcgaaagaacggaagcgtccagctataccgaacggcgctatatcaccattgacaaaaagaatgaagtcctgctcaccttgaaaagcttgtttaaagacgaccggtatatcaccgccatcagcgaaaacattaaagagcaaatgaaacagcaaatgaaagatgatcctgataaaatatattggatcggtgacgaagaagtcgagccattcaaacgaatcaaggccgaccaaaatttttacattacagagaatcataaactggtgatttcgtttgatgattatgaagtcgctcccggctatatgggcgcggtggagtttgaaattccgactaaggcgatttcgaacctgctgatcggcgaccgctatatccgctagtgaaagaaatccatgattcgctgaaatcatggatttcttattttttacaactttgtaacaacatattctgcaggaaactcttatactagagagacggcattactcagggaagataaaaatgacgattttttgaaacaaaaaaccgtcctgacttcgtctataatatcggagccgtaaaaggcacgaaacatacagaagaatcgtacgtacatatcattggaggaataccatgcgagatcagacacaacaacaccgttacataccggggttagacggccttcgggcttttgccgttttggcggttatcgcttaccacctcaacatgagctgggccgacggaggcttcattggggttgatatcttttttgttttatcaggatatttgattacatcgattatcctgccggcgtatggaaatgacatttccctcacattccgcgatttttgggtgcgccggatacggcggctgcttccagcggcgacgctcatgattttcgcaaccgtcatatgggtcgctttgtttaacagagagctgatgcataccgtacggggagatgcgatctcctctcttttgtatgtcagcaattggtggtttatctttcacgacctgtcatattttgatagtttcggatcgccgtctcctttaaaaaacttgtggtcactggcgattgaagaacagttttattttatctggccgatcattttgctgttgggcatctacatatttaaaaagcgggagaggtttgcagcggcggttgtgctgtgtgcgctttgttcagccatatggatgagcatcctgtacgtcccgggcggcgatccgagccgtgtatattacgggacggatacacgcgctttcgagctgttgatcggatgcgcattagcccttgtgtggccgatgaaaaggctgtctgggaacaggctccccaacagcctcaagcatgcattgcacggaactgagcttgccgctttcgcgctgcttatgatgtgcatttattttgtcgatgaattcagcccgtttctctatcacggcggaatgcttataatcagcataatcgcagctattttgattgcatgcgtcagtcatccgagcagcttcctgggctttgccctttccgtgaagccgctgcgctggatcgggaaaaggtcgtacggcatttatctttggcactatcccgttatcgtgctgagcacgcctgttcaggagattggaaatccggtgtactggcatgttgcgatgaaggtcgccgttacatttattctggcggaactttcgtatcgctttattgagaagccgatccgaaaagacggttttaaaccgtttgtcagccgggtttttctggataagatcacggaatggaaaacggcttccgttccaagcaaaatatcaatcggcctgatgtttgccgcgctcctcgtttttgcagggggtctgtcgggattggccgacgaaaagaaacagccgcagcaggcctattcaaaatcttatgaggaaacaagcgcctcagcggatcagccggctgacaaaagtgaagaacggcaggacgataagaaagcacaaactgagagcggaaatgagagtaaaaccggaaacggggaggaatcgtcagatacgaaagatgagcagtctgcggaaaaagagccggatcgcatcgaaaaagaagtattggctgtcggggattcggtcatgctggacatcgcttcaagcctgcgccggaagattccgggaatcacaatcgacggacaggttggaaggcaagtgagggaagcgcttcaattgacatcaacctacgcctcctttaatcatccggacaaagccgtcgtcattgaattgggaacaaacggctattttacggacggccaattggacgctttgcttgatgctttctcaaaagcggatgtctatctcgtgaatacgcgcgtcccccgacaatgggagagcaaggtgaatgaatcgcttcggaagcatgcggacagccgtcaaaatgtgacattggtcgattggcacgctgaagcactgcaacatcccgaatatttcaccgccgacggcgtccacctgatgccgaaaggtgctgaagccttggcatcgcttatcgtcaaagcgatgaaataatctataaaaagaggctctcctttaaggaggcctttttttatggcaataaagtcaattgggtgcatttatttttcatgcaaccgcctttcactgttcaaaaaatatggtacaatatacaaatgttttgcagcctgtaacaatagaaacagagatgttaactaggttgatagaaaggttttgatgtttttatgcttcataatccagttggaaaagagaggttggcattggcttttctgctcggaatgcttgccatacttggacctcttaatatcgatatgtatttgccgagcttccctgaaatagcggatgacctgggagccggtgcgtcgcttgtgcagctcagcttaacggcttgcttgatcggccttaccatcggccagctcgtgattgggcctgtgagcgatgcgaagggaaggcgaaaacctttattaatttcgatttcgctgtttgcgctgtcttcactgttttgcgcgctgtcgcctaatatcgcgacattagtgcttgcccgttttttacagggatttaccgcttcggctggaattgtgctgtcgcgcgccattgtacgggacgtgtttacagggagagagctttctaaatttttctcgcttctaatggttatcaccgcggttgcgccgatggtcgcgccgatgacggggggagccatcctgcttttgccgttcgctacttggcatacgattttttatacgctggcattgatcggattgttactagtactcgttatctcgatgaaattgactgaaacattgccgcccgaaaaacggattccaagctcaatcggttcgtctctcaaaacgatggggagcttgttgaaggatcggtcttttatcggctatgcgctgactgtcggtttcattcacggaggcagctttgcctacgtatccggaacgccttttgtatatcaggatatctatggggtttctcctcaggtgttcagcgtgctgttcggcattaacggcctcgccattatttcgggaagctttatcatcgggcgattcgggggaatcattcatgagaggaagctcttgcggatcgcggtcattaccgctgtcatcgcgacatccgttctcctgacgatgacgattttgaaaggaccgcttgcagcgattgtcatttcaatctttatctacatgataaccatcggaatgacgttgacaagcacatttacgctggcgatggaaaaccaggggcaccgtgcgggcagtgcaagcgcaatgctgggcatgcttccgctgctgctcggttcgatcgtttcgcctctcgttggaatgaatgaaacaacggccgttccaatgggtgcgatcatgttcatcactgctgtgatcggctctttcgctttttttgctttaacgcgggaaaaccagggggagcggtaaaggtaaaggacggaatcacttgattccgtccttttgttgttatagaggcgcccgctggatggcggagtctgagacgtccgcggattcattgatagaaatgaccattgagacagcggtcccgctatcaggcgtactttcgatattcagttcacttccgcagaagtgtttcagcctgcggttgatatttttcataccgacactatgagtgaaatgagaagaaaagatatcttgttgtttctccggcggcatgccgattccgttgtcctctatcttgatataatagcggttttcgctttctttttttgccgtcagcttgatccagcctccgcctcttttcttgctgatgccatggtggacggcattctcgacaagaggctgaatcattaaaggcggaagggtaaagtcgatgtcttcctcaatatcgtaaatgacgtccagccgatcgccgaagcgcgttttttcaatggaaagatacgaattcacaatcgacagttcatgcttgaaagaactcatccctgatgtattttgaaagtcaaaactcattctcaagtagtttgtaaaatcagccgtcacttcgcgcgccttttcaatatccaaatgactgagcgcgataatggtatttaatacattgaaaagaaagtgcggcttgatctgcgattggaggaatgccatctccatatttgtcgcttgggctgccgtatctttcatcatgatcaggtttttaacgcgggctgcaaattcagtgtagttgtacggtttctgcaaaatgtcatttgccccagcgtgaaaagccttgtatttatcatggtcgatgatggctgccgtaatgatcagaaccggaagttccaccattgtgaacctttcgcggattttcatgcagacttcaaaccctgtcatatccggcatcatcaggtccaaaatcaccaagtcaagctttgaacgggagacgacttcgagagcctcatggccgctttttgctgcgatgacttgataaggaacgccttcaagcatatcggccaaaatttttaagctttcgatgttatcatcgacgatcaaaacagttgaagcatccattttctttgagtagtacggcgtgctgatagaaacatcgggcagatctctgacggcttgctgttgaggcatgttctccttcttcgcgtcaggaagagggtcattttttgcaacaggcagtgtgaaatgaaatgccgatcctttcccttcttccgattctacccagatctctccattttgaagctgaacgagctgtctgacgatgcttaaaccaagcccggctccgtcgtctttatggttttttgcttgttgaaaagcttcgaatatcaattgacgcacggcttttggtatgccgactcctgtatctgctactgtaattttgaccttctcttggtcgagcctttcggcggagagcgtaatctgcccctccggcgtatacttgatcgcgttatcaaccaggttggtcatgatttgccggaagcggttttcgtcggccaagacgagcggcagtccggatggaacacggtttacaatccggacatttttattttttgacaacagccgatagaagtccatttccgtgctgatcgccgaatgggcatcgacaggaacggcctgaatctgcagcatgccctgcttcattttttccaaatcgagaatgtcgttcaccagactggagagtctgtatcccatgcggatgaccagctgcagattttctttttcttcctctaacgtcctttttctcttccttgccaaaagggtctggcatatattaatcatgctgttcagcggcgttttaaattcatgtgatgttttggcgataaactcgtcttttaatcgattcattctgagcaatttcaaggacaggatttcgttctcgcggaatgcgcctgcgaattgctgcgccatcatcagtacagccgccagcaaagcgatgatcgacggcacggcatagagcgaattgaatgaaaagcctcttttgccgctgtaagcagaaactgtcgttaaaatgacgaatgcgctcatcgagatcgctgcaatcgtaagataaaggctgcctttcattttccgaacagcagaaatcgcaaacacatacgtaatataaatcaaagtcgtgacggcaagaacagagtgcaatatatatgcgagacggtctgtgtaaccccaggtaataaaatcaatcatcaaaaccagtacagaaaatgcagtcgcggcgattatccattttttcgaaacgatttctttgtaagcgaaatatagatagagaaaaaccgccatactgacaagcaccattgtggtcgccctcacgacgcttaaagctgagaatgagatagacggaaagagaagaaagatcattcgttctcttccgattaaaagcactatgaccgaaaaaagaagacacatcgtggaaaaaaagaataagtgcttatcctttcttcgatgcagaaaaaagccgagaaagtataaaccggtaataaagaatgctgtgatcatgctggtttcatttaaaaaagagattttgctttggtgtaaaatgtgctgctgcatcccaaaggcaatcggtttttctatcccccatgaaggtgtttttttgaagttcgaaaattgtacaatcaactcgttgtctccgcggcgaacctcgaaaaaactcgtataaggcctgttttgcgccgtgaaattcgctttgtttgaaggggttccgctctgcccgatcaatttgccgttgaaataaactcggtttgcgctgtttataaaagaggtgctgattccgaacatctcattgtcttgctttgaccggatcatcagtctgtatgtaccgtaatccacgttttttcctgaatcggtaagtttgacattgttaggcacatcggaataaatgggggcttttcctttgcctgcatgaatgtcctttggggagagaagctggtttcggtatagtgcccattctccggtgagcgcgatgttcccgtctttctgaaaatcccatgtttccagattgatgattccttgcttcgcttcagggtagttttgctcggacaattggttgttaatgaataagaaaataaaaaagaagccggcatagccgagaataatcgaaatgaaaacaaatagctttttcaacatgagcactcctcattccacctgctgcagtcttgtcgaatcttatgaatattgtactcttaaatgttaataaacgacaagattaagaaaatgaatccaactaaataggtccgtagacatgatataatcattatcataatttccagatgattcgatgaaaaatggggtgggtgtgtcgtgaaagcgttaattgtggatgacgaggaactggcattgcttcattttaaaaatatgcttgaacgaacaaattgctttcgattcattgaaatgtttcaagatccggctgatgttctggaatatccggatattcgggatatagacacggtgtttcttgacattgaaatgccggggataaacgggattgagctcgctgaagcgattcaatcgatgaatgaaaacattcaggttgtttttatcacggcttataacgattttgccataaaagcgtttgaattaaatgcggtggattatttgcttaaacccgtcgattacgtccggctcgtgaagacgattgaacggatcagggaaaacagcttgctaaaggcttcagcggtaaataccggaggggactatttcatccaatgttttgggaatttgcaattttacaaagcagagaagggcgtcaaaacatatatacctgttaagtggagaacatccaaggcccgtgaaatttacgcgtatttgcttcatcatcacggccatgtgatcagcaaagacgtgctgatcgacctgttctggcaggatcatgatgtctctaaagcaagcactcagctatattcagcgatttatcaaatcaggaaattaatcgataggcttcctttcggtcaatccatcgagaagactgacacaggatatgtcctccggatttccggtgtgaaagtggatgctgacgaatgggaaaagtcgctgaaagaggctcctcccatccatatggcgacgatcaacaggcacatggaattgctgcttgcatacgaaaaccattactttatggaacacggttatttgtgggccgaacccgaaaagacgcggcttgcccggatctggcttggaaaagcttatgaactggtcgattttcttattcatgaaaaagactaccgccgggggcttgatatatgtctgctggtcgagaaaatcgaaccgtgcgatcataaaatcatccaatacaagatgcagctgtttaataaaaccgggaatgtagaagaagcgatcaaggaatatgagcgctataaacttatgaaggacaaaatgaattaaaggtaaacgcgagaccggatcagccggtctttttttatgccattttcagcttacatttcgatgttcagaaattgtatagttccatcccatacaatgtagtttggttcggatgatgtcagctgacataaagcaaaattcatacccgcgacatcttgactaccgccgctaaacatacagcaacgattttaaaagcctgtcattctgcaaatagaaaaaaattttcaggagggaggccgtccatttccaggctcaatcgatccgtacacaaaaacattataaaaggggaggaatcacaatttgagatcgaaaaaatattcgttcagcctcagcaaaaaaagagggctgaaatcatttttggtcacttgcctggcattgtatttgatcttcagtcaagttgtcggctttacgctgacggcagtggctgccggcacatcaacaggcggcagcgtgttttttgattcagtgacaatcaaaaacagcgaagatcaaacggttgacggctcaaagggagacgaaccagcattaaagccgggagacaaagtgacactcacatacgagtggtcgttaaaaaacgatgaagaagccggcgccgaaaacagtttcactgtagaggtacctaaaagcttcgaattcgctcaggatgccgagggagaagtgaaatcggcagatcagcagatcatcggcagctatcaagtgaaagcggacagcaacatttttaccgtaactctaaaaagccctgccgagggctctgccggagcaaaaggggccattgcgctgtcagcaaagtttgccgcagatatgaaaagcgatacaaaaacggtcacagctctctttcaactcggagcaggcaagacacagcaagtgatcatacccgtgaatacaggctccgaatcggaaacggcgaaaaatgatcctccgtcatctgaggacgatcagtcagacgatcaatcaaaatcttcaggaggacaggaccaagaggaaacgaagaaaaaagctgccgacgctgagaacagcgattcaaaaccggcggcatcttccagactggcggcagccggaagccttgcgtccggtggcaatcaaatcacccaaaatattttaaccggcgtgacgctgacggatgagcacggaaagccttatgacaaaagcaatcgagccgacacgaattctccggcgaaaatctcaattacttgggacatcccgaatgagctcggaaagacgataaacgacggcgaccgctatgaatttgatctgcctgaagcttttatcatgtacaacgacattacgaatcagccattaagctcagacggcatcacgtacggctatttttcaattgatacaaaaggccacgttgtgatgacgtttaacggcgaagtgaaagaagattcgaatgtcaaagggacgttgtttgtcaacacccagttcaacgcacaaaaaataaaaggctcgacgactcaaaagattccttttccggtgaaatcagacactccggaagtaacggtttatttcaaaccaaaagtaagcaaaaccattgataaatcaggaactttcgataaaggcatcaaccccgggcaggtcacatggacagtcgacctcaacaaaaaattggatcaggtgaaaaatgccaagctgcagaactttccagaggggctgacctatcgttctgtcaaagtttatcagctggatgtcaacatagatggttcagtcagccggggagatgaagttctttcaggctacaccgtagacgcagatggaaatgtcacattcgacggtgagatagattcggcttaccgcctcatctatgtgacggacatcgatgactccgcaaaaccgaacgaaggcggaaacgctgcatttaggaacaaggcaacgttcggcggagacaatctggaaccggcttctgcagaggcctctgtcacggccaaatacgggaaaatgatcgaaaaatcgtcgacaggttataaaagcgattcacagacgttcagctggacgattttatataactatggagagaaaaaaatcgacgaatccaaagcgagcataacagactcgtttggttccgctgatttgcatcttgtttcagattccttaaaggtgattccgattactttcaatcagaacggcagtgagcaggctggaacgcctctaacggaaggcaaggattatacgctctctgataatggaagcgggtttgaaatcaaatttaaccaagatgttaccggagcttacaaaatcacgtatcaaaccgaggtcaacagcggagtaatcatcgataaatcaacaacctatacgaacactgcagtgaccggaacaggagaatcaaagaaagcttcaggtacagccgttcagcagaatttgataaaaggctactcaaacattgattacaagaagaaaacggtcgattggacgatcgcaatcaacaaaaacaactacacgatgaacaattggaagttggatgacaatttcgaaagcggcgggctcacgctcctcgacggatcattccgccttcaggatgtgacgaataacaaaacgcttgaagaaggcaaagactatacattgataataaaaccggatcatgaaggttttctcctggaactcatcggagattatgcgacaacgaacagccagcttaagatcacgtataccacgaatatgaatgccgacttttccaacgaaaatgtcaaaaacacggcagaatcaacgtggactgatcacagcagcactgaacgcaaaaataaggaagcgagcagttttacgccgaatcgccagacatcccacaacggcttcaaacacggcttatacaacgctgtttcaaaagaaatcacgtggaaaatcggcatcaactataatggagagccgtcaaaaaacccttatattaaagattctttagcagatgaccagcaatttgaaaaaggctcggttgtcgtcaagagctattcagttaataaagacggttccatcacagaaggagacatcctgcccgcctcccaatatgatgtggaagagccgtcggctgccaataaacaaactttgaccgtccatttgaaaacggacgattccgtcccgtatcttattgaatttaaaacatcgctaaaaggacaggtcattaagcacgatccttacaccaataaggccacgtaccataatgccggatattcagagcgtgagttgacggcatccgtttcggtcgcagacggaggaagcctcgttttcaaaggaggcaaacaaaacggaggttatgtcgattggagcatcaatgtcaacgcgagccagtcggtgttggaagatgtaaaagtcaccgatactccggataccaatcaaattttagctgaagattcttttaaagtttatcaggctaaatatgatgaaaaaggtgcagtcaaagacagcagcggaaatcttgtcccggatgatgttcagcttaagaaaggcgaggactatacactggatatcaagaccgacaatgcaaccggcgaacaatcatttgtcctgaaatttacaggcgattacaaaaaaatcgaccgcgcctatgttattcaatatcaatcattgatcaatattgccggcacgagcggccatgttaacaacaaagtgtcgatttcgggaacgaatgtccaggaacagacccaggaaaacaacagctcggtctttgttgccgtttcaagcggcggcggttcaggctcaggggaaagaggaagcctgacaatccttaaaacgggagaagacgggacgccgctttccggagcagattttcaattgcggacaaaagataatgagcagctcctgcggacaggaacgactgacgacaacggcaagctgacattcggcaatattcgctatggcacttacattttaaaagaaatcaaggcgcctgacggatatacgatcagcgacgcctatgcagacggggtctccgttgagattaacagcagctcttcaagtgccggagcgctttacaaagtcgtgaatgagaagaataaggtgacgcttatcaaacaagacgaacaaaagaatccgttggaaggagccgtgttcaagctggagaaaaaatccggcgatggcgcctttacgacaatacgtacaaatattaagagcgacaaaaacggaaaagttgagatcaacggtttgccgcccggcgattatcgtttgctggaaacgaaagcgcctgaaggttatctcttaaatacaaaagaactcggcttctccgtcaaaacgaatgataagaatcaagtacctgacgttgatttaggaacattgatcaactataaaggcagagcacatttaacgaaagaagatgcagaaggccgtcaattagagggggctgaattcaagctcattgatcatgaaggcaaaaccattcatgaaaagctcacctcagatcaagacgggaaaaccgcggtatctgaccttgcgcctggccgctatgcctttgttgaaaccaaagcgcccgagggctatgtgataaacagcaaggcaatcgagtttaccatatctgaatcggcaaaagaaaaaccggaatccgtggacgcaggcaaagccgtcaactataaaggttcggtttatttgacaaaagaggatgcggaaggccgtacgctgaagggcgctgagtttaagatcgttgatcatgaaggcaaaaccgttcatgaaaagctcacttccgatgaagacggaaaaatcgcagtttcaggcctggcgcctgggcgctatgctttcgtggaaacgaaggcgcccgagggctttatgttaaacaacgatcaaatagaattcaccatcccgggctcagctgaagggaaaccggagccggttgatgcaggcgccgctgttaattataaaggctcggttcatttaacaaaagaagatgcgaaaggccacaagcttgaaggagccgtttttaagatcgcagatcaaatcgggaataccgtacaggaggaactggtctcagatcgaaatggaactgttacggcttcaggcctggcgcctgggcgctatgctttcgtagaaacgaaagcgcctgatggatttgtattgaacagcgggaaaatcgagtttgtcatcccggattccgctaaaggaaaacctgaacatgtagatgcgggcacattcgttaactataaaggttctgtttacttggagaaaaaagatgaagacggcaatggattagaaggagccgtgtttaaaatcattgacagcgaaggcaaaacggtcaaagacgatttgatctctaaagaaggcggcaaaatcgaggctggcgatttggcgccgggaagctatcaatttgttgaaaaacatgcgcctgacggctacctgctgtcaacagatccgatcccattttccattaccgggaaacacgaaggtgagccgaaacaggttaaactgacggctctcaacaagaaaaacagcgttgtgctcacaaaagtcggccaggatgacaagagcgccggacttcagggagcgcagttcgatttgacagatgaaaccggcaaggtgctgaaaaccggtttggcaacagacgcagacggccggatcacagtgtacggtcttaagcccggtaactaccaatttgtcgaaacaaaagcgcctaagcattatcaattggataagacgccaatatcgttcacagtcaaaaatactgatacaaagcaaatcgaactgactgcagagaaccaattgacacctggcgatgtgaaactgacgaaagtggacagcaacaataaaaaggctgttttaaaaggagccgaattcaaactgctcgatgccgatggaaagccagttaaagccggaggcaacagcaaaaagctgccggcagtctggactacagaccaaaacgggcagttcacagcggagggattggcacctggacgctatcaatttgtcgaaacgaaggctcctgacggttacaagctggatgaaacaccgattccttttgaaattaaaaaaggacagacaaaaccggtcgaggtgatcgcgtccaatgaaaaactgaaaacgccggctgttgataaaggcgcaccggacccgaattcgggagaccctaaaacagataacaaaggcacaccggaccgaaattcgaaaggagatcctaaaacaaatgacaacggtcatttgaaagatacgcttccgaaaaccggtgacacagacagcatcattccgatcatgatcggcatcctgctgattctgtctggaggagccttcgctttcttcacaagaaagaaacaaagaaaggcgtaaacgaatcattgaagcacctgatcattgaaccggtcaggtgcttttttaaagaaaggactgtgaggcatgtataaaaaaatgatcgttgccgtgcttgtcatatcaggaatactcttcgtcttgtctcctttcattaaagaaagcatcatcatcaatctcaacaagaataaaaattttgatttgactgctgaacaggcggaacaaaacaatgcacaaaaggcttcatttgattttgaggcgattcagccgccttctattttggaaacaataaaagccagcctcgatcgtgaatcaaaagcggtcatcggccggatcaccataagcagcgtcaatctcaagcttccgatattgaagggcacaaccaatcaaaatcttctttacggagcgacaacaatgcgacccgatcagaaaatgggcgaaggcaactacccgctggcaggccatcatatgaagcgggagagcctcttattcggtccccttctcaacattgaaaaaggagataccgttaaaatcacagactttaaaaaagactatatatacgctgtgacgtcgaaacaattcatttctgaaatggacacagatgtgattcaagagacgaaaaaaaaggaaattacactgattacatgtgacaaagctgtgagaaccgaaggacgccttgctgtcaaaggaaagctgattcatgttgctgtacacagataattgaatgtccgctgcaggcaggcaaaaatactgagggattgccccttggtatttttttattgggactaaaattctatacatcacaaaaaaatgacaaaaagatcactatgaaatgacaagagtaaaaaagtaatgagaaataacaaaaaaagaaaatgaaacgatgcggattggatatttttctttcataccggggttggcggcgattttactcaatgaaaatagataagttttctgaaatttatattgactgaaagcgcttttaaaattatgataatatcagacctaacaaagatgtaccaaaaacataactataacctaacaatttatttaaacggaatagaaatgaaagcgattccaaaatattccgttgcgggtaattggttgcaaggaggcttcagcttccatcaaaataaaatttttaattttctgttaaggaggggttgcttggggcgaaactttcaaaagttagatatgaagcttttaggaaaaagaaatgagctactattaaggatgtttcgaaaacctttggaaataaatcaattttcatttaaacaaaggcgggggaaatcaatatgaatgaacagggaaatcagaaatcatttttgcgtactattattttagtctcgacgttcggcgggcttctattcgggtatgataccggagtaatcaacggagccttgccttatatgtctgaaggagatcagctgaacctgacagcatttacagaaggattggtcgcgagttcgcttctcctgggagccgcattgggagcggtgttcggcggaaggctatccgattatatcggacgccgcaagaacatcatttttctagctgtacttttctttttctcgacgcttggatgtacgcttgcgcctgatgtgacggttatggttatctcacggttcctgctcggagttgccgtaggaggagcatctgttacagtcccgacttacttggctgaaatgtctccttcagaaaaaaggggacgaatggttacccaaaatgaattaatgattgtctccggacagcttttggcatttaccttcaatgccatcctcggaaccacaatgggcgattcctcacatgtttggcgttacatgctggccattgccgcagtcccggctgtattcttgttctttggtatgctgagaatgcccgaaagtccgcgatggcttgtctctaaagggaaaaatgaagcggcgctgggtgttctgaaaagaatccgcaaggaaaaaagggcgcattcggaagttgctgaaatcgaagctgcagtcatgaaagaatcggaaatgaaaaaagcgaattataaggacctggctgttccttgggtgcgccgaatcgtatttcttggaatcggtatcgctgtcgttcagcagattaccggtgtaaactctattatgtattacggaacagaaattcttaaaaatgccgggtttgaaactaaagctgcactcatcggcaatattgcaaacggtgtcatttcagtattggcgacgttcgtggggatttggcttttaggaaaagtgggacgcagaccgatgctgttgaccggtttaataggaacgacatcagctttgctgcttatcggcatcttctcaaacgtccttcaaggttcagctgctcttccttatgtcgtacttacgctgactgtaaccttccttgcattccaacaaggcgccatttctcctgtaacatggctcatgctttctgaaatattcccgcttcgcgtacgcggcctcgggatgggcgtcaccgtgttttgtttgtggatcgccaatttctttgtcggattctcgtttccgatactgcttgaatcgattgggctgtcctcgacattctacatttttgtcggacttggacttctttccattgcattcgtgaaaaaattccttcctgaaacaaaaggcctcacgcttgaacagcttgagcataatttccgcaactataaatcggaaacagcacaaagcggtgcaagcgctaaaatcagcgggtgaccatttgaattgttgagggacatgcaggtcgagtctcaacggcagagcataagagcatatagatgaagcatttgaagtttgcaggcggaaattttcctatagcgaagatttctgcctgcatatttgtatgtatcggaggcgtcttagatatcctaaaagaagatcttgaataaaagcttcattaaatgaccgtgcaaaagtgctgtcgaggttaatggtttatagttcggttcagtatatattgtaatgaagttggggaacattcaataaaacatcacataagatgaaaaggcaagtaaagcgtcatttattatgaatggctgtaagcattattttttcaggggtataaaaaatgaaaaaagtgttgacggatcagttggatgcatgatatattattattcgtcgctgagacaacgaagttacagcttttaaatacagatattatattcatcatttaaagggtgtacaaaaatctttaaatgtgtataatggataaagtcgaaacaaaaaagacttcattcattcggcagaaaaacttcaaaaacttcttgactttaactgatattcatagtatatagttaagtcgcctgatgaagcgcccgtagctcaattggatagagcgtttgactacggatcaaaaggttaggggttcgactcctctcgggcgcgccatatattcgcgatgcgggtgtagtttagtggtaaaacctcagccttccaagctgatgtcgtgagttcgattctcatcacccgctccatttttagaatgatctttgaaaactaaacaagacaaaacgtacctgttaattcattaaataaatcgtacatgcgaatgtgcgtagtcaggggcctgcacgatgcaggtcatgcagatgttgtcacaggatgtgacgaacttaatctgcgctccattatttcatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgagccgcatggttcaattataaaaggtggctttcagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaaggatattatacggaatataagaccttgcggtcttatagacaggtgcgtttggatcttgtttagttttgaaggatcattccttcaaagcgtgttctttgaaaactagataacgaaagtagacattcacattcaattgtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccactgctcgtaatggagcagtatccatatctgaattcataggatatgagaaggcagacccggggaactgaaacatctaagtacccggagggaagagaaagcaaatgcgattccctgagtagcggcgagcgaaacgggaacagcccaaaccaagagggcttgcctcttggggttgtaggacactctgtacggagttgcaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagtttgaaaagacggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaaagacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttgcgaacagtggtaggagagcgttctaagggctgtgaagcgagaccggaaggactcgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggcaagcgcggtattggatatccgcgtccaagcagttaggctgggaaataggcaaatccgtttcccataaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgctgcccttatcgggcagggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattcctataaggaagtaagatccctgaaagatgatcaggttgataggtctgaggtggaagtgtggcgacacatggagctgacagatactaatcgatcgaggacttaacctaaatatttgtgaatcgtctgtccgttatctagttttgagagaacacctctcagaaagccaaaggcaaggaaactcggctaaaggccctcacatcctgtgaggaacgcccagtaccttcgtcctgaaggcatagtttggtggcgatagcgaagaggtcacacccgttcccatgccgaacacggaagttaagctcttcagcgccgatggtagttgggggcttccccctgtgagagtaggacgccgccaagctgtttatattatcgcggggtggagcagttcggtagctcgtcgggctcataacccgaaggtcgcaggttcaaatcctgcccccgcaaccaaatataatttgcatacaatcaaacaaaataaataaaaatatggtccggtagttcagttggttagaatgcctgcctgtcacgcaggaggtcgcgggttcgagtcccgtccggaccgccatgttgcacacaaacgaaatcttcgaggttttcgtttttttttatgtcttttttcaggtcaatgctgaaactcggtttctcttctgacgggatgtgaagctcgaatttctttattccttggataattggtgagaattcgataaactaatgatagtgttttgattggtttgcaacagcaaaggagcaaatgatcttatggacgaatttgaattaattcaaaggattacgccccgttcgctttctcatcgggaaatagaaatcggtattggagacgatgccgctgtttatcatacgaagaacaattatcaggagatcgttgcagtcgatacgatggtcgacggtattcattttttatcatcccattcatcgcctgccgatatcggatataaagcattggctgtgaatattagcgatattgccgcaatgggaggccgacccaagtactatcttgtgtcaatcgccgttccttccggttggggcgcgacggatattgaagccatgtatgaagaaatgaataaactggcgacactatatgaaatggatttaatcggcggggacaccgtatctgcaaacgggccgctcgttttgaccgtaacagcaatcggcgaaattgaaaagggcagatcttgtttaaggagccatgccgagcccggtgatgtcgtttttgtgacgggagaacttggctcatcagctgccggcctgtcttttatattgggccaaacatcggcgagagacgagacgcagtctcaatactttattgagcggcacaagaggcctgagccgagggtggaagcaggtttgatctgttcacgctatcaccatgtggcgcttaatgatatcagcgacgggcttgccagtgaattaaatgaaattgctgaagcgagccgtgtttccattgacatatataaagagttgattccggtccattcggatttacatatattgcacacaaaatgggaagagtgggtccttttcggcggcgaggattttgaactcgtcggtacgatttctaatgatcaatgggaacgttttagtcaggaatgctccgagcatgatgtgcgggttcatcaaatcggccgcgtcacaaaacaaggacaggcggaagtgttttatcatgacggacaggaccgcgttcttctcgaaaaaaaaggatataaccattttaaacaagacaggtgacaagtaaagtgaaaacgttagagtggaaaacgacagagcctgaagagacaaaaaacattgccaggctggcggcaaaatatgttcagcccggtgatgtcatcacattggagggcgatcttggagcaggcaaaacgacttttacgaaagggtttgccgaagggatcggcatcaagcgggttgtcagcagcccgacttttaccatcatcaaagaataccgtgacggctctcttccgctgtttcatatggatgtgtacaggatggaagacgagacggaagatctcggattagatgaatattttgagggagacggcgtctgccttgtggaatgggcgcatttgattgaagagcagcttccaaaagaacgccttgaggtggtcattaagcggcttggtgatgacaagcgaaagctgacctttacacctaaaggcaggcgctacgaaaatctttgcgaggagatcagcaaacatgacgatacttgcgattgatacatccaatttaacgctcggagtggcattaatcaaagacggaaaagtgatagccgagcatatatcccacttaaagaaaaaccattcggtcagagccatgccggcaatcgacgaactccttaaagagtgcggtttaaagcctagtgacctgacccaaattgcagttgccaaaggcccgggttcatatacaggcgtgcggatcggcgtgacgattgccaaaacgcttgcatggtcattaaatattccggttaaaaccgtttcaagccttgaagtgcttgcggcaaacggccgttttttccaaggcttgatttgtccgttgtttgatgctaggcgcggtcaggtttatacgggactgtaccagtatagggacggcaaactccatggattggaagaggaccagaacattctgcttgaagattggctaaaaaagctgaaagccatggatcagcaagtccttttcataggaagcgacaccgggattcacagggaaatgatcgaacggattctcgatgaacaagcggttattgcagaccctgccctgcagcttccaagaccttcagaattggctttaatcggagaacttaaagaggacgagccagtgcacagcattgttccaaactatattcgtctggccgaagccgaggccgtctggcttgaaaaacaaaagtaaacgggtgaagccatgaacacgcaaatggtcatacgcgatatgaatccaaaggatttggaccaggtttttgaaattgaaaaaagctctttttcttctccgtggaaaaaagaatcttttcatcatgagctttttcacaatatgtatgctcattatctcgttctcgaagttgaggagcaagtcgtcggctactgcgggatttggatcgtaatggatgacgcccagatcaccaatattgccgtttcacctgcataccggggccgccgcttcggtgaagctcttttgaaggcggccatgaagctttgccggatgaaaagggcggttcagctttctttagaggtgagggtatcgaatcatattgcacagagcttatacaaaaagctcggctttgagccgggaggaattcgcaaaaattattataccgataatggggaagatgcattattaatgtgggtgagactaaatgaatcataaaaaagatctgtatgtattaggaatcgaaacaagctgtgatgagactgccgctgcgattgtcaaaaacgggacggacatcatctcaaatgtcgtagcgtcgcaaatcgagagtcataaacggtttgggggcgtcgttcccgagatcgcatcaaggcatcacgtggaacagatcacgatcgtgcttgaggaagcctttgcacaagcggacatgacgtttgatgacattgatgccattgcagtaacggaaggaccggggcttgtaggcgctctattgatcggcgtgaatgctgcgaaagcgctcagttttgcccggggcataccgctcgtaggcgtgcatcatattgccggtcacatctatgccaacaggcttgttcaggacattcaatttccggcgattgcccttgtcgtctcaggcggccacaccgaactcgtatatatgaaagagcacggctcatttgaagtaatcggagagacgctcgacgatgctgcaggcgaagcctatgacaaagtggcgagaacgatggggcttccttatccgggtggacctcacattgacaaacttgcgcaaaaaggcgaggcaaatgtgccgctgccgcgcgcatggcttgaagaagggtcttatcatttcagcttcagcggattgaagtctgcagtcatcaacacgcttcacaacgcttcacaaaaaggcgaaacgatagctccggaagatttgtcagccagctttcaggaaagcgtcatagatgtcctcgtgacaaaaacggaacgcgctgcggaagcttatggcgtcaaacaggtgctgcttgccggaggagttgctgcaaacaaagggctgagagccgcgctcgaaaaaacgttcagcagccgtccggagatcgagcttttgatcccgccgctctcgctgtgtacggacaatgccgccatgattgccgccgcaggtacggttgcttttgaaaaaggaatcagaggaaaatatgatatgaatggtcagcctggcttagatctgacgtcttattgaaacctcacgctttgtgaggtttttttacccggaaaaagttattaacaagttatcaacacatatccacagtcttgtgtataatgttaaaaaccttaatttacagaccttttttacctgttagtaatgtgtataaatattatgttatttgtggatattgtgggtaaatcgctttctttcttttaaataaaggatttcaattgtggacaaaaaaaccgctccggcttggagcggctcatcctttattcatttgtagatagtgtttcccattctgataacagctgttcaagctcctcattcagctgttcattttcagagtggatttcctgaaccttctcgtggtcttggaagacgtcgggattgcataggagctcttcattcttttcaatttgttcttcaatggccgtaattcttgtttcgatgtcttcaatcctgcgctgccgctggcgttcttttcttttcagctctttttcttcttcatagctcttttttgcgcccggtttttcggaagcggctttctgacgctcttccgtctgtttttctagttctttcagttcaagctgctgcgcttttttttccgtgtaataatcgtagtcgcctaaatattcttcggctttgtcgcgagaaagctccagtacttttgtcgcaatccggttgataaaatagcggtcatgggacacaaataatatcgttcccgggtaatcgattaaagcgttctccaagacttccttgctgtccaggtcgagatggtttgtcggctcatcaagaataaggaagttcgctttttgcaacatcagcttggcgagggcaagcctggctttttcgccaccgcttaatgcatgtacaggctttaatacatcttctcccgagaacaagaagttgccgaggcaggtcctgatatccttttcattcatctccggataatcgtcccaaagctcgtcaagcacgcgttttgacgacgtcaattcagcctgttcctggtcgtagtatccgatcgatatgagacgacgagagcaccccgtcgactgttgctcacaacagctgctgcagctggttggatcaatgctttcaaaagggtcgacttgccgattccgttcggcccgactagtgcaacgctttccccgcgggtaatgcgaaaatccagtgaacggagaagcgggggctggtcctgatagcttaccgtcaggtcttccactcgcagtacatcgtttccgctttgccttgtaatttcaaagcggaatgacgccgacttttcatctccaagcggtttgtccatgatctccatccgttcaagctgctttcgtctgctctgcgcccgtttcgtcgtcgaagcccttgccaagttccgatcgacgaaatcctgcagcttggcgatttcgtcctgctgcttttcgtaaagctttgtttccctttccagctgctcggcttttaattggagataagagctgtagttcccgatatattttttgctttgggacctggtaatctcgtaaacttgggtaaccactttgtcaagaaagtacctgtcatgggaaacgattaaaatcgctccgctgtagctttgcaaatattgttcgagccatgtcagggtgtcgatatccaagtggtttgtcggttcgtccaaaatgaggaggtcgggttttgtcaaaagcatttttccgagggcaagtcttgttttttggcctccgcttaaatcctgaacgcggacggagtcgtcaaatcccgcaaagccgagcccgtgcatgacggatctgacctctgcctcatattggtagccgcctttgtccttgaactcctgctgaagcctgtcatatgtcttcattaatgattcaagcttgtccggtccggcttgcgccatcttttcctcgatcgcgcgcatttctttttccatttttttaagaaaatcaaataccgacagcaattcctctttaagcgtcagcttggaatcgaggccggaatgctggtcaaggtagcccatcgtcaaatctttaggtttgatgatgtcccccttttcgtatgagagctttcctgcgataatctttagaagagtcgattttccggcgccgttgcgtccgacgaccgcaatccggtcccgagacctgacttcgagttttatattcgttaaaatcgtatcggctccaaacgattttgaaagctgatttacttgtaaaatcatcatgatctttcacctcttgtctgctattttaagtgtagcctatcaccgcgcagtcagcaaacaattaagtgaagtctggaagattttagccaaagaaaaagacagattgaaaaaaatagtgtatgatcattataaggagagttaagaacatgaatgagtttacacattttaatgaacaaggcagagccaagatggttgatataagcgaaaaggaagcttcagtgcgcacagctgcggctgtttcaagcgtgtccatgaatcgagaagtacatgaaaaaatcaaaaaccgcgaaatcggaaaaggcgatgtgttggcggtggcgcaagtggccggaatcatggctgcaaaacagacatccgccatcatcccgatgtgtcatccgatcgctctgaaaggagtcgacatcgccttttgctgggagaagaaagagcagaagagcatcctgcatatacaatctaacgtcaagaccaaagggagcacaggtgtggaaatggaagcgttaacgtcggcctccgtatgtgcgctgaccgtttatgacatgtgcaaagcggcggataagggaatggtgataggaccgacctttcttctcgaaaagacaggcgggaaaaacggtgactataaaagggaaaaagctgatgtagacatggaggattagtttatgaacatggatcattcaaaaattccgcaagcgacagcgaaacggctgccattatattatcgttttttaaaaaaccttcatgcatccgggaaacagcgtgtatcttccgctgagctgagcgatgccgtcaaagtcgattccgcgaccatccgaagggatttctcgtacttcggcgcgctcgggaaaaaaggatacggctacaatgtcaattatttgctgtcctttttcagaaagacgcttgatcaggatgaaacgacgaacgtaacgcttattggcgtggggaatttggggacagcctttctccattacaattttatcaaaaacaataatacaaaaatcgccatggcgtttgacatcaatgaagaaaaaatcggaaccgaggtcggcggcgttcccgtctatgacctgaataagcttgaagagcatatgacggatgatgatatcccggtcgccattttgacggttccagctcaagccgcacagtcgattacagacaggctggtggcgcttggcattaaaggcattcttaatttcacgccggctcgcttgaatgtgccggaacacattcgcattcatcatatagatttggcagtggaacttcagtcgctggtgtattttctgaaacattattcaatgcaggaaaagtaaaacggaaaacgaaaaataaataaaggaaagggggcaggctttatgccaacaatcggtcctggaagctttattttaattgtcgtggtggcgcttttgatattcggcccgaaaaaacttcccgagctgggaagagcggcgggaaacacgctgcgggagtttaaaaatgcgacaaaaggtttggctgacgacgattccgataataaaaagaaagaagatcagtaggataggatgacatttatgaagggaaaagaaatgtcgctgttagaacatatcacagaactgcgcagacggcttgtgatcacttttttcttttttgttttgtttgtgcggcaggcttttttttggcgaagccgctcataatctacctgcagcagacggatgaagcgaagctgctgactctcaatgcgttcaagctgaccgatcctttatttgtgtacgtgcagttcgcgttcatcatcggcgctgtcttgacttcgccgcttgttctataccagctgtgggctttcatcagcccggggctgtatgaaaaagaacgaaaagtgacgctcagctatattccaatatcgatcattctttttttaggcggcattgccttttcttactttattttatttccgtttgtcgtggactttatgacgagagtctcagatgatctgaatgtcaaccaggtcatcggaatacacgaatattttcagtttctgcttcagttgacgcttccttttggcttgttgtttcagatgcctgtggtcatcatgtttatcacaaggctcggtctcgtgacgccgatgtttttggcgaaaatccgaaaatatgcatattttgtgttgttcgtcattgcggcgctcattacaccgcctgagttattgtcgcatttaatggtctccgtgccattgctcattctttatgaaatcagtatcgtgatttcaagaatatcctacaggcaggcgcaaaaaacaatgattcaagaggaaaatcaatcgtttttgaacgaccatacaaaataagagccattcttttttcagaatggctcttttctttcaaataaaaggctattgatcttttcgcttcatcctgccggccagggcgaacattttaaaggagatgctgatattataggctgcgaaaagcatcagcaggatcgtataaaaagaccacatgcttccgggcgaggttgccgcgagatacgtaaacagcacacccgttaataaataaatcactccccagaatttagggcttctcatcatagaaatcctccaataatcatttgcattttctcgacgtttttcaaatattcttcaataggctcccggaatgtctgcagcaagacgacgagcgtattcatggcgacatgggcgaaaatcgggacgataatccggttggtcctgacataaaaaaggcgaatgtgaatcccattgccgtataaatgagcagatggctgaaatccaaatggacgaccgagaagagcaccgaactgaacagagcggcaacgaaaaaattcgttttctcatagatcgcaccgaaaatgatctttctgaaaatgatttcttcaagaatcggaccgaatacagaagagacaaacaccatcagcggcaatgcggtgatgattttcataatccgctgcatattttcggattccgggttgaccccgaacaagttcatttcgatcgaagcggcaattgactgcgcaaacaaagcgagaaaaacgccggctaccgcccatccgattgacgctgcaaccgatgcttttggacgattccgaagcgtcgtcttcggcaccgtccgcaaaatcagcagcacgatgacgagacagagggtaaacgcgatgacagaccagacgcccgtcaatgtaagctgagcttcagccttgggctgtcctctgcccactcccaaaaagtagagaagaggcaagccgacaaccgccgacaattgcatgagaacgtatgccaatataataaaccagtattgttttctcaagctttatgtactccttttctaaaaatctaaatcagactatgtttattgtaacacactctttttaaattataggatgataaggatatgcggagaaatgtaggcgcaaaaaaatttgaccttttcacttgaaattgcctgggagattctttattataagaattgtgttagcactcaccgagtgcgagtgctaaaattacatatgaaaatattgaggaggttgtttcattgttaaagccattaggtgatcgcgttgtcattgagctcgttgagtctgaagaaaaaactgctagcggaatcgtacttcctgactccgcaaaagaaaaaccacaagagggtaaagtggttgcagccggttcaggccgtgtgttagagagcggagagcgcgttgcattagaagttaaaacaggcgaccgcatcatcttctcaaaatatgcaggtaccgaagtgaaatatgaaggtactgactacttaatcttgcgtgaaagcgacattttagctgttatcggctaagtcataaataaaaacgagacaattatataggaggttcgaataacatggcaaaagatattaagtttagcgaagaagcccgccgttcaatgctgcgcggtgtagatgcattggcggatgctgtaaaggtaactttgggacctaaaggacgcaacgtcgttcttgagaaaaaattcggttctccattaatcacaaacgacggtgtaaccatcgcgaaagaaatcgagcttgaagacgcgttcgaaaacatgggcgcaaagcttgttgctgaagttgcgagcaaaacaaacgatgttgccggtgacggtacaacaacagcgacagttctagctcaggcgatgattcgcgaaggtcttaaaaacgtaactgccggcgctaaccctgtaggcgtgcgcaaaggtatcgagcaggctgtggctgtagctgttgaaagcctgaaagaaatctctaaaccaattgaaggcaaagaatcaatcgcacaagttgcttcaatctccgctgcagacgaagaagtcggaagcctgatcgctgaagcaatggagcgcgtcggcaacgacggtgttatcacgatcgaagaatccaaaggattcacaacagagcttgaagtggttgaaggtatgcagttcgaccgcggatatgcgtctccttacatggtgacggattccgataagatggaagcggttcttgagaatccgtacatcttagtaacagacaaaaaaatcacaaacattcaagaaatcctgccggtgcttgagcaagtcgtgcaacaaggcaaaccgttgcttctgattgctgaagacgttgaaggtgaagctcttgcaacattggttgtcaacaagcttcgcggaacattcaacgcagtggctgttaaagcgcctggattcggcgaccgccgcaaagcgatgctcgaagacatctctatcctgacaggcgccgaagtgatcacagaagatttaggtcttgaccttaaatcaactcaaatcaatcaattgggacgcgcttctaaagttgttgttacaaaagaaaacacaacaattgttgaaggtgcgggagatacagagcaaatcgcggcacgcgtcaaccaaatccgcgctcaagttgaagaaacaacttctgagttcgataaagaaaaattacaagaacgccttgctaagcttgcaggcggcgtagctgtcatcaaagtcggagctgcgactgaaacagaattgaaagaacgcaagcttcgcatcgaagacgccctgaactctactcgcgctgcggtagaagaaggaatcgtatccggcggtggtacagctcttgtcaatgtttacaataaagtagctgcccttgaagctgaaggcgacgaactgactggtatcaacatcgttcttcgcgctcttgaagaaccaatccgtcaaatcgcgcacaacgcgggtcttgaaggatctgtcatcgttgagcgcctgaaaaatgaagaaatcggcgtcggctacaacgctgcaacaggcgaatgggtgaacatgatcgacaaaggtatcgttgaccctacaaaagtaacacgctcagctctgcaaaacgcagcatctgtagcggctatgttcctgacaactgaagcagttgttgccgacaaaccggaagaaaacaaaggcggcgcaggaatgcctgacatgggcggcatgggcggcatgggcggcatgatgtaagcccagcgtccaaacgctgatatatcaaggaaaagaggctctttttagagcctctttttttaaaaaatcacataaaaatcacattttttcggttttaaaacttgtgataccttgtaggaaacatttcattttattaaatgtttctttcttcatcttgtttgttatgtgagtataaatttcaattgtggctctcatatcagtatggccaactctcttcataatctcccccagagtgtttcattatttgacctaactcatggcagaagtctttccagtgctgctccttgtttttaagagactatcgaaaaaaaccacattacttaaacaaaacttaaagatcccacacttgttaggcatgtacctaatttgaatgtctatctatcagcaataactttcatatcgacttgggaaggttctgctatgtttatttatatatatatgtattgaacttcttcttctaattttgaaaggtagtacattaaaatccccctgtataatgaaaactgatgctctctttttggtgatttgaaaacccgattaaacgggtttaaaagtttattttttcaaaacttgaagcgttattgaagtaacgaaaaggagcaggcataatgcctgctcctctatcttgaaactaacgagattcatttgaggatttaaggtaactgatgaacaatggtgaaatgacaattactgttacaattaataatagtctgctagatattaaatttacaaatgtagtgttaataatatatagggctaaaaccattaaataaaaagccacgtaaacataagcatacacttttttgctgaatggttctttcatgtaaatgaaaagaaataaccctgccattaaaactaagaaagtcatattttccctctttcatttttattgtggaaaaaccccagttggaacagctgcatatccgagtccagtaaaacgtattctaacaccatgaccttcatgttcgtcttgaatcatttgaccaaaaccaactagtccgcctccgattactccggaaattacgcttgctaattgtgtaggaggtacgggtataacccttgatattaaagcaagaccagaggttgctccaccgcctgctttaaatggttcttgtttcattacagtcaaaataaagattatatccccaccagtagagatcatgaccagatcgaccgcagccttttttcgctactttcattttatgattgtttccattctccagtgtcaatacactaccgtctttgtctaaaattttcacactaaaatcggagttaatgacagcttctttttgtttcactaaatcgttcaagtatttaatccagtcttgaacttcgttggtgacagaacgtgaaatatctagtttagtataagatggatctaaggtaagagttccatctgcgtttaatttaagataagcttctaatttctttacatcattcatactcacctttacattcttaaattcttcgctgttcagtttttgatcgggtgcagaatttcctttatatgctccagtagtttcagtatgtagtttttcgttgtcagttagttctgacgctgatactatattgaaaatacaggtgaaaccaatattaatgtcagtaccataacaaatgtcttaaaaccattgtgcttcttttctttcacgataatgccacccttcttattatagatcaacctcattttacttgaaaaacaaggtaatttgcggcatgatgtgtataacagtaaaaaagaaccatctaaaatcttgtgcgtaatgaaattatactaggtgtgattaattagaatatggagggctaatttaagaaggaaaaaaacgattaagatgaaggatgttatgatgtaactatgttgatctttggattataggtcttactttatttctctaaaaacagcatcctcaaatttaatgaaattggtgtctccttccacaatatgaaaaaccttacggatatgatttatgtaatgaatttttccttctatgttaatagtctctcctgattctgctctatttaaaaagggcagcggtttaaatacagagaacagaactgttaaattaaattccattgcttcacatattatcttatccatgtcttctatttgaaccatgtcaagaaccggccttttaaccttgttccgattgctttctaattcgcggagcaggctgaggtgttccgacagcatcatagctgttcatttgattgatccccgatctttcaagttgtcatctttcatggtgtttatctccttgagtttcaatcgtgaattaatggaaacagtgttttagctattttggttacaaaatcggtcacggtttcggaatttgaaggtgtatgcggcatgatgtaagcccagcgtcaaaaacggctgatatatcaaggaaaagagcatctttttatttaacttgcgatgacatataaatacccttttatccatggaataatttccttttgggggattatggtataattagcatctgaatttttaacagaaaggttaaacaattgatgtcgcacaacaaactaatgtttttgctttatcattttcatctattattcacctgcttggtacaatagtggaccctgcggctagctggaagccttggctggtgaacattgcattcattttattggttcttctatttttaaatctcactataaaagaaaatcaacagaacaagtagcggcatgcccttctcaaagagaagggcatatattttatattatgaacatcggtaagagtagccttaataaacgtcactctaattctgcatctgaatatcggagcttgctattgcccgtaatctctttcaacggccagtgcgtcagcaaatggcattaaaaccgcaagacctaaatttgattctttgtgaaaaatgggggattttaaaaagatggtcaaaaaaattgtaaatggattcaattcattttcactactggggacaatcttttttatcggcagttattttacgtacaaatttaatggcgtggagctggtcgggttcctgtacttaggtattatttttttgacagctctgatcgcaaccaccgtaatgttaatcaggctaaaaagaaaaggaatcaataaagataaacaggcttaatgcatgctttatacttattttagcttctctccgctagtgtaaccttttccaatccataatatagatctcttaaaagcatcacatgtccagtacatcaaatgtaatctcctgttcatactaatatcgggaggtacatcgacttatgttgaaaatttggatgactggacttttactattagcgcagcccgcggggcattctgacagcttaacgatcactcagcaagggaagaaagtggccgttgtgaaccgcgaagattttacaatgccgcttcccggaacaccgatgattgatgataaaaaatacaacgaattcgttgacaggcttgaacggaaagtacacaaggatcctgtcaacgccgtgatcaacgatcagggaaggatcgttcccggcaaggttggctacagcctttcccggaaggggtttaaggagcagttttacgcgtatttttatggggatggcccgtccacaatagaagtgcctgaattgaatgtttacccgaaagttgacagcgaactgctttcccatatccggacacagcggatcggccagtatgtgacgtactttaattccgggaataaaagcaggacgcacaatatttctctcgcggcaaaggcaatcgacaatcatgttgtttttcctaatgagacgttttcatttaacaaagttgtcggaatgaggacgccggacaagggatatatgaaggctcccgtgattgtgagaggcgaattgtctgaaggagtgggcggaggcatttgccaggtttcgtcgacattgtttaatgctgttgaccgggcaggactcgaaatcgtccagcgctattcccacagccggcgtgtcccttatgttccgccggggcgcgacgcgacggtcagctggggcggacctgatttgcgctttcaaaacaaatataaccagccggtcttgatccgggcgaaacggcacgggggaacgatggttgtgacgctttattcttctgatgtggtcaatcatcagctgcgaaaagtcccgaaggctccggcccaaattccaaaagaagagcatcaaagcggggatcactaaaggcgaatgttcatctggcgctgcacttgttcacacaatgtacaataaaatccttttgcctgtatgatagaatgaatcaaggacatctttaaatttcagacaagaggagatgatcgagtgacatggctttttgtaacctttttggtgatcttcagtctttttaaaatattggtcacttgccttccgagcggtgtcgtagagtggctgaccggcaaatttcaagttcatgtgaagcttgaggaatcgaatgttcaagtgacattcggcggaaaacgtttagagggatctgacaagagtcgatttattcaaaactttaatgaagcggtatttatggagcggtactacatatacccgggagatgagccgctgtatgtcaatccgaaaaacgccgggacaccgtttgtgatcgaaacaactaaaggaaaaaacgctgtgaagctgtttgtatacagatacgatgatcatatagacgtcgttaaacaatataagaaaaagacggccgcttattgtctgcgttctgacagtctgcaaacatgcggggggatgaaaacggcggatttgatttaaaaagcaggaaaaacctgcttttttattatgatatgaaatagagcctgacagcgccgtaaccgatcaaaaataaccaggcagcgattctttctttttgacgtgctgtacggctgtccatttcaccatcgcctttcttcattttattagcaataaaatccttgtattgcatattattctaaattaaaatgaggttgataaaaagtcttgcacagggagaaacgccatgaccatacatattcaacagcttgaagcccctctgaatcgtgagtttgttgatgaactgatcaatttgtggaatgataatacgttggaaacggctgattgtgcattagatgatcaagatagagaaatgatacaccagcagctggaacaatatgttcaatccgcatacggagcggtttttgccgtcgtgaatgagaagcaagaagcggtcggatacgggctggcctctattaagaaagatttggtcagcgattgtctgagcgggcaaatcgatgaagtgtacatagccccggactatcgaagaaataagctggggaagcttgttgcagaccgtatgatggattggtttgaacaacatcaagtctctcacgttcaagtatcggtcgatatcgataatcaatcggcgctgcatttttgggaaggcatcggcttcagcagtgatttttatcttctgacaaattagttttttgaatcaagtgggagcggccttcgttgtcatgcccggccgcctagctaaaaagccccttttaaggggcttttttgatgagctcaggagaattatgatgcggtgaattgacgagaggcgcgacttcatacgcttccatctcttttgacgcatatggttttaaaaggctttctaagtatgcaaggttttgattcttcggattcagccattctttttcagcctggcgatcaagaatgacgggcatgcggtcatgaatgtctttcattaaatcgttgggcgttgtcgtaatgattgtgcatgtatagacgggcttgccgcctgcaggctgccacttctcccaaagcccagcaaatgaaaacagtcgatttgttttgagcttgatcctcatcggccgctttgtctttgcatcggtccgcttccactcataaaaactgtctgccggaatgaggcacctttgtctgatcagcggctttcgaaagctcggcttctccgccaaagtctcagcgcgcgcattgatcattttataaccgattttctcatcctttgaccacggcggaatcaatccccaccgcagccgccctagccggttatgcgaaccgtcgttgatgacggcgagaatatactgggaaggcgcgatgttataactggggctgtaatcttcaatcgccatttgatcaatctcgaaacggtcaataatctcatcaaattcagaaaacagcgtaaacctgccgcacatcttaggtcacctttttttgtttattgaaagtttgaggcttttatatataaatggccaacaaggccgctgaaacagccatgataaagcagtcatcgcccgtcatggccacgccgtttttgatgaatacactgcaggtccagttgagtgccgatccttccgcggtccggtcaatcagttttttacccgctgtgtaaacacatgctttaaataaagaaaacgaaatggaacataaaataaagagcaaaataaactttaccatcaacaccagcattgccttttcaccccggcatattttgtaagctccaccttcattttaccaataaattcatctgttaaaacctctttcttgttttattatattgaccgaatggtcagcaatcgttacaatttatactaaccgattggtcaataacgaaaaggaatgatggtcaatgcctttacagctttatgaaaaagagcaaatactcgatgcctgtttggaggtttttgcccggcatggctatgcaaagacttcgaccggaatgctggcggaagcggccggcatttcaaaggcgctgatttttcatcattttaaaagcaaaaaagatctgtacttaactgtgctcgattattgtattgagaaggtaaagtcgcgcctttcccttgatgacctggcgtcttatgatgatttctttgaagcgaaagaaaaaataagcatggctaagcttgagtttttcgcggattattcaaatgtatacaagctcacgaaagatgccttttattcaccgccttccgaattaaaaaaagaaatcgctgcaaagtatggggagcaatttgccgttagaaatcgtattctaaaacagctttttgcgaaagttccgttgagggaaggagtggatcgtgaagaggcgttcgaacttatcatggtcatgatggggcattttgaacaaaagtttctagcggaagtaacggctgaggacgattttgatccagcctggagcagacgtcttcttgaagaacgaaaacggtttttggatatgattcgtttcggcattgaaggcgaataaaaagggggattcctgatgggacactatgtattgggctttcatgagatcgatcgaaccgatttgccgcttatcggaggaaaagggctgaacttgggcgaattgtcaaaaatggacggcatccaagtgcctcccggtttttgtataacaacaaaagcatatgaaaagatgatcggtgaaaacgataaggtcagtgaacagattgatcagctgtctcttttaaaagtgaaggacagaaaacagattaacgatcttgcccttcagatccgcaatggtattgaaagggccgaaatcgccgaagagatcaaagaagcggttaaaagcgctcactcaaatgctggcggcgatgcatatgcggtccgatcaagcgctacggcagaagatttgcctcatgcctctttcgccgggcagcaagatacgtatttaaatataaaaggaatagaggcgatcttgaagcatatcagcaaatgctgggcttcactgtttacagagcgggccgtgatctaccggattcaaaacggttttgaccaccgcaaagttcaattatcggtcgtcgtccagcagatggtgttcccggatgcgtccggcattttgtttacggcagatcctattacatccaaccggaaggtcacctcgattgatgcaagctttgctttgggagaggcgcttgtatctggtacagtttcagcagacaactacaaggttcgtgaaggcgcgatcattcaaaaaacgatttccgagaaaaagacggcagtctattctttggaaagcggcggcactgaggcgcgcgaagtcgaagcgggctgccggaaagagcaaacattaacagatgaacagatcatccggcttgaaaaactgggaaggagaatcgaagcccatttcggttttccgcaggatattgaatggtgtctggctgatggcgaatttttctttgtccagagccggcctataacgacattgtttcctcttccgaaacagagcgatgacaagcttcgcgtctatatgtctgtcgggcatcagcaaatgatgacagaaccgatcaatccgcttggaatatcgtttttcgggttgatctcggattatgagctgacttgtgccggcggaaggctttttattgatttatcacacgatttggcatcttttgcagggcggaaagtcgtcctcagtacggcggggaaaaatgatcctttcatgcatagcgctcttgtgaattttttgaaaagaaaggagcttgtcaaaaccctgccgaaagggaagcggatgtttagattaggggctgaagggctgtcatggtcgctgccgggtgatgcgctgaagatttaccggaaaaacgacacagatgtagtcaaacggctcatgtcgaaagcggaagcatccattcaagaggctgaacagcgattgaaaaacgcatcgggtgaaacgttatttgcacagatagaagaggatcaaaaaagcttgaaaaaagttctctatgattcagagagcatggctgtaattatggttggtttatatgccgtttactggctcaatcgaaaaatggagaaatggcttggcgaaaaaaatgtcgccgataccctttctcaatcggtattgtacaatgtcacatctgaaatgggattggcgcttttggatgtatcagatgctgccagaggataccccgaggttcagaagtatttagcatatgccaataatgaaaccttttttgaagatctcaaacagcttgacggcggtcccgcctttatcggcgcattgcgggcattccttgagaagtacggcatgcgctgcaccggtgagatcgatataaccaagacccgctggagcgaacgtccttccattcttgctccaatcattttgagcaacatcaagaattttgagcccggcgcgcgaacggctaagtttgaacaggggcgattggaagcggagaaaaaggagagggatttgttaagccgtctgcaacaactaaagggaggcagacaaaaggcaaaaaggacaaagaagatgatcagcgtgctgcggaattttatcggctatcgggaatatcccaaatacgctctgatcaaacgctatttcatatataaggaagcgttgatgaaagaagccgctgttttacagcaaaagaagctgatacaagcgaaggaggatatttattatttgtcctttgatgaattgaaagaagccgtgtgcacaaaccgtctcgatgtgaagaagatcgaggaaagaaaagcggaatatcggcattatgaaaaattgacgcctccgcgaatcatgacttcagaaggcgaggtcatcaccggagaagccttgggggatcacattccggcaggagcgttggcgggcgttcctgtttcatcggggatcatcgaaggaagggcaagagtgattctgaaattggaggaagccgatatcgaagagggggatatccttgtcacgccttttacagatccgagctggacaccgttatttgtctcaatcaaaggtttggtgactgaagtgggcggcctcatgacacacggcgctgttattgcgcgggaatacgggcttccggcggtggtgggggttgagcatgcgacgaaagaaattaaagacggacagaagatcaggattaacggatcggaaggatatgttgaaatactcgaatgataaaaagcgcagctagaagcttgcgctttaatttttataaaggtcggcggacaacatccaatccatcaattgctgatacggataataggtcgtgccatttaattcaattttaggtatgtcaggatatttacgcagcatttctttcgtttctactttgctcaagcctaaataataatgtaaatcgtcttctttgattaaatagggatagcctgaataaattccctttgggtttttaaagtttttcaagccgtcaccgataaaatagcctaaagccgctaaaccaagtccgatccaaaacaggttcatctccacgtttaccatccttttctcatattgctttatctgtcatacgaaaaggattgaaaaaagtttcaaggtcaaaggctttgccggttcagcatctcataaagaacgacggcatggttatggcgctcatctttggccccgtaaagcagaataacggtttcgtccgccgccattttttttaattccctgaagcttttctgtttttcagcgttttgtttaatttcgttttgataggcttctttaaacgattcgaattttttcggatcatgaccgaaccattttcttaattcggggcttggagcgatttctttcatccagcagtcggggttcgctttttcttttgatatgccgcgcggccacacacgatcgattaaaatgcggcgtccttctgtttgctggttttcttgataaatgcgctggagaataaacggcatgcggatcactccttctcattttatgataaaacggcaggctggaaggaacaaccctattgaaaaagacaatgccaacattccgtttattcgatggaatgttttaaagaactgtacaattggctgacgctttcatcgatttcatctcttgacatccgcaaggctttttccgatacggcatagccgatttccaaccggccttcttccagccctttaaagatcgcatcggcaaattcatccaaaggagctccggaatcatgcagtccgacaccgcccagatccgtattgaccgcaggaggagcgacttctatgacctcaacgccggcctcggaaagctggtgtcttaaactcatcgtaaaggagtggagagcggcttttgtcgatgagtagattggtgcgaccgccatcggtgtaaacgccagccctgatgacacattgatgatcgcagttttcccggctttttcggcaaagtatcggctaaagagcatggccagatggataggcgcctccatattgacggtgatttctttattgtagtcagcccaattgtctataacatcggcttttaaaatgtggtagcgctgctgtatgcccgcattattcacaagtacgtttactcccggatgatgttctttgatccattcaaataatgccagtcgttccgtttcaacggccacatcgcatacacacgtgatcagctccggatgtttttcctttgcttctttaagcttgctttcccttctcccgcagacgataacggtatttcccgcttttataaatcgttcggcaaaagcaaagccgattcccgatgcgccgcctgtgatcagcactgtgtttcccgacagttccattggaatccctcttttccgtcaaattttaaacaataggttgagcatctcttctgaccctataatgcccctttattttccaaaatgcaagtattctgattagacggtatgttccgattccattatcattgaaaagtgaaaggggtggaataaaatgtatgatacaactgtcgaaacacgcttcggaaagctgaaaggcagagcggaaaacggagtccgtatctttaaaggcgttccatacgcaaaacctcccgtcggcgacctaaggtttcgggaaccgcagcgaatggaggcctgggaaggtgagctggatgcttttcaatttggcccggtttgtccgcagcctgatggggtattgcctgagtcagcgggggttcaaaagtctgaggattgcctttatttaaatgtgtacgcacccgaagaggcggacggggatctgcctgttatggtgtggattcatgggggcgctttttatcgcggcgccggaagtgaaccgctctatgacgggactcagcttgcaaagcagggaaaggtgatcgtggtcaccatcaattatcgcctcggtccgttcggttttttgcatctatcctcaattgatgattcctacagcagcaatcttggcctgctggatcaaatcgcggctctcgagtgggtgaaagacaatatcgctttctttggcggagaccgtcatcacattacggtttttggagagtcggcgggatcgatgagcatcgcttcgcttttggcgatgccgaaagcaaaggggctttttcaacaggccattatggaaagcggggcttccgcaactatgtccgataagcttgcgaaagctgcagcagaaagattcttaaggattctcgatattgatcatcatcatctggagcgccttcatgatgtatctgatcaagaacttcttgaagccgccgatcagctgcgcactttaatgggagaaaatatttttgaattgatttttctgcctgcgcttgacgaaaaaaccttgccgctgaagccggaggtcgccgtcgcaaaaggcgcggcaaaagagatcaatctattaatcggaacaaaccgtgatgaaggcgtcttgttttttccctctgattcggatcttttgcctgagagcaagatcaacgagattttagaagaatacatgggtaaagaggccgccgaagccgcctcctctctgtatccgaggtcattggaaggccatgttgatatgatgacagatctgatcttttggcatccgtctgttgtgttcgcttcggctcaatcacgatatgcatctgtctttatgtaccggtttgactggcatgcggattcagagcagccgccgttcaacaaagctgcgcacggcttagagattccgtttgtatttggaaatatggacattttggaacagctgacaggtacgaaggccggtgaagaagcgcagctgcttgctgaacagatccaggctgcctgggtgtcttttgcccgatccggaaatccgagcaccgatgatgtcagctggcctgattatgatgaagattcacggaaaacgctgatttttgatcaagaggtcgcagttgaaagcgatccttattcagataagagaaagatgttgacagccccgaacccgcagatttagaacaagcgggcctgacctgtgtggtcagccgctttgatgatagcgttcgctttgaatggcttcaagcgatttgccgcgcgtttccggcgccatacggagcccgatgatcatatgaatgacgagaaatgcaatcatgacggcgccggctgttttgaagcccaagcccgtaatcatcgccggaacgaccaatgagatgagtccgacgccgatgcggacgatgaagaacatgaagccttgagcgagcgccctgtatttcgtatgaaacagctctgccgcccacagtccgtaaaacgcctgcgctccaaaacccgcagaaatgccccacaggcatacgaataataaaagctccgtgatgttcatcgtgccgaaggtgaggatgacccatgcggcggttgccatagctgctcctatgccaaaaagcaacttccgattgactttatcgccgagacggataaagacgaagtatgtggacgccacagtcaaaatccataaaaatgcctgcagcaggttggcttgtgccgctgttaggccgccgaccgtctcatagatatacggcatgaaatatcccatcgtcccggcaacaaggttccaaaacgcataaattccgatgaggagaatcatcgcgcgaaggttcgctttgttggtcaacagctctttgatcgacgccttttcttcaactccttttgctttgtcttcggcttcttttcgcttttgctcctcccagatggacgattcgtgaatctgctgctgcaaaatccaggtgatgactgcgacgacgaataattgggcaaaaatcaaccggcttcccattaaaccgagcggcgccaaggcaactgataacagcagcgtaagcgccggtccgaccgaccatgccagctgcccccagccgacgcgtccggcccgttcatggtcaggggcctcctcggcaatgtaagtccaagcagccggaattgctgcgcccaccgcaattcccgtcacgatgtatccggttaaaagcatgggaaaattaaacgacgcggcgatcagtaaaacgccaagcatatagactaatagatcgtatttatatatgaattttctcccgtaacggtcgactaaaaaaccgccgagaaaagcgccgatcgccgcgccgaaaccatttgcgcttaaggcgccgagaagtccgacccgggcgtcgtccaatcctaaatattcaacccataacgaaagcccgccggcccccgcgacgatggatcccgcctccaaatagttggacatggcgaccgtaatcgtcgacttcaaactgcctttttttctccctggcatgattcgttcccctttcaaatcagaattcttttctgacagaagccggattgatgcgttgaatgctcgattttaccctagcgagtcatgcaaaattgtaagcgttatcatctcgtggtaatcccgaccttgcatccgttccagccttcaggctgttccgaatgttttgcttatagtattactttattcggaaaacaaaaataaatcaacataaaaatcagaatattccgtctgaatatttttgtttttgtttggatttttttctcgaaaaactgccattatatcaattttttattaaaaaaccgaaacttttcctctggaaaatagtatatttaaactaagtatattttactataaggaggaatttcttagatgagtatattaagcaggttcaaagacattatggccagcaatattaacgctttgctggataaagcggagaacacggaaaaaatggtggatcagtatgtcaggaacttaaacagcgacttaaacaaagtaaaggcggaaacggcgtccgtcatggcggccgagcaaagggcaaaaagagaactggcggattgccgggcggaaatcgacaagcttgagcgctatgcaatgaaggctttggaagccggcagcgaggcggatgcccgaacatttttagaaaagaaagcggtgcttgaaacgaaggcatccgagttagaaactgcgtttcaaacggcgtcatccaatgcgaatcaaatgaaaaaaatgcacgataagctcgtttccgatatcggggagcttgaagcacgccgcgccgcgatcaaagcgaaatggacagcggcgaaaacacaggaaagaatgaataaactcggtgcatctgcagcgaatgccaaccattcaatgtccgctttcggcagaatggaagaaaaggcaaaccgggcgcttgatgaagcgaatgcgatggctgaattgaacgccgctcctcaagatgacatagaagacctgaaggctaaatatgacagcccttctaatgtggatgatgcgcttgccgcattgaaagcgaaaatggcgggtcaaaagtcatagcatttgaaatgaataaagtgagaggttaagagacatggtaatttcttataaatgtccgggctgcggggatgacatggcctttgacgctgaatcgggcacgctcgcctgccgcagctgcgggagacaggacaagattgaaaacattccggaagaattgaaaactgcgagatttactgaagatgaagcaacagaatatcattgccaaaactgcggcgctattttgatcactgagaaagaaacgacggctacatcctgcagcttttgcggaggagcggcagtgatcgccgaccgcctgtccggaagccttgctccggcaaaggtcattccttttacgatcagcaaagaggaggcggcggacgcgtttcgcaagtggtgcagaaaagggctgctcacaccaaagggctttatgtcggctgaccggattaaaagcattacaggcatgtacgtccctttctggatgtacgatttaaacagcaaagtgcaggtcagcgcccgctgcacaaaggtacataggtatatacagggcgactatatctacacggagaccgaacattatgatgcgtttcgcgatatcaatctcgactacatcaaagtcccggtggatgcctcagaaaagatgaacgatcaattgatggacaaattggagccatatccatatgatcagctgaaagattttaaaacggcctatttggcaggctacatcgctgaaaaatataattacgatgatgaagagctttttccgcgggcgaaaagcaaaatcagcggctacatcgagtcatatatcgattccaccctgtccgggtacagctcagtcgatgtgaaaacgaaacacgtcgatacacaaaaagtgaaaagcttgtatgtgcttttgcccgtctggatggtcaattacaactacaaacaaaaggattacatctttgccatgaacggacaaacgggaaaagtcgtcggcaagccgccgatcagctcatttaaagaaaaaatgtggttcagcgggctggccgtctccatatttgcactctggaaaatcattgctgctgtaatgggaggcggggcgtgatgagaagtttattgagaagcgcgatgatcttatgtatgattttccttgtcttcatccctatagcctccggtgcggcagcctctgaacagaagcggtttgtttatgatgaagccgggcttctgaccaaacaggaaatcgagaagctggaaacgctggcagccaaattgggcgccgaacgggagaccgactttatcattgtgacgaccaatgatacaaacggccgcgatgtaaagaaatatgcggaggacttctatgacgaaaaagcgcccggctaccagaagaagcacggaaatgcagccgtattaacggtagatatggagcatagagaagtctatcttgccggctttaaaaaggctgaagaatatttgaatgacgccaggctggacaaaattagagaaaaaatcacgccggatatatccgacaagcattatgaggccgcattcgaaatgtttatgaaggcggcgcatgatgatatggagaagaaaccgtgggcggacagcatcttttttaagacgtggtttcaattgcttgtttcggcagtcatcgcgggaattgccgtcgccattatgaaatacaattcaggcggcaaagtgacagtaagtgcaagcacttatatgaacggtgatacgtccggagtgatcagaaataatgacgaatacatcagaacgaccgtcacaaaacagagaaaaccgtccaataataaaagctcaggcggcggaacgacgagcggaggccattcgcacagcggcagccggggaagcttttagaaagggaaaggaagagcttaaatggtgttttttagaaatcaatttgcaaatgtagtagagtgggatgaatttcgcgatgatatgattttctataaatggaacaaccgcgaaatcaaaaaggggagccggctgatcattcgccccggtcaggatgccgtctttttaaacaacggaaaaattgaaggcattttccaggatgagggcgactatgatattgaatccgaaattattccttttttatccactttaaaaggttttaaatttggctttaacagcgggatgcgcgccgaagtcctgtttgtcaacacgaaggaatttaccgtcaagtgggggacgaagaatgccatcaatatcccggctgcaggacttccgggcggcatgccgatcagggcgaacggaagatttaactttaaggtgaatgattatgtcgcattaatcgataaaattgccggtgtgaaagatcagtatgttgtggaagatatcaaaatacggatcacatccattctcgatcagcttctgatgaagtggatcacaaaagaaggaaaagatatgttcaaccttcaagccaacgcctttgatatcgcaaagggaatcaaggaagatcttgatatggagattgtcggcgacggcatgacgataacaggctttaacatcatgagtttcaattatccgaaagaagtccaggacatgatcacgaaaaacgcttcccacggcatggtcggcgatctgaacagatatcagcagatttcaatgacagacggcatggcttcaggaaagatgacaggcggcggtgccgcatctgacatggccggcatgatgatggggatgaacgtggcgaaccaaatgatgaatcagatgaaccaaaatcagcaggcgcaaacacagacgccaccaagcgcgccgcagccagcggcaaaaccgaacttctgtccaaactgcggaacgaaaacgggcgaagccaatttctgtccgaactgcggtcagaagctagtgtaagcggggggatcggttgatgccggcaaagttggtatcttctatgtgaatgagggctttcgctgccggcacgatcgccggcataccaagccggaaactgatggaacagaagctgatcctgatacacaagtcggattaattgcgtgatcagagcgcccgccgtattctatatataacaatgatgtcggatgaaaagaatgcggcatacatcaatcaaggatgtacagaataatcaaaggaaacaatctggaggaaaagcgacatggaattaggcatcagcacctttgtagaaacgacccctgatatcaaaaccggaaaagtcatcagccatgcggagcggctgcgcgaagtagtggaggagatcgtccttgccgatcaggtgggcttggatgtattcggagttggagagcatcatcgtcaagattacgcagcttcttctcctgccgtcgtcctggccgcagcagcttcacagacgaagcgcatcagattaacgagcgcggtcaccgtgctgtcgtcggctgatcccgtccgtgtttttcaggattttgcgacgctcgacgggatttcaaacggcagggcggaaatcatggcgggcagggggtctttcatcgaatcctttccgctgtttggatatgatttagacgattatgatgagctctttgaagaaaagcttgatttgctgctcgaactgcaaaagtcggaaagggtcacatggagcggcaagcatcgcccggctattcacaatacaggcgtttacccgcgtcccgtgcagaagccgctgcctgtatggatcggaagcggcggaaaccaggaatccgtcgttcgcgccggcctgctcggcctgccgctggttctcgcgatcatcggcgggagtccgcagcactttgccccgcttgttgagctttattacaaagcagcggaacatgcagggcatgacgcctcaaagctgattgtcgcttcccattcccacggctttatcgcggaggataccgagacggccgccgatcgttttttcccttccacccagcaggccatgaatacgctcgcaagagagcggggctgggggccgtacagccggtcgagcttcgatgcagccagaagctttgaaggggcgctctatgtaggcgatcctgagacggtggcggaaaaaattattcatctgcgcaagaatgtcgggatcacccgatttttgcttcacgttccggtcggttcgatgccgcacgaagatgtcatgaaggcgattgaactttttggaacaaaaacggcgccgctcgtcagggaagaagtatcccgctgggaggcatccgaaaggtcataacatgaaaggcccgcgctttagcgcaggcctttttatttcatataatgctttttaaaatccggatgtatcgaaaatttgcggcgcaaatggatcaggttttcgccgaaactttcctccaatacctctctgtgcttctccatgatttccatcaggtacaaatcatgaatcatcacttcggtaatcggcatcaccaagcctacatgcatcgtccaggctgcgcggctgtctttcccatgcgagacaatgccggccacaacttctgaatcgtcgacgctgaatacgagccagcgtccgtcatactcttctgtaatttgcctgctgttgtcatgtagatagacattggcgaaatccgcttcaatgtcgccgtatgcaataatggtcacaatgacgcctttttttgcggcccgcttgagctcaggctccaattcaggaaaatcctctttccaaatttccaggagaatcctttttccggccgatgatatgcacgcctttactttatcgagaatctcgcttcgcccggtgatgttccaaatattttcccggtcatttgcagtgcgctcaaacttctcgaaatatttttctgcctgttcaaaagtctcttccgctttcatccgccggtttttaatcaggtccttggcgggaacgggaatgtactgcggtgtgttgccgtagctgacaaatatatcgccgcggattacaaggctctccagcacttcgtatattttcgaccggggaacacccgatttttttgccaccgcatagcctgtcagcggcgattcttccaagagcgccaagtatgctttcgattcatactcggtgaaattcaggtttttcagtacgtctaatatgttttccttcataagccctccagcttcaacaagagtcgctacctttgtcactcatattttgctggatgtattgatttatttcaagtccgctgatacactttttataagtggttacttgagtagtcactatataaaaacagtatggggggagacatctgatggatagcctgctgtcatacatatcgattgcagccatgatggtggtgatacccggagccgatacgatgcttgtggtgaaaacacgcttcgatacggtccgaacgccgggcgctgcaatgttctcggcttggcgacggggctttctttctggacgctgattgccgttctcggcttagcggtggtgattgcgaaatcggtgattctgttcaatacgatcaaatacttgggggcggcctatttaatatatttaggcattaaaagctttttcgcgaaaaaaatgttttctttggaagagatacaagccgagaagaacaaaaacgaaaacgcatcaagccggcattataaggattcttttatgcaaggattgttcagcaacattctgaatccgaaaactgttttggtctatatcacgattatgcctcaatttattaacttaagagaaagcgtcaaccagcagttgatcatcctcgctttaatccttacttttcttgctgtgttttggttcctcatcctcgtatatttgatcgatttcgcaaagaaatggctgagaagcgtgaaattccagaagatctttcaaaaagctgcgggtctggtgcttgtcggatttggcgttaaaacgggtttagattgatattggagaacgagtgagcgctttggctcactttttttgtttatttgtcaacgattatttgatagaaaacactagatgaaataagagtgctatggttattcgttgacattttgacaacgattctatatatttataccgacttggtctttgggctgatagattgatacatttttagcgtgggaggagaaaagctcgtggatgaacaaaagaaaaatcagctgggagtgctgctgaaagagcagttgcgaaaacgatcattatctttaagagaattgagcgaacgcactcaaatcgataaagcgaccatctcaagaatcatcaatggcaaaagaaaagcaaacctgaaccatttgcaaaggttttcagaaagcttcggcgtttcttttgatgagctgatgacagcggccggctatgcgatggagaagacgcaggaaagcgaacgtccggatattcactcgtcagttgccgaaattgaagatgttttgcaaacctcaaatgtctatgatcggccatttaccatggaagaactgaaaaacaaattgaatgagtgcgaacaatattctcagacggaggaaggaaagcgtaccattctggctgagtttgaatctaaaatcgagaaagttgccggcattggtccttttctgacccgtctgcacgacatgtacagcagatttacctcggggcgggggacgccgcgtgaattgctgctgatgggcggcgctttgctgtatttcatcgtttctgttgatgtcataccggattatatttttccgatcggctatatcgatgatgcggcagcggttcatttcgttttcaaccagctgtcatataaatcatgatggagcatgttcaagatgaaaagaaagcatatcaacattgacatcagtctgctgctcattctattttgtttgtttatcatcagcctgctggccgtttacagcgggtcgggccagtatgaaacacaggaccctttttattttgccaaacggcaggtcttttggtatcttgtcgggtttggcgtcatggcgggaacggcctacatcgactatgagctgcttgaacgattggcgcttcgtttatttgtgggagccgtttttcttctgattctcgttcatttttttggaacttacaaaaacggttcgcaaaggtggatcagcttcggggtcatcgaaatccagccttcagaatttatgaagatcattttgattcttctgctggcttcgatactcaatcaatttcagcataaaaggttctccttcgccgagagcatcattccgacgggaaaaatcatgatgtacacggtgattccgtttttctttatattggttcagccagatttagggtccgcattggtgattttatcgatcgcattcacgttgatgctggtctcggggatttcgggcaggatgatcgtgtccctgtcacttggattcatggcattggttgcctttttgacgtatttgcacaatcattactttgagatattttcaaagattattaagcctcaccagcttgaccggatatatggctggctcagtcctcatgaacatgcctctacatatggataccagctgacgcaggcgttattggggatcggatcaggccagctgtcagggagcggctttactcaaggaatccaagttcagggagggaaaattccggaggctcatactgattttattttcgccgtgattggtgaggaattcggttttttgggtgccgtaacattagtctgtctgtattttctgatgatctacagaatcatcaggattgcgctttcgtccaacagtctgttcggtctttatatatgtgcgggggttgcagggttgattgtattccaagtgttccaaaatatcgggatgacgatcgggttaatgccgatcacggggctcgctcttccgtttatcagctatggcggcagcgcgctgttgaccaacatgatcgctttaggtctcgttttcagtgtgaatatcagatctaaacattacatgtttgggaatgattggggatgaagttgctcaaaatgattctttcccatctaaagaaacttgattatgtattgattgccgcggttctgtttttatctgcgtttggcttgctgatggtatacagcgccggctaccccctcggatatatgaagtatcatgatggcagctatttttttatgaagcagctgcaatggctgctcatcggtttggcctttttttcggctgccgccattttcccatacaaagcttacagcaaactcattcggtttttggtgaagctttcttttttaatgctgattctcgttttgctgccgggaatcgggatggagaaaaacaattcccaaaggtggattcaattcggttcgctcatgattcagccgtctgaggctgtgaagcttgtgatggttatttatttcgcctatgtgtatgcaaaaaagcagaaatacatcgccgatttcggaaagggcgtcatgccgccgctgctgattttggcggctgtgttttttttgattttaaaacagcctgacttgggcaccgccgtttccatcctgttaagctgcggagcggttctgttgtgcgccggcctcagaatgcggcacttgctgcttctcggaacaatggcaggggctggcatcgcatattttgcaataacagcgccgtaccggttaaaaaggctgacatcgttcagcgatccttttcaaaatgaaaacggagacggctaccagttgatcaattcctaccttgccattgattcgggcgggttatgggggaatggattggggaacagcgttcaaaagctgggatttcttcccgaagcccatacggactttatcatggcggtcatcactgaagaactcggcggtatcgggctggcggtgatcatctgggcttacctgttgatcatgttcagaggggttcggatcgctgtgcaaatcgatgatccgtttggaaagctgctggcggtcggccttactttccagatcatgattcaagcgttatttaacctgggcgctgttttcggccttcttcccattaccggaattcctcttccgtttgtcagctacggaggttcttcgttattgttcatgctgacgacagccgggatattggtcaacctctcatcacatgttaagcggggagttaaaaaagatgtggcctttcttttgtagagagtcttttcttaactttgaagtggagaattttatctcaaagttacgattgttgatcttgtcttctcatatagaatttgaccgggacgtgtttatacatataaatgcgttcatattgataaataaaggaaatcatgatatattcaaggtgtatgaaacagaataatctctttatatgaatgcataaactaaaaaagaccggaagatgcggcaacatctcccggaagcaacagagaggctccataaaaaggagtcggctctatttttagatcccaattaaaaagtaagatcgtcttggtgtgggaatcaagggcgatcttacttttttttgtcgtttgatgacagaatggccactacgagaatgccgaaagacaccatgagttgcaaggcctctgatactgtcacatgctcaccccctttctcttcaagagatggaggatgagccgaccgcccttatatagaaccgaactgctgccaacccttattataccaaaaagcagagttgtttccataaatgtccgttgacatgcaaatttgaaaaaccgcagttttcttaaaacgttctgcggtcaaactgagtaaatgctgttttttcttagccggaaccctgctcattcctttagcagctgatctagtgcaaaacaggccggttcattaaaacccggcctgtttgaaatatattgttcatttatgcgggacgcgcggcaaaaatttggaaggcaacgccgaacggatcagtgacaatgccgtatgcgggactgaaataagtttccttcagctcaagcttgacctcgccccgctcgctcagcttgccgaaaagccgcttggccgaagaaacatcggctgccgttacgcaaatggacaattggtttccgctttggaaaggcagttcaggaataatgtcggcgatcatcaggacagcgtcgccgattgtcaaaacggcatgtgcgatgaaatccaattcgtcttccttaaagttcgctgcctcatctgcggggccttcaccaatcgtctgactgaactttacttcggcatcgagtacatcacggtaataatcaatcgcttcctttgctcttccattcatcaggatataaggtgtgaatcgcgttttcatagggggaacatctcctttttttgttgatctaaggagattgtatattataatggtgacaactaatgtcgtggttaaaaaataattggaggtattcatgtctaaagcgaaacgattgaatgaaatgatcatgatggtaaaccggaaaaaacgatttacggtcggggagctggcgcgggaattcggggtttcaaagagaacggttttaagggatttgcaagagctcagcgaaatgggggtgcccctctattctgaaaccggcccccacggaggatatcaggtgttaaatgaaaggattcttcctcccatcgccttcagcgagaacgaagcgatctcaatcttctttgcgatcgatgcactgaagcattatatatccctgccgtttgatgcccagtacgcatccatcaaaaagaaattttatttaaacctttcaggagatatccgggatgcgattgacagtatgaaggaccgcgttgctttttatacgccttatgagcaaacagacgacattccggttttaaaggtgctgcttgaggcagcggttcagcaaaaggtgttgatcatcgagtatgaagcaaatggcgcatcaagcaagaggagcattcagccgatcggaatctatgccaatcaagggaagtggtattgcccggcttactgttttttaagaaaggattaccgcatattcaggtgcgaccggatcaagcgggccgagcttgatgaacataaggcaccgattgatttgtccggcctcaatttaaagaaccgtttttcggctttgtcccggccaagggagacattggaattatccgccgagctgacaaaaaagggagtagagcggcacggttcactcaaatggccgcaccttgaactgcatgtaagagaagatgggtccggcgtgctgaaaggcgaaatcgcgccgaaggatatcgatttttttgcggattatttcatttcgttcggccgggaagcggttattcagaagccttccaaattaattgaaaggatgaaacggacattatccgacatgctgaaacaatacggctgaaatgaagactccggtataccgcagcctgcgtttttctgcatttaaagttccgcaaaaaacgcgtgaagacgcatgtcttcttcatcctccagttaaagacactctcaggaatcgagagtgtcttatttttgccgtcagaagaaatttttacccaaaaaagttgacggcagatttaaaagtgagtatcattacaaatatgatattaatattacatttttgttacaaaagaaaatgatatgttacgagttaaaagaagattgacaaaggagcatgcttatgaaaaaagcgatggctattttaggattccttgtactcacagcatcgctgctatttatcatcaataaaggaacatctcaaataaacgcttcacaaaatagaaaagccgcggttcacacggagtattacaaagacatcagttcgctttcttttccggtattcagcgatttgaaggaagaggatgccaagctggccaacgatgcggtaaaacttcatttaaaaaattcctataaagaatttcaaaaaatcgttaatgatgccgaaaagaaggataaggatgaagaaaacgtttatgaaacgtcctacaaagtcaaatacaacgaggaaggcaaactgagctttttaatctatgactatcagttctccggcggtgcgcacggcatgtacaccgtaacatcctacaactttgactttgacaagcataaacaagtcgtgctgactgacgtattaaacaatcaggcgaaaatcgaaaaggcaaaaaactatattttcagctatatcaacgaacatccggaacagttttattctgatcttaaaaagagcgatatccgtttggatgaacatacggcattctattatacaagcagcggaatttcaattgtatttcagcagtatgatatcgccccgtatgcagccggaaaccaggaaataaagcttccgtcgacgcttttatattagccccggcattagatctaatatttgtaatagaaacagagagagcaagtcatgaaacaggagagtgagcagcgatgtctggcaaaccatcatttcgatgggttaaaatgttgatttttttaacgatattaataggtttggcagggtactcttacaataaagtgtcaagcaacagccaagagccccctcagccaaaaaaagaccgcggacaatccggcctcggcgtcgaatccatggtcaatgacagcaaacaagagaggtatgccatccattatccggtgtttcacataaaagaaatcgatgaacaaataaaagattatgtgaatcaagaattggccggttttaaagaggataacgcaaaggcccaggctcaggatgaagacgggccttttgaactgaacattaaatataaggttgtctattatacaaaggatacggccagtgttgtgctgaatcaatacatagaggccggcggcgtatcgggtacaacatctgtcaagacgtttaacgctgatttaaagcagaaaaagctgctgtcccttcaagatctgtttgaagagaattcagattttctgaacaggatttcaagcattgcctatcaggaattgaaaaatcggaatccgtctgctgacatggctttattaaaagaagggacgagccctcaggaagaacatttcagccgcttcgcgcttcttgaaaacgaggtggaattttattttgagaaaaaacaaaccggtcttgaacagtctgtaaaaataaaaaaagaatgggtaaaagatattttaaaagaccgatatcaggatatgaaaaagaatcgtcttcaggccaaacctgatcaggagcctgttccgcttccgaagcaagcgaaaattaatcccgatgaaaaagtgattgccctcacatttgatgacggtccgaatcccgctacaacgaataaaatattaaacgctttacagaagcatgaagggcatgcgaccttctttgtgcttggaagcagagcgcaatattatcccgaaacgataaaacggatgctgaaggaaggaaacgaagtcggcaaccattcctgggaccatccgttattgacaaggctgtcaaatgaaaaagcgtatcaggagattaacgacacgcaagaaatgatcgaaaaaatcagcggacacctgcctgtacacttgcgtcctccatacggcgggatcaatgattccgtccgctcgctttccaatctgaaggtttcattgtgggatgttgatccggaagattggaagtacaaaaataagcaaaagattgtcaatcatgtcatgagccatgcgggagacggaaaaatcgtcttaatgcacgatatttatgcaacgtccgcagatgctgctgaagagattattaaaaagctgaaagcaaaaggctatcaattggtaactgtatctcagcttgaagaagtgaagaagcagagaggctattgaataaatgagtagaaagcgccatatcggcgcttttcttttggaagaaaatatagggaaaatggtatttgttaaaaattctgaatatttatacaatatcatatgtttcacattgaaaggggaggagaatcatgaaacaacaaaaacggctttacgcccgattgctgccgctgttatttgcgctcatcttcttgctgcctcattctgcagcagcggcggcaaatcttaaagggacgctgatgcagtattttgaatggtacatgcccaatgacggccaacattggaagcgcttgcaaaacgactcggcatatttggctgaacacggtattactgccgtctggattcccccggcatataagggaacgagccaagcggatgtgggctacggtgcttacgacctttatgatttaggggagtttcatcaaaaagggacggttcggacaaagtacggcacaaaaggagagctgcaatctgcgatcaaaagtcttcattcccgcgacattaacgtttacggggatgtggtcatcaaccacaaaggcggcgctgatgcgaccgaagatgtaaccgcggttgaagtcgatcccgctgaccgcaaccgcgtaatttcaggagaacaccgaattaaagcctggacacattttcattttccggggcgcggcagcacatacagcgattttaaatggcattggtaccattttgacggaaccgattgggacgagtcccgaaagctgaaccgcatctataagtttcaaggaaaggcttgggattgggaagtttccaatgaaaacggcaactatgattatttgatgtatgccgacatcgattatgaccatcctgatgtcgcagcagaaattaagagatggggcacttggtatgccaatgaactgcaattggacggtttccgtcttgatgctgtcaaacacattaaattttcttttttgcgggattgggttaatcatgtcagggaaaaaacggggaaggaaatgtttacggtagctgaatattggcagaatgacttgggcgcgctggaaaactatttgaacaaaacaaattttaatcattcagtgtttgacgtgccgcttcattatcagttccatgctgcatcgacacagggaggcggctatgatatgaggaaattgctgaacggtacggtcgtttccaagcatccgttgaaagcggttacatttgtcgataaccatgatacacagccggggcaatcgcttgagtcgactgtccaaacatggtttaagccgcttgcttacgcttttattctcacaagggaatctggataccctcaggttttctacggggatatgtacgggacgaaaggagactcccagcgcgaaattcctgccttgaaacacaaaattgaaccgatcttaaaagcgagaaaacagtatgcgtacggagcacagcatgattatttcgaccaccatgacattgtcggctggacaagggaaggcgacagctcggttgcaaattcaggtttggcggcattaataacagacggacccggtggggcaaagcgaatgtatgtcggccggcaaaacgccggtgagacatggcatgacattaccggaaaccgttcggagccggttgtcatcaattcggaaggctggggagagtttcacgtaaacggcgggtcggtttcaatttatgttcaaagatagaagagcagagaggacggatttcctgaaggaaatccgtttttttattttgcccgtcttataaatttctttgattacattttataattaattttaacaaagtgtcatcagccctcaggaaggacttgctgacagtttgaatcgcataggtaaggcggggatgaaatggcaacgttatctgatgtagcaaagaaagcaaatgtgtcgaaaatgacggtatcgcgggtgatcaatcatcctgagactgtgacggatgaattgaaaaagcttgttcattccgcaatgaaggagctcaattatataccgaactatgcagcaagagcgctcgttcaaaacagaacacaggtcgtcaagctgctcatactggaagaaatggatacaacagaaccttattatatgaatctgttaacgggaatcagccgcgagctggaccgtcatcattatgctttgcagcttgtcacaaggaaatctctcaatatcggccagtgcgacggcattattgcgacggggttgagaaaagccgattttgaagggctcatcaaggtttttgaaaagcctgtcgttgtattcgggcaaaatgaaatgggctacgattttattgatgttaacaatgaaaaaggaacctatatggcaacacgtcacgtcattggtctgggcgtccgcaatgtcgtcttttttgggatcgatttggatgagccctttgaacggtcaagggaaaaaggctaccttcaggcgatggaaggcagtctgaaaaaagcagcgattttccggatggaaaacagttcaaaaaaaagtgaagcacgcgcgcgggaagtgcttgcatcctttgacgcacctgcagcggttgtttgcgcttcggaccgaatcgcgctcggggttatccgcgcggtgcaatcgcttggtaaaagaattccggaagatgtcgcggtcaccggctatgacggggtgtttctcgaccggatcgcttcgcctcgcctgacaaccgtcagacagcctgttgttgaaatgggagaggcttgcgcgagaatcctgctgaaaaaaatcaatgaagacggagcgccgcaaggcaatcaattttttgagccggagcttattgtccgcgaatcgactttgtagggtgtctcattctgttaccgttaacagctgaaaatgattgttcctgttaccgccgtcatgataatttcagaataaaagccggtttatcacagccggacaaccaaaagggggaaacatgatggaatatgcagcgatacatcatcagcctttcagctctgatgcctattcttacaatggacggacattgcacatcaagatccgtacaaaaaaggatgatgccgaacacgtccgcttggtttggggcgatccttacgaatacaccggcggcacatggaaagcgaacgagcttgcgatggcgaaaattgccgcaacaagcacccatgattactggtttgccgaagtggcgcctccattcaggcgtctgcaatacggatttatcctgacaggcgctgatgatcgagacactttttacggaagcaatggtgcatgtccgtttgccgggaaagcggcggatataggcaaacactgttttaaatttccgtttgttcatgaggcagacacgtttgatgcacctgactgggtcaaatcaaccgtctggtatcaaatttttccggagcgctttgccagcgggcgggaagatttgtctccggaaaacgctttgccatggggaagcaaagatcctgaggcgcacgattttttcggaggggatttgcaggggatcatggacaagctggactatttggaagacttgggggtaggcggaatctatttgacgccgatctttgccgcgccttccaaccataaatacgacacattggactattgctccatcgatccgcattttggcgatgaggagctctttcgcacgctggtcagccggattcacgagcggggaatgaaaatcatgcttgatgctgtttttaaccacattggcagcgcttcgcaagagtggcaggatgttgtcaaaaacggtgaaacgtcccgctataaagactggttccatattcattctttccctgttaaagaaggcagctatgatacatttgcgtttactcccgagatgccgaagctcaatacggccaacccggaagttcaggcttatttgcttgatattgcgctgtactggatccgcgaatttgatatcgacggctggcgtttggatgtggcaaatgaagttgatcatgcgttttggaagaaattccggcaagccgtcacggcagaaaagcccgacatttttatattgggcgaaatctggcatcaggctgatccgtggcttagaggagacgaatttcattcggtcatgaactacccgttcacagaaccgatgattgactattttgcagacggatcgatttcagcttcgcaaatggccagccgcatcaattcgcatttaatgagcgggatgaagcaggtcaatgaggtgatgtttaatttgctggacagtcatgacacgaagcggattttgacaagatgcggaggagatgacaaaaaggtgcgctctcttttggcattcatgtttgctcagacaggctcgccgtgcatttattacggaacggaagtcgggcttgacggcggcgatgatccattgtgccggaagtgcatggtttgggaagaggaaaaacagaatcaagagatgctcgcatttatgaaacggctgatcgctttgcgaaaacaagagaatgatgtattgacttatggcgcgcttgagtggaagctggttgatgaccaaaacgattttgtcagtttttctcgaacgcatgaaggaaaagagctgatctacttcttccaccagggcagcgaggtgcgccgtgtcagattgcgggatttgaagattgcaagcgataaaagaatatacgatgcgtggacggaagaagcgcttcagcatgatgatgtggtcgacattcagccaggcggatttttcattttgggggcggtctaaattctgttaccggtaacaggtttaaaactattgtaaccgctttctgtcgaggattacaattgtctcagattccaagatagaagggggaaaaaagatgcaacatttaaaaaaaggaattttagtgctgctggcgtcagttctgctgttcggtcttgccgcctgttcaagttcaaaggaaacgggaggcagcggcgggaaaaaagtgctgaccgtgtctgtagaagaggtctataaaccttacgtcgaaagcataaaggaaggttttgaaaaagagaatgatgtgacagtcaaaatcgttgaaaagccgatgttcgaccagcttgaagcgcttccgcttgacggtccggcaggcaatgcgcccgatgtcatgcttgcggcatacgaccgtatcggcggcttaggacagcaaggtcatttgctggaagtcaaaccgtctgacacaaaaagcttcggagacaaagaaatgcagcaggtgacggttggcggaaaagtctatggaatcccgcttgttattgaaactctcgtactctattacaacaaagacctgttaaaaacgccgccaaaaacttttaacgagctcgaggatttaacaaaagacaagaggttcgctttttcttcggaaaaaggaaaatcgaccgcctttcttgcaaaatggacggacttttacatgtcatacggtttaatggccggatacggcggatatgtattcggagctgacggcacggattccggagacatcggtctgaacaacaagggagccgtagaggcggtggaatacgccgaaaaatggtttagtgaatattggccgaaaggcatgcaggacaatacgagcgcagacgattttatccagcagacctttatggacggaaaagcagcggctgttatcggaggtccttggtcggcttccaattataaagaagccggtttgaactacggcgcagcgaaaatcccgacattgccgaacggaaaagagtatgccccgtttgcaggcggaaaaggctgggtcgcctcaaaatatacgaaagagccggagcttgctgagaaatggcttcaatatgccgcaaatgacgaaaacgcttaccgcttttatgaagatacgaacgaagttccggccaacctcgctgctcgaaagaaagcaggggagcaaaaaagcgagctgacgtcggcggtcatcacacaatacgaaacggcgactccaactccgaatattccggaaatggccgaagtgtggacaggtgcagaaagcttgatatttgacgcggcagcagggaaaaaatcggctcagcaatcagcggatgatgccgtgcgcgtgatcaaagaaaacattaaagaaaagtatgtgaaataaaacggcggttttagcgtccggaagaatagagggcgaaaaaaatgaacaaagaccaaacactagcaaaccggagccggaaggcagcgctgttatcgataattcccggtgctggccagattgcaaaccggcagttttcaaaggggatcctttttctagtcatcacaggcttgtttatttgtgagttagcgattttcggttatcaggcgctgatcggtctcgtgacgctggggactgtccccggagaagaccactcgctgtttctcttgatagagggcacgctgcaattgattttgacgctcgttttcttgatgttttacatctttaatctgtatgatgcccggaagaccgccgcgatgaaggcggcgggtttgaaaatcagcgagacggctggggacatgatcagaaatgcaggtgacaaagggtttccgtatttatttacgctgccggcatatctcatgatggtgtttgtgattatttttccggtgctggtgactctgtttatcgcgtttacaaactacgatttttatcatattccgccaaacagtctcatcgactgggtcggctttaaaaatttcatgaatatctttttccttggctcgtatcggcaaacattcgccgatgtgctgggctggacgatcatctggacgatctgtgcgacgacgctgcaaattgttctcggcatcgtgacggcgctgatcgtcaatcagaactttattaaaggcaagcggatgttccggatcatcttcctgcttccgtgggccgttccggcatttattacgattatgagcttcgccaacattttcaacgactcggcgggcgcgatgaacgtccaggtgatcccgcttttgaaccagcttccgttcgtcgacatcccggctgtcgcatggaagaccgatccgttctggacgaagacggctttgattatgatccagacgtggctcggttttccctacatttatgtcatggtgacgggggtgcttcaggcgattcccggagagctttatgaagcggcaaagattgacggcgcgacatttattcagcgctttaaacacattacgctgccgatgattttatttgcgaccgcaccggtgatgattacccagtatacatttaatttcaataacttctcgatcatctatttatttaatgaaggcggtccggggagtgcgggggccggagccgggtcaaccgacatcttaatatcctggatctataagctgacgacggggacgtcgccgcagtattccgtggcggctgctgtcacactgctcatttctttcattgtcatcggggtttccctgattgcttttaagaaatcgaatgcctttggcaatgaggaggtcatgtagatgagagggctttttaaaaatacgcggttcaccgggatgctgaacaaggttttgacctatatatttttggcgtttttaagcatcgtgattatttatccgcttttgatcacagcatcatccgcattccgggtcgggaatgtagcggcttttacactcgatttttcgggcgcatggacattggaccactttaagcggctgtttgaagagacgctttacctcaattggtacgggaatacacttgtgatcgctctgtctgtcatggtgttccaggtgacgattgtgacgcttgccggctatacgtacagccgctaccggtttgcgggccgaaaaaagagcctcattttctttttgatcattcaaatggtgccgacgatggcggcgctgaccgctttttacgtcctggccatgctgatcggagctttggaccaatattggtttttaactgcaatctatatcggcggcggaattccgatgaacacatggctgatgaagggctactttgatacagtgccgagagaaatcgatgaagcggcgcgaattgatggagcggggcacctgcggatctttgcttcggtcgttctcccgcttgtgaaaccgatgcttgcagtccaggcgctgtgggcgtttatggggccgttcggcgactatctgctggcgaaatttctgcttcggtcgccggaaagcctgaccatcgccgtcggtttgcagacattcatctccaatccgcagcagcaaaaagtcgcgctgtttgcagctggggcgattcttgcagctctgccgatttgcatcttgttcttctttctccaaaagaactttgtgtccggtttgacatccggcggaacgaagggataaatcgatgaacgacatgcgaaacgaaaagctgatcgtccgatttcttaaagcagcggcatcaccggcgggcgtcatgcgctgcaaacatgcattcagctggctcgaaatttcttttctgtttatgtttttgactgcttgtttaatggcgcctatgacccttgcgtttatgaaaatggaccgcttcaatgccgggtatctgatcccgaacgtcgctcaagaggctgacgcggcattcatcaaacaattaaaaggctaccaattgacaaacggaagattgaagggcgaagacgagctgtaccgtgtggagaaagggagaaccctgctggccgtcgatttgaaggatgaattaaaaacaagcggtgagaacgggcggataaaagcggaaggctatcaaaatgcgctcatctttcagtcagatcatctgatcatcagtgatcaaagcggagcggggttttccgttcgctatccggcaaaggctgggctgaatgatctggatgccggtcatttgggggattttatcggtgcaatgtggtttgcccaatataagccgcttatcatcatgctggcctgttcggcggttttcatcatctcgctttttttaacggccgttctggcgggaggcatctggatctccaaaaaatccaacatgaccgggataaggtcgtttaaggaagcggccgcagcggcggtgtgcggatcggcgcttccggcaggagccgcaatggctttcggtatgatcagctttgacttcatcgcgatgctgctcatccattcgtgcggtagtgctttgatggtctctttcattttcaggcacatcttcaagaaccgccatcacaacgaaaatctacagtcaggaggaaatcatggcaaatcagcggctatttgagatcgaccagtggaaaatcaaaacaaacaaatttgaaaaggaacataaacggcttcaggaaagtctgacatccttggcgaacggatatatgggaatcagggggaattttgaagaaagctattcaggcgaaagtctcaaaggcacatatatcgcaggggtttggttccctgacaaaacgcgtgtcggctggtggaaaaacggctatcccgaatatttcgggaaagtgatcaatgcgatgaatttcatcggaattgatgtatatgtagacgacgaaaaagtcgacctcagccaaaacgacatcgaatcgtttgaattggagcttaatatgaaagaaggcatcttgcggagaagcgctgtcgtccgtgtgaatcaaaaggctgtcaaaatttcgtccgagcgctttcttagcctcgatgtcccgcaactgtgcgcgatccattatgaagcggaatgcctgagcgatgaagcggtcatcacgcttgttccttatcttgatggaaatgtcgcaaatgaggatgccaatttcgaagagcggttttggcaggaagaagcgaaaggcgccgaatctcatcgcggccatcttgtgacgaaaacgattgagaatccgtttggaaccccgcgttttacggtggctgcttctatgtgcaatgtgacggaaggatatgtcagcgagcattttcaaacggatgcaatgtacgcggaaaaccgctactgttacgaagtgggaccgggaacaaaggcttctttaaagaaattgatcattgtcacaacgtcccgggattttgaagaagcagagcttttagtacagggcagggcgcttttggcggatgttcttcggcagggatatgaagaagcgaagcggaggcataccgaacattggatggaaaggtgggcaaaagcggacattgaaattaaaggggatgatgagcttcagcagggcatccggtacaacctctttcagctcttctcgacatactacggagccgattcacgcttaaacatcgggccgaaaggatttaccggcgagaaatacggaggagccgcctattgggatactgaggcgtacgccgttccgatgtatttggcgacggcagagccggaggtgacgaagaatctgcttttgtaccgctatcatcatttggaggcagcaaaacggaatgccgccaaactggggctgaaaggagccctttatccgatggtcaccttcacaggcgatgaatgccacaatgaatgggagatcaccttcgaagaaattcaccgcaacggcgcgatctgttatgcgatctacaattatgtcaattatacaggcgaccgggactacatgaaagaatacgggatagacgttctcgtcgaaatcagcagattttgggcggaccgcgtccacttctcaaaacgaaacaataaatacatgatccacggcgtcacagggccgaatgaatatgaaaacaatgtcaacaacaactggtatacgaacttgattgcgtcatggacgcttgagtacacgctcgaaaacctcgctatcctcccggaggaaaaacgccgccggcttgatgtacgggaagccgaaatcgagaaatggaaggatatcatcgagcgaatgtactatccatacagtgaggaattaaatgtttttattcagcatgatactttcctggataaagagcttcaggcagcggatgagcttgaaccgggtgaccgtccgctctatcagaactggtcatgggataaaattctccgctccagttttattaagcaggctgatgttctgcaaggcatttatttctttaatcaccgatttacaatggaagaaaaacgtcgcaactttgaattttatgaaccgatgacagttcatgaatcgagcctttcgccatctgtccatgcggtgctggcggctgagctcaaaatggaaaagaaagcgctcgaactgtataagcgtacagcgaggcttgatctggataattacaatcatgacaccgaggaagggcttcatatcacttcgatgaccggaagctggctcgccatcgtgcaaggatttgccggcatgcgcactcaggatgagaagctgtcttttgctccgtttctgccgaaggaatgggacggttattcgttcaacatcaattatcgagaccggctaatcaatgtgcaggtagaggaaaacagcgtcgttttcagtcttttaaaaggagaaccgctttctatgacagtttatggagaacagatcgcactgaacggacggtatgaaaggaggatggcccgatgagccaatggtggaaagaggcagtcgtgtatcaaatttacccgcggagtttttatgattccaacggagacggcttcggtgatttgcagggggtgattcaaaagctcgattacatcaaaagccttggagccgatgtcatatggctgtgtcctgtgtttgattccccgcaggatgacaacggctacgacatcagcgactatagaagcatatacgaaaagttcgggacgaacgatgatatgtttcaattgattgatgaagtgcataaacgcggaatgaaaatcattatggatcttgtcgtgaatcacacgtctgatgaacatgcctggtttgccgaaagccgcaagtcaaaggacaatccttaccgtgattattatttttggaaggatccaaaggcggacggttcagagccgaacaattggggatcgatcttttcagggccggcatggacgctcgatgagcggacaggacagtattatcttcactacttttcgaaaaagcagcctgacttaaactgggagaatgaagcggttcgccgcgaagtatacgatttgatgacattttggatggacagaggcgtggacggctggcggatggacgtgatcggttccatctccaaattcgtcgactttcccgattatgaaacagatgacagccgtccatatgtcgtcggccgctatcattcgaacggcccccgtctgcacgaatttatacaagagatgaaccgggaagtgctgtcccgttacgactgtatgacggtcggcgaagcaaacggctcagatgttgaagaagcgaaaaaatacacggatccaagcagacatgagctgaacatgatttttacatttgaacatatggatattgataccaaacagcattctccgaatgggaaatggcagatgaagccgtttgacccgatcgctttaaaaaagacgatgacgaggtggcagaccgctttaatgaatgtcggctggaatacgctttatttcgaaaatcatgatcagccgagggtcatatcccgctggggcaatgaccgcgagctccgcaaacaatgcgccaaagcatttgcaacagttctgcacggcatgaagggaaccccgttcatttatcaaggtgaagaaatcggcatgacaaacagcgagatgccgctcgaaatgtatgatgatctcgaaatcaaaaacgcataccgcgaacttgtcattgaaaacaaaacgatgacagaggaagactttcgaaaagccgtggcgaaaaaagggcgggatcatgcgagaacgccgatgcaatgggatgacgggaaatacgcgggctttacggatggagagccttggctggcggtaaatccccgctatcaagaaatcaatgtgaaagagtcgcttgccgatgaagattcgattttctattattatcagaagctcatcgggctgcgcaaacaaaataaagtcatcgtgtacggagactatcggctgctgctcgaggaagatccgcgaatctttgcgtatatccgcgaatatcggggcgaaaagctgttagtcgccgtgaatttatcagaagaaaaggcgctgtttcatgcttcgccggaattgcttgaggacagatgggatgtgctgttgtcaaactacgcccgagagcggcttaatataagcggcagtatcgacatggagccttatgaagctttcatgatgatcagccgggcaaaggattacacatcatgaaagcggtcatttttgacttggacggcgtgatcacggatacggccgagtatcattatctcgcatggaaacatactgcagaacaaatcggcattgagattgaccggagctttaatgaacggctgaaaggcatcaacagagagcagtcgcttgataagattttgattcacggcggcgcggccggaaagtttcaggaggcggagaaacaagagatcatgcgccggaaaaatcaatactaccaacagctgatccaaaacttgactccgcacgacctgctgccgggaatctccgtgctttttgccgaattgaaaagagaacatataagcattgcgttagcttcgtcaagccgaaacgcgcctgctattttgcagcggctcggtgtcatggacgaatttcagggtgtcgttgatccggccgcacttgctcacggaaagcccgaccccgaaatctttttgacggccgctgcactgctcggtgtgcctccgtctgaatgtgcagcaatcgaagatgctgaagccgggatcgccgcgatcaaatccgcagggatgttcgcggtgggagtcggtgatgagacatcgctgcgcggagccgatttgatcgtgcacaacacaaacgagctgacgtttgagctgctgaatgaaggatggcagcgctattgctgtataagagaaggaaaatgaaaagcaacccgagaatcataaaatgacaggccgccgctggcggccttatctgcaatcggagagggaagcaaaaccaagaacaagatcaagatcaaggcgttcggctggccggagagggagaccgttcagatatgcgttttgctggttatacaaccgatctcagcaacccgacttcgaatctatcaggcggttggatacagtcctgttgcagagtctatcgcctgcgtttttcaagaaaaacagcctaatcgatccctttaaaaggatgattaggctgtttgtttattggtgcatttgcaatttgacaaattttcgtttgccgacttggatgatcatgccgtgttcgagtgcaatgtccgcatgaatcgattccgctttggcgccgttgattttaacgccgccgttttggatcatgcggcgggcttcacttttggaaggaaggagttcgagcgtcaccaataaatcggtgaccggcaccgttccgccaccttgccagtgtacggctgttatattgtccggcgcgctgttttgctgaaaaactttcttaaactgctgttcggccgcttctgccgccttgcttccatgatacatgttgacaatggttttcccgagaagcatcttcgcgtctctcggatgaacggcccccgtttccaaatccttgacaagacgttttttttcttccgcctccaagtcggtcgcaagatggatatactttttcatcaaactgtccggcagagacatcgttttcccgaacatttcatgagggtcttcatcgatgccgatgtaattgttctttgatttagacattttttcaatgccgtcaagcccttcaagcagcggcatgagaatgacgacctgtttttcttttccgtacttttcctgaaagtgtctgcccatgagcacgttaaaatgctgatccgttccgcccagttcgatgtcgctgtccagaacgactgaatcatacccctgcatcaacgggtaaaagaactcatgaagcgaaatcggcttttgcatggcgattctttcttcaaaatcatcgcgttccattaaacgggcgacggtaattttgcccgcgagctcaatgacgtcttccaaggttaatcgtttaagccattttgagttgtagtgaagctcgaccttgttctgatcaagcacttttccaaactgttgaaagtatgtttcggcattgcggcggacctcttcgtccgtcagctgtttcctggcggcggattttcctgttggatcaccgattttccccgtgaaatcgccgatcaggagctggacgatatgtccgttttcctgaaactgacgaagcttattcaagacgacggtgtggcccaaatgtacgtcaggcgcagacggatcgaggccgagcttaattttcagcggttcgccggtcaaaatcgatttggccagctttgcccgcagttcctccgggggaatgacctcctccgctccgtccatatataagtgaagctgcctttcgacttcccgcttttcggcagttgtcagttgatcaaattgttgttgctgcatgataactcctcctttttttgtataaaaaaagaacctcatcccgataagggacgtggctcaaatgcacgcggtaccaccctgattgaagaccttcatcttccgctcaatttccggtaacggcttcccgttctttgctacttgaaggttcacaaagaaagctcagggaggtaattcacgtctgcctttgtaccggctcgcaccagccgccggctctctggaacagggagacagtccgctactcgttcccgtcgttgcttatggtttatgaagattgtcattcacttttcgaaggagctcgatcaatgtattctgctcctcttttgtcatgcccttgatcagcattgtttcccctttgtggaacgccggataaagctcttcaatcgcggcttttccttccggtgtgatctcggcgtaaacgtgtctgcggtctctcggatccgcgcttttgacgcaaaagttctttttctcaagcgttttaatgacattgctcgcagtggctgttgaaattcctgacagttcggcgagttttctcgtttcaagcctgccccatacccatagatcgtaaagaatcgaaaaagccgtccaagacaattgatatgaggaaaggacctcggtctccattttgacgcggagcttttgcgccgaccggtaaaggttggtggcgaccgaaatggcttcaagattcaaggattcgatcggcatgcgcttcagcttgctgagggtgtcgtgttcttcctgtcgaagatggggggatctattcaatcgtgacgcctgcctttttattttcagaattattagctatgaaatgaattttaacagacggtctccatcaatgcaagcccttgtttgacatgatgagaaaagccggcatcatgatgatgaccggcgcttgtttcagctattttttggtgatctgtttgcggcgcacttcaattcggtcccctttttgaatgctgtcatattgttttttcgagacgaggacggcatgtttctttccgttttgatcttcaatcaacagccaatatcttttttcttttcgttcagagagcgctttttctttgattcctgcggtacggaggatgtttttttgttccgctgtatatccgcctacgtggaagatcatccaatatggaaagtagtaattcaaaaaggctgatccagcaggattttgattgagtgtccgcttgatgcttcctttgtacagggcatcgggaggcagtgtccgctgaatggtgttgaactgactgttcttgtttaagtatcgtcggctcgcagactgtttcatataactgcgcatactctggttgactgaacccgcacgtgtttttagagcgctgttattagccgaggaactcgaagccttcaccccggatgctcctttgctgcctgctgcctctgcttgagcaaaaggcagcaagagggacagcgccatgatcaaaataagaggagcgctttttttcttcattgttcatcactgcttttttgttcaactttgtctttgacgacgccctcaagcggctcctgatcatatttaatgtatgggggacgaaagatgaaggcttcctgatcgcggattttaatataaggctgttcgacattttctacattttccacatattttttgaaagtctccgtcttttcttttccatctttcacgtatgctgctttcagtaatggtgctttgtcggattcgctgtcattcacgtaatcaaaccatacgagatcgtatttttgaatggattggtcatctgcgacctcctgtgaacggtctgaagcggatgatgaacatcctgataagggaacggctaaaagcatcgcagccgcggataaagagatcagtttcgattttttcactgtgatcatcctattcatttcggtttcgcttttatatacgaacgatccgggcaaaggtgtcatctattcaaaatagattggcagaaaacagggcgtaacaattgcattttaaacgtaaacaaactgtaaaataccatttctatgaaaaaaggtataatttgaatgtcagaaaaaaatcccattcacggaggatatttttatatgaagaagatacttttttctgtttttgttttggcaggcagcttgctattggcttttaattttgccggtgaagcgagtgctaaaacgaaaaaagtcagcggctatatcacttggtacaacggagtgggcaaaatcggcgctgacggcaagaggctcggccattgggactgcgccacaaagatgggcttcgatgttccgagaaaaggcacaaaaataagagcctattcaaaagcaaaaccgcacaaagtcattacagtctataaatatgatgtcggcagaatgccgggcgctgttttggatgtaagcccgaaagcttttagagctttgggatttccgacaagcaaaggaaaggtagccggacattatacatataaaaaataggagaaatgaagcaagaaaaatcgttttcttgcttctttcaattggcggggtcgaatatgaaaaaagtttcagttgttttgttggcggcagtcattttagccgcaggcgcatttgcggccgtccgctatttcgtcccggaaaaagcggagccggcaaagagcggcggttcagacctgcttgtatcgataaccgatcagaagctgatgaccgcttactatgaaaatcaaaataagctgtatgaagaaaagatgacggattatccggctatggcattagaccggaaaaaacgaattctttactatacaaacaccgataacagcaatgtgaagcatttgatcaggctggatttacagtcgggcaaaaaaacaaccctatattcaggagatgaatatgtcgacgggctcagtttatcggcggacggttcgaagctgttcatgagatacaaccttgcggaggagaggaattttcaccttgcttcctttgatttaaaacaaaaggcgtttcatgtcatctatccatcgttgaaaaacaaggacgaaactgtcagctactatcagtacaacaaagctgacaatcaattcgttatgctgcattattcattgaaggaagactatcaaaaaacagatgatgcgaacaacaaaggcgtgccgcccgaaccgacgaatatgaacatttccatggcgggtgtgaaagatcggcaaaaggtgagaacgatagcaaaatttatcaatgacgtggcaatttcgccggatggaaaaacgattgtctttacagaatcggctgatgatcagaaggcgatttatgcgatggatgccgaaacgaaaaaatacaaagcgatcatttcagatcagcaggcattttcattggtcgattcagcacagccgcaattctcgaaagacgggaaaaagctttactttctcgctgaagcaaaagatgcgaagctgcttgaagatgaaacggggagcgaagcaagggtgagaacgatctattcgtatgatatggatacgaaaaaagtgagcaaagcctgggaaaaaacaaacgggatcatcaacacctttacggtcattgacgaataaacgggcaccagccggcacaaacagactgcgccggctgtttttttatgagccgtttgcctgagacgctgcagcagagcttgtcataatggcgattgctgccgtctgctgtgcttgaataacagcttcaagcgtttgataaagccctgtatccaaaagcgccgggtcttccgttttttcgctcatgtacaagttgacggccgttttcagattcatgtctttctgccacctgaacagtttatcgctgttcaatgcgcctgccatgatagtgatggcatctatgtctttttcgccgttctcaagcagcgcgagcagtccgatttccgggtaatggacaggctttggtcttttatgcttttttgtcaattcatcgtatatccggagggagcgggcgacaagctgatctgaatcctgctccggcataagcgagaggatgtggctgagaaactgcaaatcgttccctttgcgaaaacccgcctggttaagcttttggtaaaacgcttcgatatagtcaatcagttcacctgtctccatatctgaaccggccaaaagcacggagagcgggtagtcgccggcagatgttaaaaaaacgtgcttgtccttcattcctttgtaaatagacaaagcccgattgattttgctgtcatgatcatgctcatcacggtattttgtcaaaagaataagagcggacaaataagtgaaaatactttttttgaatccgttgccggtcatttttacataaagagtgaaaaaaggtctgatatgcgtttcaggttcttcgaagcgtacgtcaaacatagcggcaaaagtgtagcgatgggctgacctcaacggcgaaaatgtaccggcggcctgtttgacagcctcactcagatttaaaaaccgttctttatcaaaaggccgcttgttgacgacatacatggaagcaatcatcattaatgtccgctgatctgtgactttccattttaaatcgctttttaactcagagtaaattgctttatattgatccaatcgctgctgcagtttagcagatgccatttatctatctccttcctaggtttgcgtgtttttgtatatacgaaacaaagggaaataagtttcagggatttggcatcatatcgggcttctgcttaataatatggaaaaggatacagcgcagcaataaaaacaaacgggaagatccttctcctgaaccgcctgaatcgtcggcgcggatatccgtaaccgccgtaaaactgcctttcatctgtcacgtcttcgggaatgaggacagatgcttcctgacggttcaccccttcaagaatgccgtgaacagaactgccgtccttcattttcagcacgacgtgatagtgcatgtatttgcggcataaatcgtgcaaagacctttgatgatcatggggcatcgagcaagcggcatctttcggaacactcatattcctttccatctccttttagatacatggtattcacccgatggatgaatgttccggtttgaagcggtgaagccgtgattttatgtaaaaaagccgattatcatatatgaatcggctttaaagatcaacggtcagcacttcattctgcggcatttgaagcggtcgtcatcgtcatcagaaaagcactttctttttctgcatttgaaccggtcatcgtcagagctgcgggttttatccgttttatccgctttagctgttttatctgttttattcgttttatctgttttattactatccgccgaacgccgcgctttcattgactgtctttctttttcccgctcagggctgtatggatcgtaattgtcatagtactcttcgtagctgctcattttgaggcaatcaccgcctttgggtcatgatatgataatgtattataaagaggggcgttttgcctgtgcatatataacggtttttcgtgctgtaaataagctgatcaactgacaaaattcaacattgaataaaggatttttcgtttcaaccgctaatattatatgtatcaaccatttttttacggctgcgcctgccggtgcttgcggaaagcattcagacggacggcctgatatgatagaaggagcggaatgccgatgaaacgatccggaagtgaaggagagtacttatgaaaaatagtagaaaaaaagagatcttatcgtgggtgaaaacacttgtcatcgccgcagcgcttgtgatggtttgccgctattttctgtttacgccgtcaaccgttttgggagattcaatgtatccgactttagaggacggcaacatggtcatggttagtaagatcagcgatattcagcgctttgataaaattatttttcacgcgcctgattcggatgaaaactatgtgaaaagggtgatcgggctcccgggagatacgatcgaaatgaaggatgatgtcctttatataaacggaaaagcatacgatgaaccttatttaaagaaaaacaagcaaaagctgacgcttcatgaacatttaaccgataatttcacattggagaaattaacaggtgaacaaaaggtgccggaagatcacttgttcgtgatgggggataaccgtcaaaacagcaaagacagccgctttttcggatttatcacaatggactccgttgtcggcaaagttgagttccgttatttccctttcaatgagatcggcggaatagaatagaaaacaaaaaggcttcccatgatacctaatgggaagtctttttgtttgtcgcaaagtcaccaaaagtggtttaaaccaagccgctatgcttgagcacggcggcaattctactattcacttaaatttaaattagagccagtttttgatatcgcagttgcagaattaggtctctctgaattataaggattgcctttaatttggtataaaagcctgtttaatcgctgattacccaaacaaaaataactaaaaaatcctcgatttaacaatttagtgtatggtactctttaaacatgtaatcaaaaaactatctttttcgctccaaagcaacataccgtatttcttggtttgttttttagttgttctaaatattttttattgttatcgcaattcttacgttgtttgctgcaatgattgaagtactatattacataaattctgataggaggtcattatgtttaatagacaacagatagatcatctgcttgaagaaaaaaaaggagagctgaagaaaaagttcggaagtggttttatcgcagttttctatatttctattcttctttccatatgtacgttttttatagaatacaaatattttctcattgtattattcgcacccactattattgtcatgttaatcaaccctcctttttccgaaaaaaaaggggtgtttcgtttcattgccggcctttatttgcttttattggcactggcaacatacttttggcttcgagcataaacagtccggatataaaaaacaaaagtggcttcagcccgcggagaaaaggcgaatttacgtttaacattgctgccaaaatctcaaaaatccggcgacttgacttgaaagagtcctcatcgccagaaaacagaatgaattgcataaaaataggacagaatataaaagtccgacctattttgtcaacgatctgaaaggctgcctgcagttaggatgggaagcctttttagcatttgcgcattttggcgagcggacggtttgaacaattatctggacagtgaaataatgaaataagaaactggcaacaaggaggataagcagatgaaagtgtttgtagtgggggcgaacggacaaatcgggcgccgtttgacgaaaagtttgaatgagagcagcgaacatcaggtcagggcaatggtgagaaatgaagagcaggcgcaagctttgaaacaatcgggaacagaaacagcgctcgctaatttagaaggcaccgttgaaagcatcgcagaagcggcggagggctgcgacgcgattgtctttaccgccggctcaggcggcaatacgggcgctgacaaaacgcttttggtcgacttggatggggcggttaaaacgatcgaagccgccgaaaaagcaggcattcgccgctttattatggtcagcacattgcaggcacaccgccgtgaaaattggaatgaagcgttaaagccgtattatgtcgccaaacattatgcggatcggatgcttgaaggcagcgaattaaactacacgattatccgtccgggaggcctgttaaacgaaccgggcacaggccgggtgaaagccgcggaaaatcttgagcgcggaacgattccgcgtgaagatgtggccgataccatcttggcggcgctcaccgaggagcacacattccgtcgttcgttcgatttggtttcgggtgatcaaacgcccgccgaggcgctgaaatctatataaaaggattcggggaacctgtggtcagaaggttccccggcgtttttacagaagcgggatatagatggtcatcttcatctcgttcggcggtacggaacggcacacatcagtcacttcaaagtccggtccttctgttctctcgtaattggtattcatcagccatgatccatagatgtatcttcttgtgttctgcactgattcagtcgatccgtttacatgaaatacggcgtatttgccgccgggaattttcgtataaataagcggctccggcacttccccggctgctgtttcgcgaacggcttccccgataataaatgagaaacctccgtcatcctggaagcggcatgacagcccgtaacacatattcggatccgttttttgaggaatttgcataaagtatccatttctgccgaaatcgttgtagaatttcgggatatcttcgaaatacttttcatcgtttaaatttgtccggtactcatatccgatcatatgtatgtcgtttaaatgagtgatgtgcggctttgggatgttcatatctccagtcatcctttctttatattcgaggaaattaattttagattgaaaatcaagcttgaccttcgctttgcgatacttggccggagtgatgccgaagtactgtgagaaagccctgctgaaagcttcttgtgagccatagccgaaattgattgcaatgtcgagaatggaacggtctgttttctcaagcagaagcgcagcttcagacagacgccggttgcgaatgtattgataaacggaaaaaccggagatcgcctgaaaaagcctttgaaaatgaaatggggagaaacacgatttagccgcaatatccgtgatgtttaaatcgttttgaaggtgttcttcgataaactgaaccgcgttttgaattctttcgtaatcattcatattcatccacagcctttacgatttgatgatcctattgtacaggatcaagcgatggtttttttgatgatttgtgcttttttaaaagcctccaaatgcggaggctttttcttattgatgacgaacatctgtcacttcaagagggcgcatcatatcgtaatcttcgtgctcaaggatgtggcagtgccaaacatatctgccgctgtacggcgcaaaggtggcgataatgcgcgtcactgaacccgggggtactttgacggtgtctttcagccccttttcattcggtgccggaggaactgccggaccggtaaaaacaagttctccgttttcctgataccgctcgatatcaaacggccggtggtcgagaatcataaattgaacaagatgtaaatggatcggatggatcgcccttccggcattgatgatcgaccagatctcagtgctgccgagtgcgggtgtttcggttaccggttcatgccactttgtgttgtttaaaagcagaacaggtcttccatattggtcaacggccgcgcccaatgacagatttctgagggcattgatcttgtgtctccggtaaaatgggcgctttctcaatattctcggcaatgaacttgtatctttttgcttcaaaggttttgagatgcggaattgcatgatgtcggcatcagtatcgggatctgcgtcttgtccgccgcagccgatccgttttttcagtgtcacggtttttccttctgctcgtgaaaaatcaacgatgatatcgcacctttcagccggcgcgatcaccagttcattgactttgaccggatgctgcagaagaccgccgtccgtgccgatttgatgacatgtgatgtcatgatcgaaatacagctcaaagattctcgtattggaggcgttcagtatccgaaaacggtattttcggggttccagttcagcgaaaggccataccttgccgttgactaaaatggtatcaccgcaaaaagccggaacaatcgacgggtccggaagatccggcgaagggttgtcaggctgccgcggataaaacaatgaaccatcttcatgaaatgatttatcctgaatcaaaagcgggatttcatattctcccttcggcaagttcaatgaacgctcttccctgtcgcgaataaaatataaaccgacaagccccgcatatacattcagccttgtgatggccattgcatggtcatgataccaaagagctgtagcatcctgctcattcggatattcatacacctccctttcaaagaaagggccttttgcatggaagtcttttgtgtaccaagcctcaggatatccgtcgctgtcagcaggcgtacagcctccgtgcaaatgaacgaccgtcttcacttcatgttcgtgatggccgtcatcgtgaagcgtatggtcgacggggagaaaatggcgatccggaagcttatttaaccacttgactgcgactttttcgtgtttctgcacttcgaaggtagggccgggataaactccgttatatccaaacagccgagtcggcggcagatcgcggtgaagctgctgctgaaattctttcatggtgacttcataataggtcatttccttgcttttgctttggggttgaagcacttgcggaatggggagccggtcaacgaatttttcaagtttcatgtttcacctgtcctcttttgttctgatgaaaagatcattacattataagacgggttgcatggtctggttcctcatgatgagaataagaaacgcagtatgtgctgagtatgttaaaaaatagaatcgatcattacaagaagatgaacaaaatatttcctgacgattaaaaatcgccttgaggcgtgattcgcggaggaagaaaggcggggatgatggtacattatgtgtaaaccctttcttatggggcgaagcggtctgaaaggagatacccgtgttgcagaaaagaatagagtggattgatgtttcgaaaggcgtgggaattatattggtcgtattgggccatacaccgacgccggattggctgaaaacgttcattttcgcatttcatatgccgctgtttttctttctgtccggcctcgtttaccatgatgggaatatgacttttacatcttttctcttaaaaaaaataaagacgctccttttgccgtacttcatcttctccgttcttgcctatttattctgggttctcgtcgagaggcattttacgttcaccggcagttcggatgtcgacccggttgtaccgtttaaagggattttttattcgatgcctgatgactacaagctgacacacaacccggcgctctggtttttaacatgcttattcatcgttgaaatactgtttttcatcgtgaagagatgggggaaaggcagactgtttatcgtcatagccgtattggtctcagccgctttaggctttttgaattatcaatatctcggcatcaagctgccgtggaatattgaagtggccctgaccgccatcgtcttttattcggccggttttctgttgaaaaataatctgaaagagatgagagaccgaagaatgctgctgctcacgcttcttttattcatcgcggtcggctgcttgcagaccctgaacgtcagagtggatatgagggccaatgagtacggaaacatggcgctcttttatatgacctcatttctggggacggcaggcgtcattttcagcagctttcaccttgaaaaagcaaggcttctccaattcctcggcaaaaactcgctgatcattctcgtactgcactatccggtcatcaggatgctgaaagccgtcgtctactacttcacacaggtttcccttgatgagacatacggctccctgttgtggagcgcgctttacaccggcatgacattgcttgtaatggtgccttgcatctttttgttgaaccggtatccgatcgtacttgggcggaagaaatgcaattaaaaaaacttgcaaagttttctttgcaagtttttttgaattatttaaggttgaaagtaatctttttgtcattccaaaattcaggagtgtagataactttatatgttttgctctttttagtctcgaaagtgattgttccagataccttgccgtttggtgtcagatttccagaagataggtcgttatcatctgatggtccaaacgtattgtgcgtaatttgtccatcttcattttgaatttgaaaatcgagcgggttataggaaatatctttatcgcttttattttctatgttaagtgttgcaactacatattcattaccgttgtttggtttgaaatattcattgcccatcgattttttaacgttagtaactgtgatgtgtgtgccgtcaagatcagctgtttcatttaaaccgaattcagttttttctttggcatcgtcattgcttttttcttcgctagtttttgcggctgtcgtctttgcgctgcttccggacgatttgctctcttgagtagaagagccgcttgaagcgaacatcatgacgaatacgatggagccaataatcgtgacatagaaccaccatttttatagacaaggcctttattcccgccgctgaacaatgctttacatccgccgattaaaagcaggataagcggaacgatatatgccaggctgacgccgacagttcctcctattgcagcagcgatataaaaaggttgctatctgcgctggccattgtcggtgcatgtatcgtaatgtccacctcataatctatgtaataatgtctgaaacataataatccaaaaaaaggaaaaagtctattttattatgatattttaatcgtcagagctttaaggactattttcgacttttttaatatcgtttaaattttgagtttgtttaatgtttttcagaagaatcattcatggattctaaagaaaaaatattctgaaagaagaaaccgtcctttccatcctatgacgcttgaataatttgaggttttcgaaaaatccttatatagagcgggttttaacggttttgaccaaactgaaatttgtttccttaaataaaaaaagttctactctgactatatttctgcaagaagtgaatcatgtttctatagactcactcaagttttgctttgtatgattaaaagcgaaaactcggatgggaaaggaagctttttatggaacggtatgatgaattaaaaaaaggtgaaaccggggcatgggtcagcatcatcgcttaccttgtactgtcggctgttaaattggccgtcgggcttgcatttcactccgaagccctcagagccgacggactgaacaatacaaccgatattatcgcctcattagcggtgctgatcggcctcaggatttcgcagaagccgcctgatgaagaccatccgtacggacatttccgcgctgagacgatcgcctcgatgatcgcttcatttatcatgatggtggtcggtcttgaagtgctgtacagctcgggcgaaatgctgtttaatccgaaggaaacgacaccggacatgattgcggcctggacggctgcaggcagcgccgtcgtgatgtttttggttttcctctacaataaaaggctggcaaaaaaggtgaacagccatgccctctatgcagccgccgccgataataaatcagatgcctatgtcagcatcggaacattcgcaggcatctttgcttcgcaatttaaccttgcatgggtcgatacggcagccgcgtttatcattggattaatcatctgcaaaacggcttgggggatttttaaagaggcggcccattccttgacggacggattcgatattaaacatatttcaacctataaagaaacgatccggaaagttcccggcgtcggcaacatcaaagatgtaaaagcgcgttatttgggcagcgccatccacgtggaaattatcgtggaggtaaggtcagatctcaacattgcagaaagccatgacatcgccgatgaaatagagagaagaatgcaggaggagcactcgatcgttcattcccatgttcacatagagccttctaaagaaaaataaaaagcggtcactgaccgcttttttttactttcatcactctgtaaattcgaaatgaaaaaagacaaaattctattttccgccagtcagttgttttctgggagcacatcgtttatggtaaagttaaataaattcgattcgtcagcaatgaggaggaagaggatgtcatacgaagaaatgctgcatcccgttttgggaaaagtagctgataatattgacaaagtaatggtaggaaagaaacatattgccgttttaagcctgactgccattcttgcaaacggacacgttctgctggaagacgtacccggcgtcggaaagacgatgatggttcgcaccctggcaaaatcaacaggcgctgaatttaaaagaatccagtttacgcctgatttactgccttcagatgtaacaggggtttccatatataatccaaaaacgctggaatttgaataccgttcaggtccgattatgggggacatcatcctcgccgatgaaatcaacagaacatcgccgaaaacccagtcggcgcttctggaagcgatggaagaaggaagtgtgacagtagacggtgtgacaatgccgctctcaaagcctttttttgtgatggccacgcaaaaccctgtcgagtatgaggggacatacccgctgccggaagctcagcttgaccgctttttattcaagctgagaatgggatatccgacagtccgcgaagagcttcaagtgctcgatcttcaggaaaaccgcagccccattgaggaaattgagcctgtcatagagaaggaagagcttgccgcatttcaaaaagaagctgaaaaggtgtatgtagacgctgcgattaaagaatacattgttgggatcacccaaaaaacgaggagtcattccgccgtttatctcggggtgagtccgcgcggctcaatcgccttgatgaaggcggctcaggcgtttgcatttttatataaccgcgattatgtcattcctgatgatattcagtatttggcgccttttacccttgcgcacagaatgatcctgcggtcagaggcgaaatttgaaggaaagcggcctgaagctgtccttcaggacatcatgtcaaaaaccgaagttcccgtcggaaggccgatgagcagctgatgagagagcgcatcggtcttgtgatgtacggatggaagctgtttattctgtttcttctgtttgcttcaacgttttgctatgcgatgtttcaagggggatttgtcagctggtttctgttctactcatttctcccctttgcgctttatgctttcctgtttgctttttatccgctgaagaacttgacagcggagcggaggctgagccaagggcagtataaagccggtgatcaattggaggctttcgtcgtgctgaagagaaaatggccttttccgatcatgtttatgatcgtggaagactgcctgcctgattcgctggggaaaaacaggggttcggcagaggccaaacagcttctctttccttggtttaaaaaagaaattaaaatggcgtacacgatcgattcggttccgagaggagaccaccgtttagcaaaaatcagagtccgtacaggtgatccgctcggcctgctggaaagggaatgcgagattcaattggaagcttcctttctcgttttgccttcctatcaggagatcgcttaccgcgccagcggaggctcttatgacgagcatgcaggccgcgtttcagagcttcgccgcaaggacagtacactggcgtcaggtatcagagaatatcagccgggcgaccgttttgcatgggtcgactggaagacgtcagcccgccgcagccagctgatgacgaaggaatttgagcagacgaaaggggatgacctgctcgtctttatggatcagtccccgtctgaggcttttgaagagatcgtcacgtttaccgcttccatcattcgttcggcaatgcggagcgggacgaatgcagggcttgtttccattggtaaggagcggaatgtcttcccggttcggcagggggaagagcagctgagaaagctgttctactacttggcgattgccgactgcaatgcagtccagccgtttcacagtctgatagagggggaattgggacattccgatatgagaaaagccgtcaaatatattgtgacaagccgcatcacgatcgaactggtgcaggctttgaagaaaccgctctccggcgggcggcccgtcatttgtttggtgaagaaaaaaggcggagatctatcaagcgaggaaagcgcggctgtccagcatttaaaagcgcggggaatcgaagtaaacgtcatttacggggaacatttttcccggggtttggctgaagcgaggtgagaaaatgttgtccgggggaaaaagaaacaggttcggtttattgcttttttatgtgctgacttttttgctgctgtgggagtggctccgtcctttgcagtattttaccgatacggggcacaccgtcttttttattttatttatcgctcttgtatttttgcttacattttttaaggtcccttggtttatcagatttccggtcagccttggcttcgttctgtttgcactgcacacgattttttacgaaggatcggtgttttcaccttcatggattgccctgtttttccaggatttaaagcgaaatttctcctatattttctccggcatgtggcgggatatgtcgccgttgtttcggacgctgctcttttacgtccttctttggctgctcgtatacttgctgcactactgggtgatctatcagcgcagaattttattcttttttattatgaccgttgtttatgtcgcggtgatcgatacatttacgccgtttgacgcgtcatatgcgatcgtcaggatcgtgctgatcggctttttgcttctcggcctgctgtatttggaacggatcagggaatcagaagcgctcaaatcctcgaaatcgcggtttgccaaatggtttgcaccgctcttattgatgactgccgccgccgtgtgcatcggcgcggtctcgccaaaagccgatcccgtctggcctgatccggtgccgtttctgcagacggctgcgaccggcgattttgcttcctcaggcagaagcaaagtcggctatggaacgaatgatgaggcattgggcggtccattttcaaaagacgatacatgggtatttacatggcagggaaatgaacgaagctatttcagggtggaaacaaaaagccgctatacaggaaaaggctggattgaagacgaaaaatcaggcgcatccattcagcttgaagaggataaactggattaccagtggtacgacgaaagcgtgaagaccgaaacgcgcaaagcgatcgtcgatatcgatcccgcttaccggtacgatcatgtcctgtatccgatcgggacgaccgaaatcaagctcaataatttctttgtgccgctccgcatgaacttaaatacggagaaaataaaaccggccggcaagacaggcgcggacattcagaatctggaaagctattcggtcacctataaatcacccgtctttgatgtcgatcagctgaggaaagtcagcttggagtcggaggggaaatgggccaggagccatgagaagtacctgcagcttcccacttcccttcccgaccgcgtgaaaacattggcgcacgatttaacgaaagacgaagataatatatatgacaaagcgaaagcgattgagaagtatctcggttcttccgaattttcttatgagacggaagatgtcgctgttcctaaaggagaccaggattacgtcgatcagtttttatttgagacgaaaatcggctactgcgacaatttttccacggctatgatcgtactgctgcggtcggccggaataccggcccgctgggtgaaaggctacacatccggtgaatatgcaggaacgacggcagaccggaaacgcacgatgtacgaggtgacaaacaacaatgcccactcctgggttgaagtgtattttgaaggacaaggctgggttacgtttgaaccgacgaaaggctttttaaatcccgagcagctcgttgaagagtccagcggtcagcaagccggcgcggcttctgataaaaaagaagatgataagaaaaatgatgaaggccagcgtccgcaggatgcaaaagaacaagacaacaaagagaagcccgaatcccaggcaaagcgtgatgccaaagccgattcccatgccggaagcgatgatgcagaccgtactcttttgactggtgcggccgtactcggtctgttgctggcgtttgcagcggtgctttactatacaagggtgaaatggatgccgcacatcatcatcaacaggctgaaaaaacggcgtgatgaagcggttttctttaaagcctacgacgaactgctccgccagctgaagcgccaaggcatgcaaaaagaagaaggccagacgctgcgcgagtttgcgaagacggttgatgaacgctttcaaagcggggacatgacggctttgactcttcaatatgaacgggctttgtatcgaaaggaagacgccgctaagctttggaatgattcggcggagttatgggaaaatttaattaaaaagagatagtcttgaccgctttcagtcgtattgttagaataagtgaatattaaaaacccttatatattcttgctggcaggctcggcggcttatctatcggacaagccgggccttgtcccgtgaatgggggcaggacggccgtgtgtctgccgccattttttctgtgcaaaaagacaatttgataaagaggtgacaccatgacgaagttagtaaatgaaatgattcttgtgttggattttggaagtcagtacaaccagctgattacccgccgcattcgtgagtttggtgtatatagtgaattgcatcctcatacgttgacggcagaggaaatcaaaaaaatgaatccgaaaggaattattttgtccggcggtccgaacagcgtttacgacgaaggatctttccgctgcgacgaaaagattttcgaactggacatccctgttcttggaatttgctacggcatgcagctgatgacgcattaccttggcggaaaagtagaagcggcaagccagcgcgaatacggaaaagcaaacattcatatcgagggtgaaccggatctgtttaaagatcttccaaacgaacaagtcgtctggatgagtcatggtgatctagtagttgaagttccagaaggctttaccgttgatgcgacaagccatcattgcccgaactcagcaatgagcaagaaggataagaaatggtacggcgttcaatttcatccggaagtccgccattcagaatacggaaacgaccttttgaagaacttcgttttcggtgtttgtgaatgcgtcggcgaatggtcaatggaaaactttattgagattgaaatgcagaaaatccgcgaaacagtcggcgacaagcaagtactgtgcgcgttgagcggcggggttgactcctctgtcgttgcggtcttgatccataaagcgatcggcgaccagctgacttgtattttcgtagaccacgggctccttcgaaaaggtgaagcggaaggcgtgatgaaaacgttcagtgaaggcttcaacatgaacgtgatcaaagtggatgcgaaagatcgcttcctgaacaagcttaaaggcgtctcagaccctgaacaaaaacgcaaaatcatcggtaatgagtttatctacgtgtttgacgatgaagcggaaaaactgaaaggaattgacttccttgcacagggaacgctatacactgacattatcgagagcggaacagcgacggctcagacgatcaagtcgcatcacaatgtcggcggccttcctgaagacatgcagtttgaactgatcgaaccgctgaatacgctcttcaaagacgaagtgcgcgcgctcggaaccgagcttggcatccctgacgaaattgtttggcgccagccgttcccaggtccgggcctcggcatccgcgttcttggagaagtgacggaggaaaagcttgaaatcgtccgcgaatcagacgcgatcctccgcgaagaaatcgccaaagctgatcttgaaaaagatatttggcaatacttcaccgttcttcctgatatccgcagcgtcggcgtcatgggagacgcaagaacttatgactatacgatcggcattcgcgccgtgacatcgattgacggcatgacatcagactgggcgagaattccttgggatgtccttgagaaaatctcgacacggatcgtcaatgaagtgaagcacattaaccgcgtggtttacgatattacgagcaagccgcctgcaacaatcgagtgggaataagaaaaatgcctcagccgcatgaagctggggcattttttattggtggagcagtagattggatgatataacgcttatatcttccgttttcatcgccgcagccgctgtgccatgaatcttccgatcacagagtgacaactgaacaaggcattaaagtctacgatacagttcaaacggtgttcgaagcgcggtcttgtcggaggatatgacgcggaaacagaatatcacgctaaaaaaagagcgtgttttatttgaattgaaagaaaaccggggattgagccccttcagaccacgatcagaatttggaaaaacaacgaacgaagcgaacattaaaatcatgaatgttcgtttttttgtattgtgttcaacgttagatattgctacaatagtatagtaatttaaaaaagacttgtcgtataatcatggggatatggcccataagtttctaccaagctaccgtaaatagcttgactacgcttgtatacaatattttatccgtgaaaaatcattttttcagtatgaaatatgccgtagtcaagcgtcccgccagttggggcgttttttgtttaaaagcaaaggtttatgaaacaataaaagcgacagacaaacgagaggagtataccattttgaagcgttactttcagtttgaagaattgggcacaaattatcggagagaaatgatcggcggactcaccacatttttgtccatggcatatattttgatcgtcaacccgcttaccctttctctggcgtcggtggaaaatttcccggatgcattgagaatggatcaaagcgcggtctttacggcaaccgcggttgcagcagccgtcggttgttttatcatggggctgctcgcgaagtatccgatcgctctggcgcccggaatggggcttaacgcattctttgcattctcagtcatcctgaatatgcagattccttggcagacggctctttcaggcgttatggtttccggacttatttttatcgttctttcgctatccggtttaagggaaaaaattatcaattcgattccttatgagctgaaaatggctgtcggtgcggggattggcctgtttatcgctttcgtcggtttgcagggctccaaaatcgtcgtatccaacccggatacgattgtgtcgtttgggaatattcattcaggtcccgttcttttgactgttttcggactgatcatcactgtcattttaatggtattgcgcgtcaacggcggcattttcttcgggatgctgatcacggcgattgtcggcatgattttcggacagattgacgttcctgacaaaatcgtcggtgccgttcctagtcttgcgccaacatttggacaagcctttatccaccttcatgatatctttacggtgcaaatgcttgtcgtcattttaacgtttttattcgtcgacttttttgatacggccggtactttggtgggtgttgcatcacaagccggtttgatgaaggataacaaactgccgcgcgcgggaagagctttgcttgccgattcttccgcaactgtggccggagcgatccttggtacatcgacaacgaccgcttatgttgagtcaagcgccggggtagcggccggagcgagaagcggttttgcggcgattgtaaccggcgttttgttcttgctgtcgctgttcttctcgcccgtactcagcgttatcacttcacaagtgacggcgcctgctttaatcatcgtcggcgtgctgatggtggcgaatctcaacaaaatcgactggaccaaatttgagattgcggtgcccgcattcttcacgatgatcgcgatgccgctgacatatagcatcgccaccggaatcgcgatcggatttattttctacccgatcacgatgatttttaaaggcaaagcaaaagagatccatccgattatgtacggactggctgtcgtatttattctttatttcattttcttgaaataggctgtaggaaaaagcgcttgttcatttgaacgagcgcctttttttatttccaattcatcaaaatcggaaccttccgccttcgtttttcgtcatatataagggctgctgcatctatgataaaaagaggtttgtcttgactgttcacacagcttatgtaatttataaaagtgcttttcatttatgtaaagcttttgaatagaagaggagttgcttatatgattgaagaacatcacaaacgaaacgaagatgatatagaacaagaacctgcttcgaggatgtcgaggaattcccggaaaaaagcgaagaagagcaaggagacgaatccgtctgcagcaaaagtcaaatcggtgatggagagtgtgattgccgctttgttccgttatttcagctttgtgctcgatattttaaagtccccggtgcgcactgcacttgattatgaccggtcttattttaagtattccgttatttcaatgacgcttttagctgttttcttttcgctcggcaacttttatcagctgcttgcgggccgggggagaattctcgggttcggcgtgtcggtgccgtttatggaagtgtttttgggtgtgtttatctactgcatggctttcatgttttggatggcggcagcgagctgggctgtatcgaattttatgctcaggtataaagcttcatttttcgatatcacggcaaagtacggctctttactggttccgtttatcgtccctgccgctctgtggatgattttcgcgattatcaacttcacggccgcgacggtgattctctcgatcgtcatctttatgggattgaccttcggcacttttacattgattcaatcaatttatgaaaaaagcgaaaaaccgcggtttgacctgatgtactgcgtgtttaccgtctttttgcttgaattggtattcgttggggcaacttggaagctggtgggcggatacttgctgtcctcgcttatccctgtataaggagatacagccggttctttaagaagaaccggttttttcttaacattaattctgagttgactcataagaataatatgtattatattgtaaccaatcatacgaacggatgggggagtgatcgatggctaactttcttcgaaaagctgtaaagcaaaaaaaggagtatttaatcaggcagctcgcaaaaccaggacggctggacaatttgaaagacctctcgtcatacacgctgagcgatttggaaaaggaacaccggaagctgcacaaattagatgaagttcgtcagcgggatcataaacaccagctctaaggacgttcatttgaacgtcttttttaatggcgtttaaatgctttgaaaccggcagaaaaagggtaaactgatggaagtgagcaatgtcgaaaaattttgtggtgaagcagggccattacaggattgtgtatggagaatttctctagtagaatatgattgctttgcatctaaaggagggatttcaattgcttcactcagcactattgaacggtgtgatcatggttggaattattctggttatcaatattatatatgtaacgtttttaacccttcgcatgatactgactctaaaaggccagcggtatctcgccgcttttatcgggacaatcgaaatgcttgtttacgtcgtcgggctgggtcttgttttagataatttaaatcaaatccaaaacgtgatcgcttatgcggttggatttggaatcggcatcatcgtcggcacgaagattgaagaaaagctcgctttgggctatattaccgttaacgccattacgaaagagcttgatttggatctgccgaaacagctcagggaaaaaggctacggggtcacccattgggtcgtcggcggacttgagggagacagaacggcgatgcagattttgacgccgagaaaatacgagctgcagctgtacgaaacaattaaatcaatcgattcaaaagcatttatcatttcctacgaaccgaagacgatacacggcggattctgggttaaagccgtaaagaaaaggagaattaaagaataatgacaaagccgaaaaaaaagcgctttgaagtaacggaaggcgaaacgatcgaaaccgtgttgacgaagatgcaggaagaaggctacacgccggtgcgccgaatggaggagccggtcttcaaagaaacaaaggaaaatggaacgattcaggttgttccgtgcggaagaaaaattatattcgaagggaaattactctaaacccgaacattagaacaacaaaatatactatcgttcgataatgtcgttgacattatcacagtccgttgttaagataaacatgacatgaaaacacatcctcatataatcttgggaatatggcccataagtctctacccgatgaccgtaaatcatcggactatgcaggaaagtggacaataaactgacatggagatcgcgagaagcggactaactgacgatacacgcgccatgcccggtttgtgttgcttcctacaaatgcaatacatgccgggctttttatttgcgaagaataacagctaaaggtgggacaaaaggatatgcagcctcttcttggtgttatcatgggaagcacatctgactgggaaacgatgaaacatgcctgcggcatactcgatgaactgggaattccgttcgaaaaaaaggtcgtttccgcacatcggacgcctgatttaatgtttgaatatgccgaaaaggctcgggaaagaggcttgaaagtcatcattgccggagcgggcggagccgctcacctgccgggaatggtcgcagccaaaacgacgctgcccgtcatcggtgtgccggttcagtcaaaagcgctgaacggtctcgattcgctgctttcaatcgttcaaatgccgggcggagtacccgttgcgaccgttgccatcggcaaagcgggagcggtcaacgcaggactgcttgcggcgcagattttgtcagcttttgacaaagagcttgccgaaagattggacgaacgaagggaaagcatcagacaaaccgtgttggaaagcagtgatcagcttgtataaacaaacgatttttccgggagcgacaatcggcattatcggaggcggacagctgggcaaaatgatggccgtcgcggccaaacaaatgggctataaaatcgcggtggttgatcctgttccttcatcaccgtgcggccaggtcgccgaccttgagattacggctagctataatgacggggaagcgatacggaagcttgccgaagcgagcgacgtgatcacttacgaattcgagaacatcgattatgacgcgctgaactggctgaaggagcacgcttaccttccgcaggggagcgagcttttgctccttacgcaaaacagggagaccgagaaaaaagcgattgcatcagcgggctgtaaagtcgcgccgtaccggatcattcacgaccgggcggaattggaagcgtccgtagcggagctcggtcttccggcggtgctgaaaacttgccgcggcgggtatgacggaaaagggcagcacgtcctgaaagaacaagcacaaatcggggaagccgcagctcttttacagcacggcacatgcattttggaaagctgggttcctttcaaaatggaattgtccgtgatcgtgacaagatcggttcacggagagacaaccgtctttccggcggcagaaaacatccataaacaaaatattttattccagagcatcgtcccggcccgggtcgatgaggcgattcaggaacaagcggcagcacttgccctcaggcttgccgaaaagcttcagcttgtcggaacactggccgttgagcttttcctgaaggaagacggcggccttctcgtcaatgaactggcgccgcggccgcataattccggccattacacccttgatctttgcgaaacgagccagtttgaacagcatattcgtgcggtctgcgggctgccgctcggtaaaacggatcttctgaaggaagggatgatggtgaaccttctcggggacgaagtgtacatggctgaagaagatcccgaacttttaaaagaagcgaagctttatatatacggaaagcatgaagtcaaaccaggccgcaaaatggggcacatcacatttttaagaacacccgacaatgaatggatcgggcagatgacagaaaagtggattgaaagagatggaggacgaaaacaatgatcgaacgttattcaagaccggaaatggctgcgatttggacagatgaaaacagattccaagcatggcttgaagttgaaatactggcttgtgaagcttgggctgagctcggcgtcattccgaaagaagatgtgaaggttttaagggaaaaagcgtcatttgacatcaaccgcatcttcgaaatcgagcaggacacgcgccatgatgtcgtcgcatttacccgcgccgtatcggaaacgcttggcgaagagaaaaaatgggtgcactacggactgacatcaacagatgtggtcgataccgctctttcttatctattaaaacaggcgaacgagattttgctcaaggacattgagaggtttattgacatcttgaaagaaaaagcaaaggaacataaatatacggtgatgatggggcgcacacacggcgtgcatgcagaaccgacgacattcggcttaaagctcgccctttggtatgaagagatgaagcgcaacctggaacgcttcaagcaagcgaaagaaggcatcgaagtcggtaaaatctcaggcgccgtcggaacgtacgcgaacatcgatccattcgtcgagcagtacgtatgtgagaagctcggcttaaaagctgcgccgatctcaacgcagacgctgcagcgcgaccgccacgccgattacatggctgcactggcgcttgttgcgacaagcatcgagaaattcgccgttgagatccgcggcctccaaaaaagcgaaacacgcgaggtcgaagaatttttcgcaaaaggccaaaaaggttcatctgccatgccgcataaacgcaacccgatcggttcggaaaacatgacgggaatggcgcgcgtcatccgcggctacatgctgaccgcttatgaaaatgtaccgctttggcatgaacgcgacatttcgcattcatcagcagagcgcatcattctgcctgatgcgacgatcgcgctgaattacatgctgaaccgcttcggcaacattgtgaaaaacttgaccgtgttccctgaaaacatgaagcgcaacatggaccgcacactcggattgatctactcccagcgcgtccttctcgctctcattgataccggcatggcgcgcgaagaagcgtatgacaccgttcagccgaaagcaatggaagcatgggagaaacaagtgccgttccgccagcttgtcgaggctgaggaaaaaattacgtcccgactgtctccggaacaaattaacgactgctttgattacaattaccacttgaaaaatgtcgactacatttttgaacgtttaggcttggcatagaatagaccgcccgcttttacaggcgggggtctaagtgcttaaatatttccaacattcgggttaggaggccttctgtgaatattgtgaaaaatgaacttttatacgaaggaaaagcgaaaaagatttaccggacggatgatgacaacactttgtttgtcgaatacaaaaactcagcgacggcttttaacggagaaaaaaaagccgagattgacggaaaaggccgtttaaataacgaaatttccagcctgattttcacaaggcttcacgagaagggaatcaacaaccactttgttgaacgaatttctgaaacggagcagctcattaaaaaagtgacgatcatcccgcttgaagtcgttgtccgcaatgtcgttgccggaagcatgtccaaaaggctcggcattccggaaggcacggagctggggcagccgattatcgagttttactacaaggatgacgcgctcggtgatccgttgatcacagaagaccatatccggattttaaaagcagctgagcctgaacaggtggagaaaatcaaatcgattacgagacaggtaaacgaagagctgcagacgattttcgcggcttgcgatgtcagattgatagatttcaagcttgagttcgggctcgataaagacggcgaggtcctgctggccgatgagatttccccggatacgtgccggctgtgggatcaagaaacgaatgaaaagcttgataaagatgtgttcagaagaaatctgggcggattgacggatgcatacgaagaaatattcaaaagacttggaggcatgtaatatgtacaaagtgaaagtgtatgtcagcttaaaagagagtgttttagatcctcaggggagcgccgttcagcatgctttgcacagcatgtcctacaaagaagttcaggacgtccgcatcggcaaatacatggagctcacaatcgaaaaatcggaccgcgaccttgacgttctcgtcaaagaaatgtgcgaaaaacttttggccaacacggtgattgaagattacagatacgaagtcgaggaggttgtcgcacagtgaaatttgcggtgattgtgctgcctggctcaaactgcgatatcgatatgttccacgcgattaaggatgagcttggcgaagaagctgaatacgtctggcatacagaaacaagtcttgatgaatatgacggcgtcctcattccgggaggattctcatacggtgattatttaagatgcggcgcgatcgcccgcttcgcaaatattatgccggccgtcaaaaaagcggctgaagaagggaagccggtgctcggcgtctgcaacggatttcaaattttgcaggagctcggtcttttgccgggcgcaatgagacgcaacaaagatttgaaatttatctgccgtccggttgaactgatcgtccaaaacaatgaaacgctttttacatcttcctacggcaaaggcgaatccatcacgattccggtcgctcacggcgaaggaaacttctactgtgatgaagaaacgcttgccggattacaagaaaacaatcaaatcgctttcacatacggaacggatatcaacggaagcgtcgccgatattgcaggcgtcgtcaatgaaaaaggcaatgtattaggcatgatgcctcacccagaacgcgcagtcgattctctgctcggaagcgccgacggtcttaaactgtttcaatctatcgtgaaaaattggagggaaactcatgtcgctactgcttgaaccaagtcaagaacaaattaaggaagagaaactttatcagcaaatgggtgtcagcgatgacgagtttgccatgattgaatcgattctcggaaggcttccaaactatacggaaatcgggattttttcagtcatgtggtcagagcactgcagctacaaaaattccaagccgatcctgaaaaagttcccgacaaaaggcgaacgcgtcctgcaaggaccgggggaaggcgcaggaatcgtcgatatcggcgacaatcaggcggttgtcttcaaaatcgaatcgcacaaccatccgtcagcgattgagccttatcagggagctgcaacgggtgtgggcggcatcatccgcgacgtcttttcaatgggcgcgcgtcccatcgctgttttgaactctctccggtttggcgaactcacttcaccgcgtgtgaagtacttgtttgaagaagtagtcgcgggcattgccggatacggaaactgcatcggcattccgaccgttggcggggaagttcagtttgacggctgctatgaaggcaatccgcttgtcaacgcgatgtgtgtcggtttaatcaaccatgaagatattaaaaaagggcaggcgaaaggcgtcggcaataccgtcatgtacgtcggcgcgaaaacggggcgcgacggcatccacggcgcaacgttcgcctcagaggaaatgtctgaccaatcagaagaaaagcgctcggccgttcaagtcggcgatccgttcatggagaagctgcttcttgaagcgtgtctggaagtcatcaaatctgacgctttggtcggtattcaggacatgggtgcggcaggcctgacaagttcaagcgcggaaatggcatccaaagccgggtctgggatcgagatgaaccttgacttgattccgcagcgcgaaacaggcatgacgccgtacgaaatgatgctttcggaatcccaggagcgcatgcttttggttatcgaacgcggccgcgaacaggaaatcatcgatatttttgacaagtacgatcttgaagccgttgctgtcggccatgtgactgatgacaagatgctgcgccttttccataacggagaaatggttgccgagcttccggtcgatgctcttgcagaggaagcgcctgtttaccataagccgtcaaaagtaccggattattacaaagagttccttgaaacagacgtccctgcaccaaaagtcgaagatgcgaaagaaacgcttctcgagctgctaaagcagccgaccattgcgagcaaagaatgggtttatgaccaatatgactacatggtcaggacgaacacggttgtcgcaccgggctctgatgcagccgtcctcaggattcgcggcacgaaaaaagcgctcgccatgacaacggactgcaatgcccgctacttgtaccttgatccggaaacaggcgggaaaatcgccgtcgcagaagcggcccgcaatatcgtctgctccggagcagaaccgcttgccgttacggataacctcaactttggaaatccggaaaagccggagatcttctggcagatcgaaaaagcggcagacgggatcagcgaggcgtgcaacgtgctcagcacaccggtcatcggcggaaacgtctctctctacaacgaatcaaacggaagcgcgatctacccgacgcctgtcatcggaatggtcggactgatcgaagatacggagcatattacgacacagcactttaaagcagcgggcgatttgatttatgtcatcggcgaaacattccctgagttcgccggaagcgagctgcaaaaactgaccgaaggaaagatttacggcaaagcgcctgcgattgacctggaagtcgaacaatcgcgtcaaaaagctcttctgaaagcgatccgctccggactcgttcaatcggcgcatgacgtctcagaaggcggcatcggcgtggcgctggcggaaagcgttatatcttctcaaaggctcggcgcccatgtgacgcttgcaggcgaacctgcattgttattcagcgaaacacaatcacggtttatcgtctctgtgaaaaaagaccatcaagaagcgttcgaaaagcttgtcaaagacgccgatctaatcggtgaagtaacgtcagacagcgtgctggctgttcaaagccaggaaggacaacaatggattcatgcgcagacagaagagctcgaaagcgcatggaaaggagctatcccatgcttgctgaaatcaaaggcttaaatgaagaatgcggcgtatttgggatttgggggcatgaagaagcaccgcaaattacgtactacggccttcacagccttcagcacagaggccaggagggcgccggcatcgtcgcgacagacggcgaaaaaatgtccgcccacaaaggccaggggctgattaccgaagtttttcaaaacggtgagctcaaaaaggtgaaaggaaagggagcgatcggccacgtccgctatgcaacggcgggcggcggcggcttcgaaaacgtccagccgttccttttccattcgcaaaacaacggcagccttgcgcttgcgcacaatggaaacttagtgaacgccactcagctaaaacagcagcttgaaaaccagggcagcatttttcaaacgtcttcagatacggaagtgctcgcccatttaattaaaagaagcggccacttcgagctgaaagatcaaatcaaaaacgctctttctatgctgaaaggcgcttatgctttcctgatcatgacggaaaaggaaatgatcgtggcgcatgatccgaacggactcagaccgctatctgtcgcaatgcttggcgacgcgtacgtcgtcgcttctgaaacgtgcgcatttgatgtggtcggcgcgacatatctgcgcgatgtagaaccgggcgagatgctgatcatcaatgatgaaggcatgaagtcagagcggttctccatcaacatcaaccgttcgatctgcagcatggagtacatttatttctcaagacctgacagcaatattaacggcattaacgtccacagcgcgagaaagaatctcggcaaaaagctcgccgaggaatcaggcattgaagcagatgtggtgacaggcgttcctgactcaagcatttcagcggcgatcggctatgccgaagcgacgggaattccttacgaactcggattgatcaaaaaccgctatgtcggcagaacgttcattcagccgtcacagtcgctcagggagcagggcgtgagaatgaagctgtcagccgtccgcggggtcgttgaaggaaagcgcgtcgtcatggtggacgattcaatcgtgaggggcacgacgagccgcaggattgtgacgatgctgcgcgaagccggagcgacggaagtgcacgtcagaatcagttccccgcctattgcccatccgtgcttttacggaattgacacatcgacgcacgaagaactgatcgcgtcctctcattcagtggaagaaatccgtcaggaaatcggcgccgatacattgtcattcttgagcattgaaggactcctttccgggatcggaagacagtatgaaggtgaaaactgcggccagtgcatggcctgttttacaggaaaatatccgaccgaaatttatcaggatactgttcttcctcacgtgaaagaaatcgttttgacaaaataaaccggccggcgcgattgaagcgcctggcctgctgaaatgaataaagggcagcagaggcaatgcggctgctcttttgattttgaatatcacgaatggacaagcgcggaataaggagtgattgtgttgtctgaaagctataaaaacgccggggttgatattgaagccggatatgaagccgtaaaacgaatgaaaaaacatgtggaaagaacgaagcgaatcggcgcaatgggcggacttggcgggtttggcggcatgtttgacctgtcggaactgccgtacaaacagccggttctcatttcgggaacggacggtgtcggcacaaaactgaagctcgcttttgcgatggacaagcatgacacgatcggcatcgatgccgtcgcgatgtgtgtcaacgatgtgctcgctcaaggagcggagccgcttttcttcctcgattaccttgcggtcggaaaagccgatcccgtcaaaattgaagagatcgtaaaaggcgtcgcagaaggctgcgtacagtcgggatcagcgcttgtcggcggagaaacggcggaaatgccggggctttatacagaggatgaatacgatatcgccgggttctcggtcggagctgccgaaaaagatggcatcgtcacgggcgaaaatatcagcgaagggcaccttttaatcggactttcttcaagcggccttcacagcaacggcttctctctcgttcggaaagttcttcttgaagatgccggtctgaaccttgatgagacgtatgcaccttttgaacggcctcttggcgaagagcttttagagccgacgaaaatctatgtcaagcctgtccttgaagcggtgaaatcaggcaaaatcgccggcatggcgcacgtgaccggcggcggttttatcgaaaacctgccgcgcatgatgcccgatggcctcggcgttgaaatcgacatcggctcctggcccgttcctcctatcttcccgttcattcaggagaaaggcggcctgaaatccgaggaaatgtttaatgttttcaatatgggaatcggctttgttcttgcggtgaaagaagaggatatgacagacgtgatccaaacgctcgaaaacaacggtgaaaaagcctatctcatcggcagagtgaaagccggaagcggcgttgtgtttggcggtgccggtctttcatgaaaaaattcgcggtatttgcatcaggaagcggaacgaattttgaagcaatcgaaagaagaatgagagaagagaactgggatgccgaaattgtcctcgtcgtctgtgacaagcccgatgcgaaagtgcttgaaagggcggaaaaagccggaatcccgtcgttcgccttccagccgaaatcgttcgacaataaagctgcatttgaacaagtgatcgttgaacagctccgccttcacggagcggaatggattgtgctggcggggtatatgaggctgatcggcgatacgcttctttcggcttaccggaataaaatcatcaacatccatccgtcgctcctgccggcgtttcccggcatcgacgcggtcggacaagcgtacagagcaggcgtgaaagtggcaggcatcacggttcactacgttgacgaaggcatggacaccggtccgattatcgcccagcgcgccgttgagcttgaaaaaagcgaaacactcgcgtctcttgaagaaaagatacacaaattggagcatgaactttatcccgaagtaatcaaagagcttcttgaactaaatggcagaggtgaaaaggaatgacgatcaaacgcgcattaatcagcgtatctgataaaacgaacattgtcccttttgtaaaagaattgacagagcttggcgttgaagtgatttcaacagggggcacaagcaaacttcttcaggaaaacggcgttgacgtcatcggcatttctgaagtgacgggctttcccgaaatcatggacggccgtctgaaaacccttcatccgaatattcacggcgggcttcttgccgtacgcggcaacgaaaagcacatggcgcagctgaatgagcagggtatccagccaatcgaccttgtcgttgtcaatttatatccttttaaagaaacggtttctaaagaagatgtcacattcgaagaagcgattgagaatatcgacatcggcggccccggcatgcttcgcgctgcagcgaaaaaccaccaggacgtggcggtcatcgtcgatccccgcgattacagccctgtgctgaacgacttgaaagaaaacggcagcgtctctcttgagaaaaaacgcgagcttgcggcgaaggtgttccgccacacggcagcatatgacgcgttgatcgctgactatttaacaaatgtaaccggtgaaaaagagcctgaacagttcaccgtcacttttgagaaaaaacaatcgctccgctacggcgaaaatccgcatcaggaagcagtcttttatcaaagcgcgctccctgtcaaagggtcgatcgcttcagctgaacagctgcacggaaaagagctttcctacaacaacatcaaagacgcggatgcggcacttcaaattgtccgcgagttcaccgagccggctgcggttgccgtcaagcatatgaacccttgcggcgtcgggacgggcaacacgatcgaagaggcgtttaacaaagcatacgccgctgacgaaacatcgattttcggcggcatcatcgccctgaaccgcgaagtggacaaagcgactgctgaaacgcttcacaaaatctttttggaaatcattatcgcgccggcattcagccaagaagcgcttgatattttaacatccaagaaaaaccttcgcctcttgaccctcgatgtcaatcagcctgtgaaaaacgaaaaacagctgacatctgttcaaggcgggctcttgattcaggatctggatatgcacggctttgacgacgctgacattacgattccgacgaaaagggagccgaccgaacaggaatgggctgacctgaagcttgcttggaaagtcgtgaagcacgtcaaatcgaatgcgattgtcctggcaaaggacgatatgacgatcggcgtcggcgccgggcaaatgaaccgcgtcggctcggcgaaaatcgcaattgagcaagccggggagaaagcaaaaggaagcgcgctcggatcagatgccttctttccgatgcctgatacggtcgaagaagcggctaaagccggtgtgacggcaatcattcagccgggcggctcggttcgtgatgaagattcaattaaaaaagcggatgaatacgggatcgcgatggtgttcaccggaatccgccatttcaaacattaagggagtgaccagcgtgaacgtattgattatcggcagaggcggcagggagcacacgctcgcctggaaagcggcgcaaagccctcttgtcggcactgtatatgcggcgcccggcaatgacggaatggccgggaccgccgtactcgttgatcttgacgaaggcaatcacgaagggcttctcgctttcgcaaaggaaaacaatatcggactgacgatcgtcggtcctgaggtccctttaatcgaagggcttgttgatgcatttgaagaagcgggccttccggtgtttggaccgtcgaaaaatgcagctgtgattgaaggaagcaagcagtttgccaaggatcttatgaaaaaataccagattccgacagcagaatacgaaacgtttacatcttttgaaaacgcaaaggcgtatgttgaggaaaaaggcgctccaatcgttattaaagccgacgggcttgccgccggaaaaggcgtcacagtcgcgatgacagccgaagaagcggttcagtgtctgcatgactttttagaagatgaaaagttcggcgaagcaagcgcatctgtcgtcatcgaggaatttttgagcggtgaagaattttcgctgatggcttttgtcaaaggtgagaaagtgtatccgatggtgattgcacaggatcacaagcgggcatttgacggagacaagggcccgaatacagggggaatgggcgcgtattctccggtgccgcagatttcggatgcggtcgtcgaagacgccgttaaaacgattttggagccggcggccgaagcgatggttaaagaaggccgttcgtttacgggagtcttgtatgccgggttaatgctgaccgaaaaaggaacaaaagtgatcgaattcaacgcgagattcggggatcccgaaacccaggtcgtcctgccgcgtcttgaatcagaccttgtccaggtcttggttgatctcctcgcagacagagaagtggagctgaagtggaaggatacggcggcagtcaccgttgttcttgcatctgacggctatccggaaagctatgaaaaaggcgcgccgatcggcacgcttgagcctgacatggagcagaccgtcgtctttcacgcaggcacgaaaaaaagcggcgatcagtttgtgacgaacggcggccgcgtcgccaatgtcaccgcgtttgcagagacgtttgatgcggcaagggaagcagcctatcaagcggtggatcgagtaagaaaaccggggctgttttaccggatggacatcggctcgcgtgcgctcaaggcagcacagaaataataggtgaagagacagagcgggagcacccgttttgtctctttttttgagctcaatttttttggatgatcttgatcatcgattcagccatcaattcgggcggataaggcatgccgttttcaagccaccatgcggctgtgcccgcaaaggcggaaatcacaaaccgccgctgaatgtcgagaggcactgagcggtcagtatcagcagctgccgtttttttgattcccgtcaaaaagctgtcattccaaaaatcattgagcagctccttaatgttcagctcatatcttctgttgatgataatcgcaaaatcgccgctgttctgttgcaaatgatgataaaagcgcagcacataccagtacgcttctggctttttcccgctgctatctatatcaagcggcgaaaaaatatcctctttcatcgcctcaaacatatccctcatatgttgatgaagcaaatcgtatttatcttgataatgctgataaaatgtcgttcgattcaagtttgcccgttgcgtaatatcctgcacagagatttttccccattctttttcagcaagcagttcaaacaaggctttttttaagtttgttttcgattttgtgatccgcttgtccccgcggtagctgtcagccaattcagccgcctcctcaatcactttttcgacacttctttgccatttgttggttgaatggccagatggaatctattaatttaaaactaacatattgaacttcatgaatcagctgacaagcaaccgaaggagtgaaagcgaatgagtcaaacaaaacagcagaaccccattcagaaagcgctgattaacggaaagaacagacaagacccgtatgatccgtttccgtggtataaaaaaatgcgcaccgaatcaccgattcactatgatgaagacagcaaagtgtggagtgtgttccgctatgacgatgtcaaaagagtgatcagcgacaaagactttttttcaaatcaattccctcagcttggaactggcaatacgtttgcgaaaacgatgatcagcatggatccgccgaaacacacgagaatcagatcgatcgtcaacaaggcttttacaccgcgcgtcatgaaggagtgggagccgcgcattcgcgaactgacgaatcaattgctcgctgatgtccgcggcagggaagagatcgaccttgtacaggatttttcatatccgttgcccgtaatcgtcatttcggaattgctcggcgttcctttggtgtataagcatcatttcaaagaatggtccgacctgttggtcagcctgccgaagagcgatcggccggaagatgtgaacgagtggaaaaacatcagggaccaaggcgaagaagagctgaccgcattctttgaaaagatgattgaagagaaaagacaaaacctcggcaatgacctgatttcgcttttgatcaaagccgaacaagaaggggacaagctgtcccctgatgaattggttccattttgcaatctgctcttgatggcggggaatgaaacgacgacgaatttagtttcaaatgcggtctacagcattctcgaaacaccgggcgtgtatgacgagctcgccaggcatcctgaactgattccgcaggcagtcgaggaagccgtccgtttccgggcgccagcgccgatgattgtgcgcttcgttaaacaggataccgagatcagaggagtaagcttgaaaaaaggagaaggtgtgatcgctttccttgcttctgccaaccgtgatgaaacgaaatttgagagggcgcacgaatttgatattcaccgccatccgaacccgcatatcggatttgggcacggcatccacttttgtttgggcgccccgctcgcaaggctggaagcggcgatcgccattgaggcgctcttaaagcagtatgcctcgatggaaaagcttgcggtcgtgccgatggccgacagcagcatgtacggcttgaaacatttccgtctgcgggtgaagtcagcaggggaaacggcgcctaactaattagaaaagcaccgaaaaggtgctttcagcgtgtcgacaaaccctcgcattcgttgtcaggcctgctaagtcggtgctcacgaatagaggaaggatcggcggctaaccgcccaggcgtcctgcctgaacgccgccgtcatcacctcctgtgaaagtccgctccgatgctcggccttcctagactgcaaggttttcaatcacgctgaaaaggtgacgaaatcctaaaactttaaaccgttttaggatttcgtcaacaatctgccaccttctttcccaagaaggtgtttttttacggacagggcatttctttcattgcataagccggtcagcaggaatttgactggataagcctcgtgctttaaaatgaaagtaataaaaatgaatactccaaaggggagtagctgtcacagtaaagtcgtcattacgggatgtcctagatcctcggctttactggcaatctaattgttagcgagacctttgccaaatctgatttggtgaaggtctttttgtttatccacttcaccaaatcggtggagttttttcatttttatcaaaagggaaaggagactgaccgtgtctaagctcgggaaatggctgaagcgtgaattggtgaagaaaggtctgcctttggcgaaagaaaaattaattccgattttgaaagaaaaaatgaaaaagaaacgataaggaggcaaacaatgaaaagaattcttatagttcttgccggaattggccttttaggtgcgggcggatgcggaatgcttgatcaggtgaatgacggattgaactatacaaatgaagcggccggctatatccaaaaagtgaagacatttgcggaggaggcgccttccttggctgaacaggctgtaaacgacacgggtgcaaaagaaaagctggaaactcagcttgagtctatccagcaggctgcagccgattttaatgaattaacccctcctgatgccgcagccgaggttcataacaccatcgagaagcataatgaaacactgcaaaaaagcgctgaggatgttttgaaaagtgttgaggaaggaaaattaacagtcgagaagctggagcagtcagaattggtgcaaagcgctcagcagatcagcgatgtgatgggccagattgaaaaattgaccgaatagaaaaaagcatcccggtttgggatgtttcggcttgtcgacaaagtcataaaaagtggcttcatcgacaagcttttttaaaaaaatgtgagtggaatctagattatgttgcccaagcactcaaaagatcagcgtaaacagcttgaagtcgttgccttaagtgaacttgtccctgaagatcaactggtcaggaagatggaagaagccatggatttttcatttatttatgaaaaagttgcccctctttattcttcaaaagcacgtccaagcattgatcccgttgtattgatcaaaatggttctgattcaatacgtgtttgggcatcgctccatgcgcgaaaccatcgaacgggtttttgcggatttaaaacacaagcgtggcctgcgctggacaaccctgcggggaaagaaaaaattgtccatgcaggcgatgcttgttttcgctgccatgaatctaaaaaactggcgaattggacgtggaaaggccctaatcgccagccttttcatcgaaaaaacaaaataaactggacaaaaataggtcggatcttagaaatccgacctattttgtcaacggtctgaaagcacctataaaaggtgctttttatgattgttcgccagtctctccctgttgcttcatatacgtttggcaaacatatgtcatgggacaaaatcgtaaaatgccggaagcggccttcatcgcccccataaacatgcagaaaagcgtcattctgcaccacggttttctcgtaaactttgccgctgccgccgacaggatcgtcagtccgcaggcaatgcgaaaaacggcgtcaaacagtccgatgttttgcttcatactttattcctcctatttaaataattaaataaagtgttttttcaaaaaattgtaacggattggtaatgcgtgacgatagtaaatgtgttaacataggatcattacatgtaaaggagagtatgtgaatgtccgaacgcaccttaatttggaaaaacaagcacatcagatcgcaagttgatgttgtaagttcaaggctgcagccaacgctccttttacgaaatgcatctgtactgaacccgtatgtaaagcaatggattccagcaaacgtatggattcatcatgacagaatcgtttatgtcggccgtgacttgccgaagacggctgttaaaactacaatagattgtgaaggaaaatacattgtacccgggtatattgagccgcatgtacatccttttcaaatttataatccccaaactttggccgaatatgtgtcacagtttggaacgaccacattcgtaaatgacaacttgtttctgcttttacattgcggaaaaaagaaagcgttttctatactggaggaactgaaaaaacagcctgtccactactattggtggtcaaggtatgacttgcagaccgaagtgttgaatgaagatcaaatcttatcgatcgattaccgaaaacattggggagaacacccggatgtcatccagggaggagaaatgacaggctggccgcgccttttggacggcgatgatctgatccttcattgcatgcagtgcacgaaaagaaggagaaagcggatcgagggccattttccgggggcatcggaaaaaacgctgacgaagatgaagcttttcggcgctgacgccgatcatgaagccatgactggaaaggaagtgctgaagcggcttgaacttggttaccacgtcggcttgaggcagtcttccatccgccctgatttgcgaaaaattttgcgcgagctgcacgaagaaggctttcaccattatgaccatatgttttatacaacggacggcgcaacgccgaacttttataaagaaggcatgacaaacaagctgattgaaatcgccatcgaagagggcgtgccgctgatcgacgcctataatatggcttcgtttaatatcgcgaagtattaccatatggaggacatccttggggtggttgcaccgggcagatacgcgacgctcaacattttgaatagccctgatgaaccgaatccggagacggttttggcaaaaggtcggctgatcaaatcaggcggcataaatatgaatgcgttttcagttccggattggcaaaaagggggtcttgtccctctgaacctttcatatgatctaacgatggatgatttgcagttttccatgccgctcggcttgaaaatgaggaattccgtcattatggagccttatacgattgagattgacaactctgtgaaccagctttcttttgatcatgatgaaagctatctctcgctgttcgacaaatacggaaagtggcgtgtcaatacgatgctgaaaggctttgcaacccgcatccaaggtttcgtcagctcctattcgacaacgggagacattatcgcgatcggcaaaaacaaggaagacatgcttttggccttcaaacggatgaaagaaatcggaggaggtatcgtattagcggaaaacggaaaaattctgcacgaaattcctcttcatttaagcggcggcgcatcaattgagacgtatgaaaaggtgcttgaaagggaaaaagcgttaaaagagcttctgtttgaaagaggctatacgttcgacgacccgatctacaccctgctctttttgcaaagcacccatctgccttatatcagggtgacgccgaaagggatctttgatgtgatgaaaaaaactgtactctttccatcgataatgcgttaaaatataaaagagcgggagctaatctatggtgaatcgatatgtaagagtactgctttgttttgcttcgcttttactgcttgcatcgtgccagtcgcaggaacagcaggaaaaggaaaagaacattcatccgctgacagggttgaaggcggacggagatattcggcagcggcccattgccgttgtggtgaacaatcattcaaaagcaaggccgcagtcgggattaagcaaggctgacattgtcattgaagctctcagtgaaggaccgatcacacgattgttggcgatctatcaaagcgatatgcctgaagcggttggcccagtccgcagcgcccgggagtatttcattgatttggctctcggttttgacagcatccttgtgcatcacggctggagtccgggggcaaaagaccgcctgttgaacggcgacgccgatcatatcaatggaatggatcacgacgggaccctgttttggagagccgattttcgggaagcgccgcataattcgtacacatcatacaaaaacgtaaagcaagcagcagatgacaaaggatatgccatcgaaacccgcacagaaccgctcacttttaaagcaagccctgataaaccttcggatgcgctttattctatacggttagattatggaacaaaatccgttacaaaccgtgtcgaatatggttatgataaaaaggttgaaggctatgtgagaaagtcagacggcgttttgacaacagaccttgaaacagaagaaccggttgttcttcaaaacattctaatagcggaagccgaacatcatatgaaagatgcgtacgggagaagggatattgaccttcgttcaggcggaaaaggactccttctgcaaaacggggaagtccatcggatcagctggaagaacgaaaacggccggatcataccgacggcggacggcaaaaccgttccgttcgtgccgggaaaaacgtggatcaatatcgttcccgatctcagcaaggtttctattagcaaaggagaaggtgtgtaaagatgcagatcgataaattgcgcgggagagagctggaccagctttttcaatccatactatcactaaaagatctcgaagaatgctatcgttttttcgatgatttatgcacaataaatgaaattcaatcattggctcagcggctcgaagtagccagaatgctgcgcgacggcaacacgtatcataaaattgagacggaaaccggagcgagcaccgcgaccatttccagggtaaagcgctgcctgaactacggaaatgacgcttatatcatggcgctggaccgcgtcaaagcaaatcaatctgaatcatcttcatgatgtcatgaaaccgcctggctcagggcactgagcaccggcggtttttttgtgcttctgcccgtttatcgtttatttgttatccgtttttcgaaaggggctgaatttgttataatatttaaatggtaagaacgcgaatggaggagctttttcatgtacgatattaccgagtggaagcacgtctttaaactcgatccgaataaagatattacggatgatcagcttgaacagctgtgcgaatccggaacagacgcggttttgatcggcggaagcgaccatgtcacagaagatgacgtccttcggctgatgtcaaaggtgcgccgctttttagtgccgtgcgttcttgaagtatcgacgatcgatgcgatcgtcccggggtttgacctctattttattccgactgtgctcaacagcagggatacagactggattgccggcttacataaaaaggcgatgaaagaatacggcgagctgatgtcgccggaagagattgttgttgaagggtactgtattttgaatcaggactgcaaggctgccgctttgacgaacgcagataccgagcttgacattgaggatattaaagcgtacgcccgcgtagctgaacatcttttccgccttccggtcttttatcttgaatacagcggcatgctgggtgattcagagaccgttaaggaaacgaaagccgtgcttcaggaaacgacgctgttttacggcggcggcatcaaagatgcggagacggcggttaaaatggctgaacacgccgatgtgatcgtagtcggaaacgcgatttatgagaacttcgaagaagcgctgaaaacggtacaggccgtaaaaggatgagcacaacgaaccggattggtttataatagaacatatgtttgaataggcggtgaacggaattgaattacattagcgaccaattattaagcggattgaacaagatgcagcaggaagcggtcaaaacgacggacggtccgcttttgatcatggcaggagcaggaagcggaaagacgcgggtattgacgcaccgcattgcgtatttaatggcggagaagcgcgttgccccgtggaacatactggcgattacatttacgaacaaagcggccagagaaatgaaagaacgtgtggaaagcattctcggaccgggagcggatgacatctggatttcgacgttccacagcatgtgcgtcagaattttgcggagagacatcgacagaatcggcatcaaccggaatttctcgattcttgatacgtctgaccagctttccgtcattaaaggaatcctgaaagaaagaaacatcgatccgaaaaaattcgatccgagaagcatactaggatcgatcagcagtgcgaaaaacgagttgatcgccccggaagaatacgagaaaacagccggcggtttttttgaacaagtcgtcagcgatgtctacaaagattatcagaagaaactgcggaaaaaccagtcgctcgattttgacgatttgattatgacgacgattgtcctgtttgaccgggtgccggaagtgcttgaatactaccagcggaaattccaatacattcatgtcgatgagtatcaggatacgaacagggcgcagtatttgctcgtcaaaaaaatggcgcagcgcttccaaaacatctgcgttgtcggggactccgaccagtcgatctacagatggcgcggagcggatatcgccaacatcctgtcgtttgaaaaagactatccgaatgcgagcgtcattctgctcgaacaaaactacagatcgacaaagcggatattgaacgcggccaatgaagtgattcagaacaactcaaacagaaagccgaaaaacctctggaccgaaaatgacgaaggggcgaaaatctcctacttcagaggcgacaacgaatttggcgaaggccaatttgtcgcgggcaaaatcagggagctcgtcggctctggaaaacgatccttctcagatatcgcgattttgtaccggacgaacgcccagtcgcgggtcattgaggaaacgctgatgaaggcgaacatcaactacaacatcgtcggcggcacgaagttctatgacagaaaagaaatcaaggacatcctcgcgtatttgcgcctcgtcgcaaaccctgacgacgatatcagctttgcgcggatcgtgaacgtcccgaagcgcggcgtcggtgcgacttcagtcgataaaatcgcggcctatgccgacatgaacggtatgtctttatttgaagcgctcggccaggttgactttatcggcctcagtgctagagcggccaacgcgcttgatgagttcagacagacgatcgaaaacctgacgaatatgcaggaatacttatccgtcacagagcttacggaagaaatccttgaaaaaaccgaataccgcgaaatgctgaaagcggaaaaatccttggaggcgcagagccgccttgagaatatcgacgaatttctctccgtaacgaaaaactttgagcagcaaagcgaagacaaatcgctcgtcgcttttttgaccgatttggcgctcatcgccgatatcgatcagcttgatcagaaggaagaagagaccggaaatcaagacgcggtcatcttaatgacgcttcatgctgcaaaaggactcgaattcccggtcgtgttcctgatggggcttgaagaaggagtgttcccgcacagccgctccctgatggaggaagcggagatggaagaagagcggagactcgcgtacgtcggcatcacgagggctgaggaagaactttatttaacgaacgcgcggatgcggacgttgttcggaagaacgaatatgaacccggaatcaaggttcattgcggaaataccggaggaattattggacaatctaaacgagaagaaaaaagatctgaaaacgccgtttggaagaaagcccgagcggagaggccccgttacccgtccggctgcatcgtacagcaaaaccggcggcgacggcgtcaattgggcagtcggcgacaaagcctcccataaaaaatggggcgtcggaaccgttgtcagcgtcaagggatccggcgaatcgacagagcttgacatcgcctttccgagcccgaccggagtgaagcgtcttctcgcggcctttgcgccaattgaaaagcaataatggcaaaagacctgaaatgaaaggacgaaaccaatggaaaaagaagcagctaaacgccgtgtggaacaactgcatgcattgattaacaaatacaactacgaatatcacacccttgacgatccaagcgtgcctgattccgaatatgacaagctgatgaaagagctgattgctcttgaagaagagcatcccgacctgaaaacgccggactctccttctcagcgcgtcggcggagccgttttggacgcctttcaaaaagtgcagcacaaaacgccgatgctgagcctcggcaacgcgtttaatgaagaagatctgcgcgactttgaccgccgcgtccgccaggcggtcggagacgttgaatacaacgtcgagtttaaaatagacggtcttgctgtttcactgcgctatgaaaacggcgtatttgtcagaggtgcgacgagaggcgacggtacgacgggcgaggatattacggaaaatttgaaaaccatcagaaacattcccctcagaatgaaacgcgatctttctattgaagtgcgcggcgaagcttttatgccgaagcgctcctttgaactgctgaacaaagcgcggatcgaacgtgatgaagagccgttcgccaacccgcggaacgccgctgccggttcattaaggcagctcgatccgaaaattgccgcgaaacgaaatctcgatatcttcgtctacagtatagcggagcttgatgaaatgggcgttgaaacgcaaagccagggactcgatttcctcgacgaactcggcttcaaaaccaatcatgaaagaaaaaaatgcagcacgatcgaagaagtcattgagattgtcgaagagctcaagacaaaacgcgccgacctcccgtatgaaatcgacgggatcgtcattaaagtcgattcccttgaccagcaggaagagctcggctttacggcgaaaagcccgcgctgggcgatcgcctacaagtttcctgccgaagaggttgttacgacgcttttggacattgaattaagcgtcggccggacgggcgcagtgaccccgactgcgattctcgaacctgtaaaagtggcgggaacgaccgtccaaagagcttctctccacaacgaagatttaattaaagagaaggatatcagactgctggacaaagtcgtcgtcaaaaaggcgggagacatcattccggaggtcgtcaacgtcctcgtcgaacagcggacgggcaaagaaaaagaattcaacatgccgaaggaatgcccggaatgcggaagcgagcttgtcagaatcgaaggagaagtcgcgcttcgctgcattaatccggaatgtccggctcagatcagggaaggcctgatccattttgtttcccggaatgcgatgaatatagatggtctcggcgagcgcgtcatcacccagctgttccgcgaagacctcgtccataatgtcgccgatctgtataagctgacgcgcgagcagctgatcaatctcgagcggatgggggaaaagtcgaccgacaacttattgaattcgattgaaaaatcgaagaagaactcattggaacggcttctcttcggactcggcatccgcttcatcggcgccaaagcggccaagacgctggcgatgcattttgaaacgctcgataagcttaaaaaagcgacaaaagaagaattgatcgaagtcgatgaaatcggcgacaagatggcggacgccctcgtcacctattttgaaaaagaagagattctgaagctgttggacgagcttgaagaactcggggtcaacaccgtgtataaaggcccgaaaaaagcggccgctgaagcgagcgattcgtattttgcggggaaaacgatcgtcctgaccgggaagctcagcgagatgtcgcggaatgacgcgaaagcggaaatcgaagcgctcggcggaaaaatcacaggcagtgtaagcaaaaaaaccgatctcgtcattgccggcgaagcggcaggcagcaaactggcgaaagctgaagacctaaacatcgaagtatgggatgaggcaagactgatcagtgagctaaagaaataagaggagtgttttctattgaaaaagatattatgtttggcggctgctgcgggtatgctcatgctctcagcctgtgcgccgaattttgggggagaagaagagcaggagatggtgcagaaaacggataagtcgaaagaaaaagccatcattccgaaatacaacatctccgattcttattataaaatggttcttcctttcaaggcggggaaagcccgcggcttgacgaccgaacgcctgaatacgcggctggatatcgatgaatttgagacaggcatgatgcgccttgcgcaagattcattttctactgacgattacctttttcaagaaggacaatacctggatgaggatacggtatcgagctggctcgcccgcaaaaaaacgggggacgacttgaaaaaagcggagaaagacgataaaaacttcaaaaacctcggactgaacccggccctttccggaagcggatcaacagagaagcaaaacgaagaaagcccgatatacctcgcccatatgcttgagcacgactacctcgtccgcaaagacaaggatacgattgagctcggaggcgtcgtgatcggccttgcgctgaactctgtccactactaccgcgaaaatgtcggcgacccgcaaaaagaagtgaccatcagcgacaaaaagctgaggcaggaaggcgaaaaaatcgctgaagaagtggcgaaacggatcagaaacatggatgatctaaaaaatattccgctgacgatcatgctttacaagcaggcgcctaagtcatcgatcgtccctggaaactttatcgccaaaaccgatgtgaaagcagggacaagcgagatcggcggctgggataaaatcaatgaagagtacacgttcttcccttcaacagaaggttcggagaagcatccggatgacgcggagctcttcaaacgctttaaaaacaaagtcgatacgtattttccaaactacacaggggttgtcggcacggctctctataaagacgaccaaatgcaggacatgaaaatcaacatcccgatgcagttttacggcaaaagcgaagtcatcgcctttacccagttcttgaccggtgaagtgatggactactacggcaaaagcggactgaacgttgagatcaacattaattcgtcagccgggcaggaagccgtcattctgaaaaagccgggagacaaagaaccgaccgtccatatttatgattcataaaaaagaagcagccctttggctgcttcttttattacgcagaaaagggatatggagacctatcattcatttatgaagcaccaacaaatttttcttaacgtattctgaataaaatactattgcaaaattaggacacaactcttataattgattatacagaatatagtatattgttttaaggaagattaattatgtgggaaaaattttactctaaaaatggtttggcagctaaaaatattgctaaagaattgatgaatatcaaagcaggtgaaaaaattccccgtatctcagactactgtcataagttatccatcggcagggggactgtgcaaagtgcgctgaatttattagttgatatgaaagcgattcaattggaggctagagggcatttaggaacgtttttggtaagtaaggataacaatttattacttgagattgcaggtattgcaccattaatcggctcaatgccacttccgtattcaagaaaatatgagggtctggcaacagggattgtggaagggtttgaatcaaccggaaaaacagttaacttgatctacatgcgtggcggagtgaatcgaatcgaagcagtccgaacaaaaagaagtgattttgcaattgtttctaagatgacggcagatcatatcatagcagaatatccaaatttgaaaattttcaaaaaattcggggaaagtagttatgtatcttcccataaaatcttcttagctcatccagatgaggaaataggcaaggatggcgtaagagtaggtgttgatttggaatctctagatcagaaacaattaacattggctgaatttgaaaacaaaaatgctgaatttgtcaatgtgaattatatgcagctctttgatatgcttctttcaaaacaaattgatgcagcagtttggaatgctgatgacaaaagaatgattcaaacgtttaaagcaatcgattttttttcaccgaaagcaaagaaaatttccaaggatacaacagaagccgttattgttattgaaggagacagagaaaaagaaatagcagaaaagtggaatttggttaatgagaaacagatattagacacccaaaaaagcgtagaaaagggagagaaaataccgcgctactaaaatgccggcccatccgacttgtcattcaataaatgaggcgatgggttagcatttaaaatctaatttaaaatactaaatacagtatattggaggaactggcgtgaatcaaatacagctggaagaaaagttgtctattttactaacgagtcgagtgattacaaaaaatgctttcaacacaacattgaacacatttgttttcttatcagaaaagctgaaaaaggaggtgatcaaagactctgaaatgttttggacgcacatggcgatggctttaactagaattaaggagggagaaagcgaagaagttcctgcaaatgccatcatcaatgaaatgtatgaaacaccatataaaagtgcaatagaagaagtgatagactttatacattcactggcaggtctagaacttccagaaggtgagctcgtttatttttatcttcatcttcataaagtcatagaatctaataaataggaggattttattatggtgagaattgtaataggcggacagttgaaaaaacaagcgattgaaaaacttgttaaagaaattgggggaaataatgtagaagtattggtcaaaggtgatttggacgctgttatggctgtgaaaaacaataaggcagattattatattggcgcctgtgaaaccggatctggcggtgctcttgcaatggcaattgcattattaggtaaagataaatgcgtcaccttggcttctccaagtaccataaaaaacaaggaagagatcgagaaggaagtagaaagcggcaaaattgcttttggtttcaccgcttcaacatcacaaaatatattaaacattttaattcccttatttattaaaataagcgaacttttccaatatatattttgttatacaggcttaaatttttttcagttaaggaaagcgctttcttggatgctcgaaataaaagaagcgtggatgacatgatgtacagaaggtgagaaaaatcatagaggtgaataatgtaatggacctttctttgattcaatgtcttgtcatagcggctgttggtgcattaggttctatactagtcaatcgcggggtagctgtatttaatgatggtttgcgtccgattatgcccgaatacctagaggggagaatgacaagaggggagcttgctgcaacaagctttgcattaagttttggattaatcatagggtttggtattccgctttccataggagcaacaatcattattggacacagtattttattggcttgtgacatcattggcatttggactccggaaaacaaaataggcatggcaactgcaggagttattggtgccgtttatagtattgggatcgttttaggattgcaatttgtagtagatttatttggcaagtttcccgtgaattttatagactctttaagtcttattggccagcctattattatcgcatttacagtatttccagctgtagcggtcggatatcagcacggtttaaaaaaagtcgccgtcactgcaattgtaactttagcttcttttctcttattcgaaaagtttggaacatttcaagcggcgggatatgaaatttcgctcagtcctgaagggatggctttattagcaggaatgttaatgatgatttattatgcagcgagaattagaggaggagatgaatctactaatgcaaatttagtgaatatatttaatgagcgtgtaaatcgaattaagaaaaaccgctggttattagctcttatgggagggcttgtttctttaacatcatctatgctgattttagcagtggatgcaatgcctcaagcattgattaataaagagctttacacagaggcggcaatcgctacatttgcacgtggaattggtttcatccctttagttttttcaactgcaatcgtaacgggggtttatggtttagctggtaccacactggtatttgcagtgggtcttattttcagggatataccgattttagcatttctgttgggctttttagtcatgtatttagaggtcatatcattatccgcagtatcaaaaagcatggacaaactgcctggtgtaagggagatgggagagcatatccgcacttcgctgtcagatgttctaggaatggctatattaattggcagtgcgatggcaggggaaaaaattgctcctggcattggcttcttctgggttattggattttatttaataaaccgaatagcatcaaaaccgcttgttgaattggctgtcggcccaattgcagttatattgttggggattgtcgctaatcttctctatgcagtcggtttatggcaggttggctaaatcatcgaaagaggggaagtttccgaatgttgaaagacggaatgacctatatgcatgaacatacaacgatagacctttccaaagtaaaaaacaatgaggattgtaagttggatgtatttcctgaaaccgtcagagaatttaaaagtttatacgaaaagggcgtacggaatattgttgatgttacgaatattggaatggggagaaatattacatacgtccaaaaagttgcaaaagaaacaggcattaatattgtcttttcaactggtttctatcaagattctttttacccgatccatgtgtttcgtgaatcgaaagaaaagctggcagaaagaatgattatggagattgttgaaggaattagaggaacagatgccaatgccgaggtcatcggtgaaattggaacaagttacaataaatggacggaaaccgaacaaaaagtttttgaagcggttgttgtggcacataagcaaacaaaaaaaccaatatcaacccatacttccataggaacattaggacatgaacaagtagaattttttaaaaaacatgaagttgatttaaaccgagtggtgatagggcatgttgatttatctggggatgccgattatatattgaaaatgctgagagaaggtgtatatgtagaattcgatacaataggtaaagaaaattatatgcctgatcgtgttcgggccgaaatattgaaaaaaatacaggataaagggtatatagacaaggttctgttgtccatggatatcacaagaaaatcacatcttgtatataaaggcggggtgggctattcatatttgatagacacgtttatccctctcttgcaaacctatggaataactggtgaatcaattgataagatgttgattaaaaatcctcgcgcttttatgaaaggggagagtgaatgagcatggatacttatcctctagatagcctatcaattgaagaagccatgcatagacaatttaaattggttgatgtcatgacaagacattttcgaggagaagaattgctttcacttggcgatttaggcgttgtaaaaggaatcaataaaccgcggttcacaaaaaaaatagaagagacactagctgatttctttggcacagagaaagcaatgttagttcgtggtgcaggaacaggggcattgaggtttggttttatgagctttttaaagccgggtgacgagatccttgtccatgatgcaccgatatatccaacaagtaaaacaacgttagagtcgatggggatcttgccaatatacgcggattttcacgattctgaacaaataaaagaagccatcctcaaacacccgaagttaaaaggtgtattgattcagcatacgaggcaaaaaatagatgaccattatgatttggctgaaacgataaaaaaaatacgttccatttattctgatctagttattattacggatgacaactatgctgcgatgaaagcagaaaagattggagcgcaactcaaagccgatttgtccaccttttcattgttcaagctattaggtccggaaggtattggagtcattttaggaagaaaaaatttaatagaaaaaatagaaaaaataaactattcaggcggaagccaagttcaaggttatgaagctttagaagctttaaggggtctgatatatgctccggttatgctggcaatacaagcaagtgtcaatgatcagttagttcactcgcttaataatggagccattaagggtgttaaaaaggcttatttggcaaatgcacaatcaaaagtcttacttgtagagtttgttaaaccaattgcagaaaaagtgcttcatcatgctaatgaattgggagcagcaccccatccgataggtgctgaatcaaaatacgagtttgcaccaatgttttatagagtgtctggcacttttttatctgcggatccatcactggcaaaaaaaatgatccgcattaatccattaagaagcggtcctgagaccattttaagaattctaaacacatccgttcatcgagcaacagaagatctcagcgtaaattcttcaaaaggcgatgatataaatgaataaaagagtcattatcataatattagacagcttaggtgtcggttatatggaagatgcaagcgattatcatccttcagatgttggcgccaatactttctatcacatacttgatacggtgccctctttaaacattccgaatctcgaaaaattgggtattaataaaatattgcaccatcctaaattgaaaaaaacagatcatattgccagctatggtgttttaaacctgatgcatcaaggagcggacagttttgaaggacataatgaaatcatgggaacaaagcctaaaaagacatatttagctccttttgcggaacatctcaatcatgttaaactcgctttggaagatcaaggttataaagttaacataccgaattcagatttgccgtatctattggtaaacgatttagtggtcgtggctgataatatcgaaacagattacgggcaaatttataatgtaagcgctccgctggattatattccgtttgatgaagtattgaaaataggaagatgcgtccgtcatcatgttaaagtaaatcgcgtgattgttcttggaggagaaaacgtaacacctgaacacttgcagagatcggttgaaagaagagaagacggattaataggggtgaattcgcctaaatctaacgtatacaagcaaggatatcaagttcgtcacttaggatttggtatctctcccgaaaatcagttgccgacattggcgagaaataggggaatggaagtctctcttatcggaaaaatgcaggacatcatttattgtgaaggtgcaaatagatttccaggtgtagatacagaacaagtcatgaaggatattattcaggagatggaccgcgtcaaaaaaggcttgattgctgccacagtacaagaaaccgatttggccggacatgcacagaatcccgtccgttatgcgaatcggattgaaatggtagatcgatatttgccggaaattctccggaaaatgacagatcaggatctgctgatgattagtgcagatcacgggaatgatcccacgatcggccacaaccaacacacacgggaaaaaacatatttgctggcttatcacaaaaaattatcgcctgttcacatcggggaaagaaaaacgctatccgacattgctgcaacttctgctgattatctagggcttcgcaatactgaaaacggcagttcattccttcatttaatgcaaaaaggaaaagaggagacatactgatgtttttggaatctacattaaaatataacaaaaaattaatagaggctgcattgagttttcatcagcagggaatcatttcacctaacacttatgtattagacttggacaccgtcaaaaaaaatgcaaaagtgttaagtgaaaaagccagaaaacaggatattgaactgttttttatgacaaagcaatttggtcgtaatccgttggtggcacaagctatagccgaaagcggaatcggcaaagcggttgctgtagacccgtgggaagcaatcacactcagccaaaatggaatcaaaattgggcatgtcggacatcttgttcaaatacctattcatatgatacccgcaatattggagcttcatcctgattatgttacggttttcagccttgaaaatgctcaaaacattaatagagtcgctaagaaaatgggaagaaaacaaaaagtttttttgcgtatcgcaaacaaagaggattatatatataaaggtcaagagggagggttcacttttgagcaaatcgttaaggatatcgaatcgattgaacaattagaaggacttgaaattgcaggtttaacaagctttccttgcatattgatccaagacggccttccagcagttactccgaatgtagcatccatgcaaaccgtaaaatcgtttttaatggaaagagggtataaaaagcttgagatgaatatgccaagtgcaacatcttgtgcaacaatgaaattgttaaaggaaaatggtgcaactcaaggcgaacccggccatgctttaattggaacgacacccatacatgcaacgaaacaacttgcagaaaggcctgcgatggtatatgtaaccgaagtgtcccacatatctaatcatcatgcttatgttttcggcggcggtttctatccgcgttcacatatgaaagcggcgctcgttggaacaaacaaagatcatcttaagaaggttcaagctattgaaatgacgcctgatcatattgattattacggttcattaaacacagttgaagcaaaagtcggcgatacggcaatatttgcttttcgtacacaagtctttgtcacgaatgcacatatagccatcttaaaaaacgttgctgaagatcctgaacttatcggtgtatatgattctaaaggaaatgtaatcgagtgaatgatcgttatcggcagaagtgcctgaataatggattgtcttactgaaaaaggtgtggcgaaaatgcttggcctttttgcagtgcagtttaatacagtagtcagtcttggacattttattttgtggaaaggagaaaaacgtgaaaattattcatgtatcaggttatgaagaaatgagtggaaaatcggctgatctaatggctgagctcattcaaaattcaaataatcctgttatcggctttgcaacaggttcgacaccgattggtttatataaatgcctgataaaaaagtatcggcaaaaggaaatttcatttaggaatgttactgcttttaatttagacgagtacgttggattggctaaagaaaataaaaacagctaccattattatatgaatgaaaaattattcaaacatctggatattagtcgaaggaatatcaatatccccaatgggatggcggaagatttggaacaagaatgcctcagctacgacagacttgtttctgaaaaagcaattgacatacaaatattaggaatgggattgaatggtcatatcggttttaatgaaccggggacaagctttaaaagcagaacccatatcgttgatttggatcaatcaacccggcaggcaaattcccggttctttcgttccttggacgaagtaccgacaaaggcattaacaatgggcattgaaacaataatggaaagtaagcggatccttctgctcgtgtctggaaatgaaaaatctgaagccttggcacggctgctgaacagcacccgtgtctcccaagagttccctgcttcaattttaaggaaacataaagatgtgacggtgatggcagatgacgcagccttaaataaaattcattaaattgaatgactgacaaaatcggttaattacattgaaaatttacacaaggcattgctttgaggtatcttctagccatcaatcagccaaaaaacgactgaatatagcaaatttccatcttgttgataaggacttacatatacaggttttgattgtcctcatattgtttactcgaacagttgaaaaggagagaagagtggataatcaattctaggcgagaggaagccatcatcctcaagaaccgaccgttcatattgatgattcataaaagaaaaagcagcctttttttcggctgcttcttttgaatcaagcttgcgtttacagcgtatcacatttaactccgacaacgccgtcgatcgctttgatatcgtaatagacatcggtgacataccttttcttatgaaccatgattttcgtttccatgatcggaaattcattatcgcgcatatcatcgatccggacggaatgaatccggatttttttcgctttcatttcctttaagatatccgtcagtttatccttgtcattcagggacatgcggacgcggatttctttttcctgcaagcggttgggcccgattttgccgacgatccacggcaaaaactcgacgctgattaaaatgaaaatcagactgacaaacgcttctttataaaagcccgctccgatggcgacgccgaggccggccgctccccagatcatcgctgaagtggtcaggccggaaatgacgtcgttgcttttgcgtaaaatcacgcccgctccgatgaagccgatccccgatatgatttgtgcgggaagccgcaaagggtccatcatgattctgttcgaccttggaaaatggtatgccgcatcaatgctgatcattgtcagaacacaggaactgatcgcaatcacgatgcacgtttttaagccgagcggcttgtttttcagctccctttcgagaccgatgaccattccgattaatgttgcgattccaagctttaacagcgtttcagtttcaatatgccaatccatgcccatgatctcctttccgacaatatcttatatgattgatatgattttctcacagacgccctggatggacaactgtttttgaagtgccgggggatgtcctggaaccattcatctgcaagaagcctatactcctatcattatattgccggcgtggcatcaaaagaattccgtctgagcaaaaaagccgccggatatcgcccggcggctttcgtaacctgatcatttaagaatgttcttcctcatgcgtctgttccatttcttcaaacatatctcttgcctcttttgccggtttgttcgtgatcatgctgacagcgtaaacgacaatcaagctcaggaagaaaccagggatcatttcatagatacccgtcttctcctgcaggccggtcagaatccaaatcagcacggtcacggcccctgtaatcatcccggccaatgcgccccactggttcatccgcttccagtacaagctgagaaggatggcgggtccgaatgcagaaccaaacccggcccacgcatagccgaccagatcaaggatcgtgttattcggtgtcagagacagaaggatcgcgatgacggcgacaagcagaacgctcagacgtccgacaagaacgagttccttatccgaagctttgcgccggaaaaacgtccggtaaaaatcttccgtcatggcgcttgatgtaacaagcagctgggaagacaccgtactcataatcgccgcgagcaaagcggaaagcaaaaatccggtgatgagcggatggaataatacctttgaaaacccgataaaaatcgtttccggatctttaagcgctgtacccgtctcatggacatacgccacaccggtcagtccgacgagcagagcgccgattacggagatgatcatccagcccatcgcgatgcggcgcgcaggcttcagttcttttacggatgaaatcgccataaagcggacgataatatgcggctgaccgaaatagcccagtccccaggcgagaaatgaaataatgctaatgacggtcgttcctttgaagaaatcgagcaagcttggattgatttcttcgatcacattgaaagtcggcgtaattccgcctaattgagtaaaggcaacgatcggcacgagcactaaagcgataaacataatcaaaccttgcacgaagtctgtcagactgacggccaaaaatcctccgaacagcgtataggcaattacgactgcggccgttaagaaaagaccgattttataatcgaggccaaacgccgtttcaaacagtcttcctccggacaccatacccgccgacgtgtacaatgtgaaaaacaccatgatgacgatggctgatgccaggcgcaagattcttgttgtatcattaaaccgattttcgaaaaagtccggaattgtaatcgcatcgtttgctacttctgtatatgtgcgcagccggggagcgaccaccaaatagttcacataagctccgattgttaaaccgacggcaagccaggcgcttgaaagtcctgtcacatacatggctccgggcagtcccatcagcatccagccgctcatgtcagacgcgccggccgataaagccgtaacagcaggcccaagacctctgccgccaagcatgtagtcattcaaattggatgtctttctataggagtaccagccgattaagagcatcgcggcaaaataaatccccaacgaaataaatacttcaacactcacgtttcatatctctcctctttaaaaataatgtggcatcacctctttaaaattttcaacaatactgatttgcgggtacgaagaaaattgcagggcctcctctataaaagatcaagtattggaattaacgcgctgcctagatcgtacttagttacctaacctatcaaactattcccaatcaatcaaccgtgaaaaacatccgattttattgaaaaagggcgtgatggttttgatgagcatcatgatgaaagcgtttacaaatgatatacaaagtaaaaatattctgaatattagtacgtgccgttttactgaatttttcatgtactttgttttaaaaggcgccaaatggggcgaagatcgcggttttgttgatttagaaggctaaaatttgatatgatcagtattatatgactaagcgagaataaccttggaggtgtttttagtatgtcgcgtatttctatagaagaagtaaagcatgtcgcccatcttgccagactggcgattacggacgaggaagcggcgatgtttaccgaacagcttgacagcattatttcatttgcagaagagctgaacgaagtcgatacagagaatgttaaaccaacaacgcacgtattgcaaatgaagaatatcatgagggaagatgtacctgataaagggcttccggttgaagacgtcgtcaaaaatgcgcctgatcataaagacggctacatccgcgtgccgtcaatcttggactaataaaggagggagcgagaaaacatgtcactgtttgaccataaaatatctgaattaaaacgtctcatacataataaagagatcagcatatcagatttagtcgatgaatcttacaaacggattcacgaagttgacggaaaggtacaagcctttttgcagcttgatgaagaaaaagcccgcgcatatgccaaagaattggacgaagcgcttgatacccgggatgagcacggtcttcttttcgggatgccgatcggcattaaggacaatatcgtaacaaaagatctgcggacaacgtgcgcaagcaaaattctcgagaattttgatccgatctatgatgcaaccgttgttgagcgtcttcatgaagctgaagcggttaccatcggaaagctgaatatggatgaattcgcgatgggctcttccacagagaactcaggctttaaaaagacaaaaaacccgtggaacctcgaaactgttcctggcggatcaagcggaggctcagcggctgcggttgcggccggggaagtgccgttttcacttggatctgacacgggcggatcgattcgccagccggcatctttctgcggcgtcgtcggcttaaagcctacatacggacgcgtttccagatacggccttgtcgcatttgcatcttcattggatcaaatcggcccgatcacaagatctgtcgaagacaacgcctaccttctgcaggcgatttcaggcgttgacaaaatggattcaacgagcgccaatgtggacgtgcctgactacctgtctgcgctgacaggcgatattaaaggcttaaaaatcgccgttccgaaagaatatctcggcgaaggggtaagcgaagaagcgaagcagtccgtgcttgaagcgctgaaagtgctcgaaagccttggcgcgacatgggaagaggtatcgcttccgcacagcaaatacgcgctggcgacttactacctgctttcttcatctgaagcgtcggcaaacttggcgcgcttcgacggcatccgctacggctaccgcacggacaatgccgacaacctgatcgacctgtacaaacagacgcgttccgaaggattcggaaacgaagtcaaacgccgcatcatgctcggtacgtttgctctgagctccggctattacgacgcatactataaaaaagcgcagaaagtcagaacgctgatcaaaaaggactttgaagacgtatttgcaaactatgacgtcatcatcggaccgacaacgccgacgccggcatttaaaatcggcgaaaaaacgagcgatccgctgaccatgtacgccaacgacatcctgacgattcctgtcaaccttgcgggcgttccgggaatcagcgtaccgtgcggatttgcgaacggcttgccgctcggcctgcaaatcatcggcaaacactttgacgaaagcacagtataccgcgtcgcccacgcattcgaacaggcgacagaccaccataaagcaaaacctgaactgtaaggggtgaaaaaacatgaactttgaaacggtaatcggacttgaagtccacgtggagctcaaaacaaaatcgaaaattttctccagttctccaacgccattcggcgcggcggccaacacgcagacaagcgttatcgacttaggctatccaggtgtactgcctgtgttgaacaaagaagccgtcaatttcgcgatgaaagccgcaatggcgctcaactgcgaaattgcgacagatacgaaattcgaccggaaaaactatttctaccccgacaacccgaaagcttatcaaatttcacaatttgataaaccgatcggcgaaaacggctggatcgaaatcgaagtcggcggaaaaacgaagcgcatcggcattacccgccttcatttggaagaggatgcgggaaaactgacgcatacaggcgacggctactcccttgtcgactataaccgccagggaacaccgctcgttgaaatcgtctccgagcccgatatcagaacgcctgaagaagcttacgcctaccttgaaaaactgaaatcaatcattcagtatacaggcgtgtccgattgtaagatggaagaggggtcgctccgctgcgacgccaacatctcgctccgtccgatcggacaagaggagttcggtacaaagacagagctgaaaaacctgaactcattcgcctttgttcaaaaaggccttgagcacgaagaaaaacgccaggcgcaggttcttttgtcaggcggtgtcattcagcaggagacgcgccgctatgatgaagcgtccaaaacgacgattttgatgagggtcaaagagggatctgacgactaccgctacttccctgagcctgatcttgtcgagctttacatagacgacgagtggaagcaacgcgtgaaagacagcattcctgagcttccggacgagcgccgcaagcgctacatcgaagagcttggcctccctgcctatgacgcgaaagtgctgactttgacaaaagaaatgtccgacttcgtcgaagcggccgttgaaaaaggcgcagacgcgaagctggcgtcgaactggctgatgggtgaagtatcggcttacttgaacgcccagcaaaaagagcttgcggatgtcgaactcacacctgaaggccttgccggattggtcaagctgatcgaaaaaggaacgatttcatcgaaaatcgcgaaaaaggtcttcaaagaattgattgaaaaaggcggagacgcagaaaaaatcgtcaaagaaaaaggccttgtgcaaatctctgacgaagcgacgctcagaaagcttgtcacagaagcgctcgacaacaatccgcaatcaatcgaagactttaaaaacggaaaagaccgcgcgatcggcttccttgtcggccaaatcatgaaagcctcaaaaggacaagcgaacccgccgatggtcaacaagcttcttcttgaagaaatcaataaacgataaaaaacagactatgcctaattaaatggaggtcctcatgttgaggaccttttttatttgtatgaaaatacaaatgaaaaaacttctttctgttcaataatattaaaatttatttgaattttatttaataatatattatcatttatttgaattttgtttttaaatttgttaataagaggggctgtctatggaaagaaaggatgtacccgagtggatcttagctttagaagaagaagatgtagaatttattaaaaactttatgctgaaatctggatctttaaaagaaattgcaaagagttatcaagtatcttatccaacagtcagggttagattggatcgattaattcaaaaaattcaactaattgacgagttagaaaatgagacttttgttaactttataaaacagttagctatcgatgatcagattagtctggaaaatgcaaagctaatcattgagaaatacaaaaaagagcggggtgttcataaatgaatcctatttatatactactcattggctttacaatactagggattcaatattttttatcgaccagaaatcataccttttggggagctatactgcctacagcttatatcgtttttctcgtggcattatccatttatgaaggaaaatctttcgcatcattctttcttcctcttatcggcggattggctttattgttgggagaatggattaaaggcagagaagctttgaaaaaaaagcgggaaagagaaatgagaataatgaaagccatggatattaaataacaggatcagcctcaaaaggacagaacaagctgtttcaaaaaaaccttggagaatgactctccaaggtttttcattattccacgacaggcgtcaaagaatcgccgtcccatatctctcctttattcagcgtccatggatgaagatagagggtgtccgctcccttattcacagccgggctccactcatcgttccacgccaggaagtacgtcgttttcgggtatttttctttgatggcatggataaaccgcgcgtaatccagcccgccgtttgtcgtctgcggtccgacttctgtaaaggcaaacggcttgttcagcgatgtgagctcttcgtagccatcaatggcgtacgggtcatcaaaataagcgtcaagcccgacaatgtccacatatgatgcgcccggataaaagtccgttttaaagtctctgttggcgtccggcgcatacacccacaagagatgatccaggcctcttgtttttgtcatatagtcatagattttcacatagagctgtttgtacaaggagattctttcgctgtctttttgattatattgcgtcagcccccaccagaaccattcgccgttcatttcgtgaaggggtctgaatagaacgggcacgccttcattttcaagctcctggaggccgtccgcgattttgctcagcatcgcctcaagccgctttccttcaggagtggaagaatctaaaattctctcatactggctgtttgaaatctgagttttataatgacccgaagtaaacgcggggtttgcgaggtgcatgctgatttgcggaatgcctccgcttttccagtatgcgatcaaatcacggttgcagctgtagtcaatcgtatcggcgatcttttccggctccagccatcctcttgcataatcgcagccgtatatggccggcagctgtcctgttgcctgtttgatccggtcgcttcagccgttgaaaatgtgtcgaggctgtatcctccgaacgccccggacatcacccggctttccgtccgattgggcaggtgggcgagccagttcatcaccgctttcgtcgtcggctgggcattcgggttcaccggagaaacggtgtgtgcatagctcggctgcgaaacggcaaaagcaaggagcagcgcgaagattgaacaaacgatgttttttttcactaaggtaaaaccccctgaaacatatagattgtcttaagcgatcttattatacatgctgctttcaaaaaatacatggtcagatcgtcttattgtaagggaatataaaaacagccataaggctgctttatgaatgaaggaaacgggtgatcattccatatagatgctgaacattgtcctgatgctgcaagtttgtcagcatgccttggagcacgggtgcgcggggcgaatcctttctcagctcttcctcgatcacatccagtgtaatgagaatgtcttccgaaagctccggctgacgtttggcatcttcaagctcccgcaaaatcgtatgtttatcggccgtattgccggcgttccggtaatagctgtacgtccggccggccaagatcggctgctccccgttttgaaccatgccatcaatcatgtcatcgattcttctcataataaaatccgcaagttcgtaaaaatcgatatccagttcattaaagataaacaaattttgataagactgcacgatgccttgaacgatcacggacaagtctgacagataaggcttcacaatgtcaccgtaggcggctgacagcgcgttttgatacgtctcgtggaatttttggctgacatttttaaaatattcttcgatcttgctgttttccggtatgctgtgttcgctgatcatcacgagaataaaatcgcggtgctccttgctctcgctgaattgataagcaatctgctccttgaacgtttccttaggagggaaattcttctgctgaatgatcttcatattttccatcattcgatcgatataatacttaatgattgcgagcaaaagagcttctttcgacttgaaatgcaggtagaaagccccttttgagatgttgcattcattggcgatgtcttgaatcgttgtggaagcaaaaccgtttttcgcgaacaggtgcaggcctgctttaatgattttttcttctttttctgtcatgaatgtacccctttaacacttctttaaaattgaataaattttaacatatataagttgacgctgtttacttttgaagtttattattgtatagaatgaccagtcagtcaatctgtattctgaaaatgatacacaatggaggtcgtaatgaattctatcattaattttgtactaaagaacaagttcgctgtgtggctgatgacgattattgttacggttgccggcatttatgcgggtttaaatatgaagcaggaatcgattcctgatgtgaacatgccttatttgaccatcagcacgacatatcccggagccactccgagccaggtagctgatgaagtcacaaagccggttgaacaagccgtgcaaaatctggacggcgtcagcgttgtgacgtccacatcgtatgaaaacgcatcatcggtgatgattgaatacgattatgaaaaggatatggacaaagcgaagacggaagccgctgaagcattggcgaatctcgatctgccggacaatgcgaaagagccgagcatttcgcgctacagcatgaattccttcccgattctcgcgctcagcgtgtccagtgataaagacgatcttcaaagcttgacgaaaaaagtggaagacagcctcctgacgaagcttgaaggccttgaaggcgtagcttccgttcagctttccggtcagcaggttgaagaagtcgaattttcatttaaaaaagacaaattgaagcaatacgggcttgacgaggatacagtcaagcaagtgattcaaggatctgatgtgacgactccgcttgggttgtacacattcggcaaagaagaaaaatcggtcgtcgtcagcggcgatatcgacacaattaaagacttgaaaaatatgagaattccagcggcgtctgccggaggcgcaagcgcgcaagccggagcgcaaagtgcgcaggcggcccagggggcgcaggctcaagccggggcacagagcgccggacaagctcagcaaagcgcgggagtcccgacggttaagctgtctgacatcgcaacgattaaagatgtcaaaaaagccgaatccatttcacgaaccaatggcaaagacagcatcggcatcagcgtcattaaagcaaacgacgccaataccgtcgaggtagccgacaacgtaaaagctgaactcgaacaattcaaaaaagaccacaaaggcttcaaatacagctcgacatacgatcaggccgaaccgatcaccgagtcggtcgagacgatgctgagcaaagcgattttcggagcgatctttgcggttgtgatcattctcttattcctaagggatattaaatcaacattaatctcggtcatttcgattccattgtcattgttaatcgcactgctcgtcctgaaccagcttgatatcacgctgaatatcatgacgctcggcgccatgacagtcgccatcggacgggttgtcgacgactcgatcgtcgtcatcgaaaacatttaccgccgcatgaggctgaaagatgagccgctgcgcggaaaagcgctcgtgcgcgaagcgacgaaggaaatgttcatgccgatcatgtcatcaacgatcgtgacaatcgcggtattcctgccgctcgcacttgtcggcggtcaaatcggcgaattgttcatgccgtttgctttaacgattgtattcgcgctcgctgcatccctcttgatcgcgatcacgctcgtgccgatgcttgcgcacaccctcttcaaaaaatcattgacaggcgcgccggtaaaggcgaaagaacacaagcctggggtactggccaacttctacaaaaaagtgttgaattggtcgctcagccataaatggatcacatcgatcatcgcggttctgatgctggtcggaagcttgttcctcgtgccgctgatcggagcgagctacttgcctgccacaaaagaaaaaatggtgcagatcacgtacacccctgaaccgggagaaacgaaaaaagaagcggaaaaggaagcgcaaaaagctgaagaaatcctattggaccgcaaacacgtcgatacggttcagtatacgttaggagcgggaaatccgctgatgggcggaagttcaaacggcgcgttgttctatatcaaatatgaggaagacacgcctgattttgatcaagaaaaggacagcgtcttaaaagacattcagaagcaatccaaacgcggagaatggaaaactcaggatttcagctcctcaggcaacaacaatgagttaacgtattatgtgtacggggattctgaaaaagagattaaaggcactgtaaaagagatcgaaaagataatgaaagaccaaaaagacctgaaaaacgtaagctcaggcctgtccagcacatatgacgaatatacatttgtcgctgaccaggagaaattaagcaaactcgggttaacggcatcacagatttctcaggcgctcatgaaagaaacatcgcaggcgccgcttacaaccgtgaaaaaagacgggaaagatcttgatgttacgattaaaacagaagaagaaacatataaaagcgtcaaagatttagaagacaaaaaaatcacaactccgaccggccaggaagtgaaaatcggcgatgtcgcgaaagtgaaggaaggcacgacatccgacacaatttcgaaacgggacggcaaaatctatgccgatgtcacggcggaagtcacatcagacaacgtcacggccgtatcagtcgacgtacagaaaaacatcgacaagatcgacctgcctgacaacgtcacaatcgataccggcggcgtatccgctgatatcgaagattcctttacaaaactcggactcgcaatgcttgcggcggttgcgatcgtctacctcgtgcttgtgattacattcggcggagcactggcgccatttgcgatcctgttctcgctgccgtttaccgtcatcggcgccttggtgggactttacgtatcaggagaaacaatcagcttgaacgcaatgatcggaatgctgatgctgatcggtatcgtcgtcacaaacgcgattgtcctaatcgaccgcgtcatccataaggaagcggaagggctctcaacgagagaagcactcctggaagccggctctacaaggctccgtccgatcctgatgacggccatcgccacaatcggcgccctgattccattggcgctcggatttgaaggcggcagccaggtcatttcaaaagggctcggcgtcaccgttatcggcggtctgatcagttcaacgctcctcacccttctgatcgtaccgatcgtatacgaagtactggcgaaattccgccggaaaaaaccgggtatggaagaagagtaagatggtataacatcaaccccttggaatggacacaggaaatggtccattctaaggggttttttctttgaagagacgatcgtcggtgtttaacaaaaatatcctgtgttatgctttgttagaaaaggcaacctgatgaggaggcattgaatggaatcgaaaggaaacagcgaaccaagccccaaaatcgtaaagcggctcacctggatcataccgatcgtgttgatcggagtcatatttctcttaaaaaatataagaaaccctgtgactgatgttttattttatattgtatgtgcaggtgttatcaccctagtgattttcagcatcatgaaagagacaaagagcagatgaaagcatgttttgagcttgtcgataaaggttgaagtgatcttcatcgacaagcttttttaatgctgcgttctccagccggcgaagaagcggctaatcatgcggattgatcacagccagcagctgatgatcttcccattttccgttgatctttgacgtttttccgggcgatgccttctttgtgaaaacccgccttctccagcacccggatcgaggcaatattacggggcatgacgccggcttcgatgcgatggagcttgagatcgtgaaaggcgaactcgaccatcagcttgacggcttcggtcgtgtagcctttgccgttgtgcttctgatccaaaaaatagccgatgaaggcgctttgcaaggaaccgcgcagcacttggaaaaggttgatcgttccgatcagcgcatcgtttgccggatcaaagatgccaaaataataatcttcatcgttctccatattttcatataatctttgaagcctcttcttttgtccttcgattgtataaaactcctcgttccgctccattgaaaactgttcaaagaacgggcggtttgcgttctgcaattcgaggcatgcctcggcgtcttcagccgtgagcggcctgatgtaaatgtttgtcccttttttaatcatggaaagtctccttttataaagatggaatgcggtcggctcttttcatcaactcttcaaaatacgcaaaaaattgatccctgtcgacttgatcaacgactttgaccattctgccgtcaggatgctcttctgtcgttccttggcgcgggctttgtgtatggacaaccgccttgatgctgcgcgagcgtgtcatatcgactgtgccgagcgtcagcgtcgtcagcacatcccaaaggtagtatgtcgaattcgtttcgttatggacaagcggcggacacatcgcatagcattggccgataaagtcgatcccgatatgctttctgaggctcgcccaatgggagcggatttcgtttgtcaaaggcacctggttcgtgctttcaagcgcgaccatttcgatctgaatgtcgctctcgaataccgtcttcacgctgtaagggtcccaaaaagcgttccattccgccgtcccgtcgtgctcaggctcttccacatttcctttctcaaggaaggtgccgcccatccagacaagctttgcaatgtgctttatgatcgccggctcttcctcaagggccctcgccaagtctgtcagcgggccggtaaacagcagtgtcaccggttcggggctctgcctcacgcattcaatcagatgaaggtgggcgggcagttctgacaccggagtccggacttcgcctttttcatttaaaatcggcagagcgtcgacataaaaggcgtgcatgcgccactccttcgggaacgggtgcacccctctcgaatcggatgccgcagtctcgacctggtacgaaccgaagcggtcaatgatttttcgactggcactgagagcaggctccaaatagcaatccgccggtatgacggatgttccgatcaatttgacattttccatctgcaatagcagaaataaagagacgagatcatcgacgcctccgtcatggttaaaataaacgggctttttcacagcaacatctccttttttcttaatattaattattttacatcaattagatcctaaagtcttttttaccattaattaggatattttatctaaaattaaacaaatgatgatacccattttgttgcgattttttcaacaactagtataattaaaggttgttggtaaagaaatgatacggatactctaataggatgatgaaaacatgaaacgtgcacgaatcatatacaatccgacttccggacgagaaatcttcaaaaaaaaccttgcccaagttctgcagaagttcgagcaggcaggctatgaaacgtcatgccatgcgacaacaggggaaggggatgccgtacaggccgccagacacgccgctgagcgggaatttgacttgattgttgcggccggaggagacggcacattaaatgaagtcatcaacggactggcgccgttggaacaccgccccaagctcggagtcattccggtcggaacgacgaatgactttgcgagagcgctcggcattccgcgcgaggatattttaaaggcggttgacacaatactagagggagaagcccgtccgattgacatcggccgcgtcaacggccaatatttcatcaatatcgccggcggcggacgccttacagaactgacatatgacgtaccaagcaaattgaagacgatgctcggccatcttgcctattatttgaaaggaatggaaatgctccttccttcactgcggccgaccgaggtcgaaatcgaatacgacggcaagctgtttgaaggagaagtgatgctgtttctcgtcatgctgacgaactccgtcggcggctttgagaagctcgcccccgactcaagcttgaatgacggcatgtttgacctcgtcattttaaagcgggcaaacctcgccgaattcatcagacttgtcggacttgccctccgcggcgaacatatcaatgacgagcatatcatctatacgaaagcgaaccgcgtcaaagtgacggtcaaagacaaaatgctcctaaaccttgacggcgaatacggcggcgaactgccgggcgaattcgaaaacctctaccgccatatcgacgtcgtcatgtcaaaagaaaaagcgagaaaattggatgattgaacttggtctaaagagctggccaagtttttcttatagcaggtgaaaaagatgaaacaaaaagcccccgttcaaaaaaatgaatattacaatgtcgtatttgaagatttaacacacgaaggagccggcgtcgccaaagtcgacggcttcccgattttcgtgccgaacgcgctgcctgacgaaaaggcgcagattaaagtgacccgggtcaaaaaaggcttcgccttcggccgcctcatcgacttgaaagaagaaagccgctttcgcacggacgcgccgtgcccgatctacaagcagtgcggcggctgccagctgcagcacatcaattacgaaggccagcttctctacaagcagaagcaagtcaaagacgtgctcgagcgaatcggcaagctcgatttaagccggatcaccgtccacccgaccctcggcatggaagacccgtggaactaccgaaacaaagcgcaggtccctgtcggcgaaagagaaggcggcctgatcgcaggcttctaccagcagcgcagccatgagatcatcgacatgaacgaatgcctgatccagcaatcggaaaacgaccgcgtcgttcaagcgattaaagagatctgcggcaaatacggcatcaaagcgtacaacgaagaacgccacaaaggctggctcagacacatcatggtcagatacggcgccgtcacaggcgaaatgatggtcgtcttcatcacaaggacaaacgacttcccgcacaaagcgaaaatcgtcgaagagatcaccgcggcattcccgcacgtcaaatcgatcgtccaaaacatcaacccgaaaaaaacaaacgtcatcttcggcgacgaaacaacggtcatctggggagaagaatacatttacgacacaatcggcggcatcaaattcgccatctccgctagatcgttctaccaagtcaaccctgagcaaacgaaagtgctctacgacaaagcgcttgaatacgccgaattgaacggcgaagagaccgtcatcgacgcctactgcggcatcggcacgatttcgctgtttttagcgaagcaggcgaagaaagtgtacggcgttgagattgtgccggaagcgattgaggatgcgaagcggaatgctgagttgaatggcattgagaacgctgagtttgaagttggcgaagctgaggtcgtgattccgaagtggtatgaggaaggcattgcggctgacacgctagtggttgacccgccgcgcaaaggctgcgatgaggctttgctgcggacgattattgagatgaagccgaagcgggttgtgtatgtgtcttgcaacccgggaaccctggcgcgcgatttgcgggtgctggaggatggcgggtatgtgacgcgtgaggtacagcctgttgatatgtttccgcatacgagccatgtggagtgtgtgacgaagttggttttaaaaggtgcagttgattaaactgtacctaatagtttaaaaactttgcagatgacttcttttcttcttcaaagacttaatctttttgatgttgctctttgataacttttttgaaggcctggattttatcctggtcttttttagtgtaattcgaaaaaattacatgataaattgttgacggggtattttttgagtgatatgattcaaattgcaattcgattaagtaattttaaagaaatactctatcgatgagggtgggatatgaaacttgaagatattgtaacggttaagataggaagaaacctttctagaggcaacgttaaaaatgatcatacattagttgcttatacatatgaggatttaatgaatgatttagatggctcatttctagactcacaagctagttttgatgctggacattcaaatcataaagaaagctatttgagcaatgccggagacgttgttttcagctttgttagttccaaagctggaatagtgagtaacttaaaccgagggaaaatcatcaatcaaaattttgcgaaactcatgatcgaacatgatgaattggatcgtagctatttatgttatgcgttgaatgaatcgtacgcaatgaaaaggcaaatggcaatttcgatgcaaggaagtgctgtgccaaaattaactccagcgattttgaaagagttggaaatcaagttgccaagtattgagaagcaaaggataattggaaaagcttatttctgtttaagaaagcgtcaagctttggcaaagaagcaagcagaacttgaagagaaactttttttagaagtattaaaacaattagaccaacaatagaaaaagtgaggaacacaaccatggctgaattacactcaaaactctttagtgccgcagacaacttgcgaagtaaaatggatgcatcagaatataaaaactatttattaggtttaatcttttacaaatatttatctgataaattattagaaaaagtagtagaaatagcgggtgaatcgttagaagaatacaacacacaagacaaacaaactcaattgtatatggaatccttggcagatgaagagataaaaaatgacttgattgaaacgttagtcgacacattgggctatgatattgaaccaaagtatttattcagtgtattagccaaccaagcgaaacaaaacacgtttcatctgaatgacttgaataaggcatttatcgatttgtctacgaaatatgaccaatttaacggtctgtttgatgatgtggatttgaaatcgaaaaaactggggtcggatgatccacaacggaacattaccattactgaagtactgaagaaactaaatgatgtcaatgtgatagaacataatggtgatgttattggggatgcctatgagtacttaattagtcaatttgcctcagaggctggtaagaaagcgggggaattttacacccctcatcaagtatctgacatgatggctcgtattgccgcgattggtcaagaagacaaaaaattgtttagcgtatttgacccaacgatgggatctggttctttaatgttgaatattcgaaactatattaattatccagatagtgtgaaatatcatgggcaagaactaaacacaacaacttttaatctagcgaagatgaacttgatcttgcatggtgttaataaagaagatatgcggttacgcaatggggatacattgaataaagattggccgacagatgagccttatacttttgatgccgtccttatgaatccaccatactctgcaaaatggtctgcagatactacattcatagatgattcgcgtttcaatcgttacggaaagttagcgccgaaatcaaaagccgactttgcttttcttttacatgggttctatcatttgaaagattcgggaacaatggccatcgtcttaccgcatggggtcctgttccgtggagctgcagaaggtgtgattcgtaagaaattattagaagatgggagcattgatgctgtaatcggcatgccagcaaacttattctttgggacatcgatcccaacaacagtcatcatcttgaagaaaaaccgcagcactcgtgatgtgttatttattgatgcaagtaaggagtttattaaaggaaagaaccaaaataaactttctaaagaaaacattgataagattgtcgaaacgtataagaaacgagaagatgtcgagaaatatgcccacgttgcaactttcgaggaaatcaaggagaatgatttcaatttgaacatccctcgatacgtagatacctttgaagaagaagaacctattgatatggctgcaattggctcaaagattaaagatattcgaatagaaaaagcagaactagagtctagcctatatgacatgatttcttcgctacaatatgatgaagaaaatgctgactggatcaagggtgcgttagaggtgtttaatcgtggaaaataagcgagtaccagagcttcgatttgcgggatttgctggagattgggaagagcgtaagttaggagaattagtagaaattaaatctggttggacaccttctgattttgttgaaacccaaaaatgtaatggagagatctatataaaagtcgatgatctaaactactctacaagagaattattggattcaaaaatgaaagtcgctatccatgctaaatatcatactataaaaaaaggaagtaccatctttcccaaaagaggtgctgccattatgacaaataaggtgcggattttaggaactgatggatatatggataccaatatgatggcattagaaccaagaaatattaatggagaatttctttatacgttgattgatagaacagggctatttaaaatagcagatacttcaacaattccacaaatcaataataagcacgttgaaccatataaaatacttttacctaatttatatgagcaaaaaaatattggtaactttttcaaacaactagacgacacgatcgctcttcatcagcaagaactaaccaccctcaaacaaacaaaacagggattcttgcaaaaaatgtttccaaaagaaggggagtctgtgccggaggttcggttcccgggatttactggggaatgggaacagcgtaaggctgatgaaatattttactctgtgtctgataaaaatcattcgaatcttccggttctttctgctactcaagaaaaaggaatggtttatagggacgaaacaggacttgatattaattatgatgtaaagtctacaaaaaattacaagagggtacttcctggacaatttgttatccatcttcgttcttttcaaggaggttttgcattttctaatatcgaaggtataacttcacccgcgtatacagtattagattttaaaaataaagaaatgtactattcgttattttggagatgtgttttagctagtgatacttttattaaaaggttagaggcagttacctatggtatccgtgatgggaaaagcattagctttagtgacttttcaaccctaaagttccgagtgccctctcataatgaacagttaaaaataggtaactttttcaaacaactagacgacacaatcgcccttcatcaatgtgaactagataccttaaaagaaaccaaaaaagcattcctacaaaagatgtttgtctaagccgaatagaggagagagaatcatgacaaagataccgcataaagatgaagctcaagtagaacgtcgcctgattgaagtgttgggggaagggcacaatcagtggaattatcgtcctgatttaaaatcggaagaagacctatggcagaatttacgtcaaaagattacgcaaaataacttatcagaaattggggaacatccaattactgataaggaatttgacacaataaagacagagttattatcgaaaacacagactccctttgatgctgctagatggctcaaaggggaaaatggaattgctcggattacgattgaacgtgaagatgtctctttaggttcgatgtctttagtgctgtattctaaccaagatataggtggcggaatctctacatatgaagttgttcatcagattgcaaaacaaaaagcaaaccttgatggtcgtgatcgcagatttgacgtgacacttttaattaatggattgccaattgttcaaattgaattgaaaaaggtcagtgccaaagacggtgtatttcaagcctttaatcaaatcaagaaatactcagaagaagggatgtttagaaataatatcttttctactcttcagttatttgtcatttccaatgaacaaacgactcgctattttgctaatgcgatgccaaaagacatgcacaagaaatttgtctttagctggcgcacaaaggacaatcgaaaagtagaaaatctttatgaatttgtaaaacaagtcttaaatattccagatgcacatcgattgattgccgattatacaattgtaagtgaggatcaagacaacaaagctgtaatagtattaaagccgtatcaaattcatgcgattcaagccttgtttacatctgccatgaaacatcaatccggatttgtttggcatgcgactggttcaggaaaaacgttgacaagttttgtttctacgaagttattagctcgcaaagcaggagtagatcgtaccattatgctgattgaccgaaaagacttagacaatcaaacaacgacagaattcaccaagtttgcttccgagtttaataccggtatttcttctggtgatgcaatatcgaatagcttgattgtcggaactggaagtgcgaaggagttaagtgatactctacagtctgatgccaattccaatacagtgattattaccactcgtcaaaaattagaagctgccttgcgctatgcccaaaggcaagaggagcaaaaaggtactcagcgctttaagaaactgctagggcaacatattgtctttgtcgtggatgaatgccatcgtgcgttaagtgcagaagggatgcaagtcattaagggattcttcccaaattcaacttggtttggatttacaggtacaccgatatttaacgagaataaaaaacaggctaaaggtcaattagctcgtaccactcgggatcaatatggagaagttttacacacctataccattaaaaatgcattggatgatggtgctgttttagggtttcaagtagagcacgaagatacaattgatccaacatcattaaataattatatttttaatcaactgcgtcaaaatgaaaaatacgccaatttgactgcagatgaaataaataacatcattgatcaaatggatggaacagaaaaggaagcatatcttgaaccttcttcgtttgaaagtgatgatcatattcaaaaagttattcataagattttcaggccggataatgcctatactaaatttgatttccaaaacggccgcccgcaaaagtctgccattttaacaactagttccattgatatggcgaagcgctactatcgggcaatcaaggaaatgatgaaagattcagattggttgacgaaagaatttgctggacatccgatccgaacgggacgaacgattgaagatccggattttccacgaattgcaatcacctattcgattcaagaaaacgaagacaattctaaacaaattcaagatgaaatgaaagagattattaaggaatataatgattattatcacactgcttggtcgatagaagatattgaacgatataatggtgatattaacaatcggttagctcgtaagaaagcagagttcaaagaatttggtaaacaaattgaccttgtcattgttgtcgatcggttgttgactggtttcgatgcaccaacgattcaaacgttatttgtggatcgaaatttaagttatgcgaatttgattcaagctttctctagaaccaatcgtacttatccaggaaagacaaaaggattagttgtgacatttaggaaaccttcaacaatggagcaaaatgtaaagaatgcgacgaagttatactcgcaagcacaagaggaatctagtcttgtttatccgacttatgatgaatcgaagaagcgctttaaaaaggctcacaaagcgctaactacattagttccaaatccaaccgatattgatgagaacacatctcttgaaacccgaattgagttcgtgaaagcatttcaagagctaaacaattcatatgaagctttagttacatataatgactacaacgatgatatgaagaaatcaccagcacttcaagaacaggtgaaaaccttagaagaatacattggtatatataacacggttaagggttcactcgaagatgaaggaaaccaagatggaccgggaccagatttctcagacattgaattttatggggaaaatgcagttaagatctatgatattgactcaacttatattgaccgactattagaaacatactcggccaataatcagaacatccgcgacgagatcgaaaatgcccttcaaaaactgaagaaatcagaaattgttaaaggcgtataccgcaagatgttaaatgctattgatgccaatgaaatagatgcagaggaagatattcttgcagtgaaacgaagctttttcactaaagcacgtgacaaagcgattcatgaatttgcgaatacgtggtttgtagaagaagatgagctgcatttatctgcaattcaatatgtgataggaataaattctattcctaatataagtaaaatcaacaatagtgggcaatttgataagtataaagccgtacatccagatgcaaaaccattgaaatatagaccagaaatcaaacgtcaatggaaaaagacattagatgaagtcattgtacctttggatgatgagttgagataaagtcgttttgaaattaatatctttaaaaaagtcagagtcggaggattttttaaaaggtatttaataataattagctgtttgaatatagatctaagaaagtagccaatcttcacataagtgagtgtgtggctgtactcgtcaaaaaagataaataaaaatctaaaaacataagcctctccaacccaggagaggcttataatgttatatgaaagttccatttcttgcataaagtcctactgaataaagaggtgtatcaaaatagaacataaaatcgatctttcaaatatcgatttaaagggcgaaggtgatcttgcggagggtatgagttaggacatgtatgtggtcgtttttatgatgtaagcaattttccaagttctgaagatatcataagcgatttacaagctttattagttacatacaaagaaatagaaggtcttattggaaatcgatcgatagaacagtttaatgattttattctgttgcaggaagacggccaatttttagaagaccgggttaacgaagaggagtatcagatagcggctcaaaccttcatcatatccgagaatacgaatgtgggatatgaagtcagtcaaaagagaaaacgtccgcaaccaatcattaatcaaggtggtcaaaggcactggacaagaaatgcaagtcttgcctcaaaagctatgatgctttctaactatacttgtgaaattgaccatacccacagaacttttatctctaaatctactaacatgccctatgttgagtgtcatcatcttgtccctatcgccaagcaagaggggttcaaatatgacttagatcaactggcaaacttggtaagcctatgtccacactgtcatcgtcttattcattatggccaagatgaggagaaagaaaaaatgttgaaaaaactgtatgatcagcggaaggatcacttgaaaaaggtaggaattgaaataaccttttcagaacttaaacgaatatataagtatcgaatatttagattcaaattacgggccttggacaagcgctaccaaggctttttgatgtttaacataatagacaaaaggttattgcaaaaatttacatatgtgatgagatcattttaataatagataacatcttaaagggaaagagggattcgacatgagcaaggtcggttccagaagtggttacgaggttgttgaacgaattccatttggcaactaaaaagcataaatattgaacaggagaagtcaatgtttttcgagatggaagagaattagaatgtgctcgttacttctcgctgcttgtggagctgtgtcggatgatgctttgctgcggacaattattgagataaattcgaagcgtgtagtttatgtttttaaccatggaatcttggcgcgcaatttgaggatgcatgaagatgtttatcatcgctattatgaaacaactataggccatttgaccaggaaatttgcttctttctgaaaaaaataaaataaatgttgacgctttcataaaaccgatatatactttaatcaaatccaatattgataaattagacatgtgactggtcatgcaggcaggatctaaaaccgataaattttttaatttgtcggtttaggtcctttttttattgcctaaatataggtctaatgtttcagaaaagggggagaaacagtgaattacatacaaacagcaagagacgtattgcagcatgtcggcggtaaagagaatattgcccacttggagcattgttcgacacgactccgttttacattgattgatcaaaacaaggcggatgtaccggcgcttgagaaaacaccaggtgtcatcgctgtccgtatgtcgggccaatgccaggtcgtgattggaaacgatgtcatcgaagtctatgaggaattgaccggccttctcggcggagcactttctggacaaaatgggtcttcccatcagccgaaggaaaagcgaaaagtggggactgtactattagacttcattgtcggtgtttttcaaccgcttgttccagccattgcgggtggagggattttaaaatcgtttctcctcctcttctcgttattcggattcattgatgccaaagggcaaacgtatcagattttaaatatggttggcgatgcgccgctttacttcctgccattgctagtcgccgtgacgacagccaataaactaaaagtgaatccgcttgttgcattatcggcagtcggcgctcttattctgccaaacatgacggcgatgctgacagaaggcgctcaattattttcattcgatgtgaaaaatattgcgtatgcctatcaggtgtttccggtgatattatctgtcctgttgtatgcacagatggaaaaatggtttactcgtatttcgccaaaacccattcgtatcttcttcgtaccgatgatgtctttggttattacagttccgatcactctcctgctgttgggaccaatcggttttacagcagggcaaggcttcacagcactcatccttgctatgtttgataaagtaggctggattgcagttgcgatccttgcagcggttcttccatttatggttgcatcagggatgcacaaagcgatggtgccgtacgctgtaacaacaatgggcaatctcggaaaagaagcactttacttgcctgcatcacttgcacacaatatcgccgaaagcggagcgtgtttcgcaattgcccttcgtacaaaagataaagtgcttcgttcaactgccatttctgcaggaatttccgcattctttggcattaccgaacctgcattatacggggtgacactgcaaaataaacgtgtgctcagcagtgtcatgatcggttctttcatcggcggcatcttcattggacttgtcggacttcaagcgtttgttcttgttggacctggtcttgcaagtatgtcgatgtttatatctgacgagcttccacgcaacttcatgttcgcagtgattggttttgccatctcatttgctgttgcgtttgctgctgcctttattttaggaaaggatcgaaagacagaagaaacggaaaaagaagcagagccaggtgctttcgctgaaaaacttggcgcagatgagacgttcaaaagtccagtcatcggtcaaatgatttcactatctgatgtagaagatgacatattttcttcaaaggtaatgggagaaggaattgccattattccttcaaagggtgagctatatgcaccggtagacggcgagatttcccttctctttgaaacaaaccatgcgctcggcatgaaaacagcaaacggagttgaggttcttttccatattgggatcgacaccgttcagctagagggcaagttctttaaacctttggttcaagcaggagacaaagtcaaagcaggtgatctgctcattcaatttgacctggaaaaaattaaggaagcaggttatgatccagttacactagcagttattacgaatacggatcaatatgatataaaagtcacgcaattaaaagaggttaatcgtcaagatacattgatggttgttacacaattaggagggtaatcatgatgacaaaaacaaaaggatttccaaaagattttttatggggcggtgcgattgccgcaaaccaagcagaaggagcctggaatgttgatggaaaaggaccgtctgttgctgatattgccatgtaccgttcgaatttgagtgttgaagattacgaaggacatcttgctgtttcttctgaaaacattgaacgcgcaatgaaagacccggacgtaaaaaaatatccgaagcgcagagggattgacttttatcatcactataaagaagatgtggctctctttgcagaaatgggttttaaaacattgcgtatatcgattgcatggagccgaattttcccgacaggagaagaagcagagcctagcgagaaaggccttcagttttatgatcgtctgtttcaagaaatgaaaaaacataacattgaaccgatcgtgactctgtcacattatgaaatgccattagcacttagtctgaaatacaacggatgggttgaaagaaaagtgatcgacctctttgtgaaatttgccaatgtgtgttttgaacgctataaagatgtcgtaaaatactggcttacctttaatgaaattgacagtatacatcgccattctttcattacagcgggaatcattcctgatcgctgtcctgaagggaaagtagaagaaacggtttatcaagcattgcaccatcaatttgtggcatccgctcttgtgactgcagattgtcatcgcatcattcccggcagtcaggtgggatgtatgctaacgaaactcacgacatacccgcacacttgccatccgagtgatgttgaacgcgcactgaagcaaaaccttgataactatttctatgcagatgttcaagtgtttggcgaatatccgccattgatcaaacgcatgctggaacgaaaaaatatcaatattaagatggaagcggacgatcttgccattataaaagaacatacggtagacttcgtttcgtttagctactatatgtccctgacagaatctgcacaggagggtctggaaaaaacagatggcaatacgattcgcggtgtgaaaaatccatatttgccgtcaacagattggggttggcaaatcgatccggtcggcttaaagatttcgctcattgaattgtatgatcgctatcaaaaacctctcattattgtggagaacggcatgggtgcgaaagatgttgtcgaaagcgatggatcgatccatgatgactatcgtattagctatttcagagagcatttccgtcagatgaaagaagccattgaagaaggtgttgatctctttggatataccagctggggacccattgacattattagtgcgggaacatctcaaatgtccaaacgatatggatttatccatgttgatcaagatgacgatggcaacgggacattgaagcgctcacgtaaagattcattctactggtataagaaagtgattgagacaaacggagaagtattagactaaaaaaccgcattcatgaaaaggtgatggcgatgtttaaaataaaaaaagttttaaactcgagtgtggtactggctgtagatcagaaccgacaggagatggttttatgcggcaggggcatcggttacggacgaaaacctgggaatatgattgaagaaaaacaggctgatcaagtctttatgccagtagacaatatgaaggcaaaggaatttctccaactgttggattcaattccgcaagaatttattgaattgacccagcaaattgttcagcatgcagaagaaagattaaaaacaaagctaaattccggtgtatacttcacattaatggatcacttgaattttgcagtagagcgctataaaaagaacatcaatattacgaatcgcgtctactgggaaattaaaaactactatacggaagagtttgaggcagggaattatgcgcttcagctcatcaatgaaacatttgggatccaattgccgaaagaggaagcggcaaatattgcgttccacttaatcaatgcattaggtgaagagacagagtcaaaagatggaatgaaaaatgcaaaaatgatcgggagcattgtcaaccttgtccgttacacattaaacatgaaattagatcaagaaaatatccactacagccgatttatcacacacgttaaatttttcgttgaaagattttacgctgataaattgctggcaaatcaggagaatgaattatttgagcaaattgctaatttatatccgcaagcaatggatgtagctttcaaaatcaaggattatatcaagcaggtgcacggaaacgtcattccgaatgatgaactgacatacttggcagtccatattcatcgattgatttcttatcagcaattaaaataaatgagagccacttgcctttgtggaaggcgagtggtttcttgtttttgaaaaagaaggagcgttttttgtttataggcaagatgagttgttgatcactaccaacagttgaaattgacaacaaaaggctttttcaattgttgacaaaaacagattactaattgacaaaaggtcattacaaaaatttacacgtgtgataagatcatgttaaagatagagaacaatcttaaaaagaaagagggggttcggcatgagcaaggtcgcttcagaggtggttgcgggggtgttgaacgaattccatttggccattaaaaagcacgatactgagcaggcaaagcatctttttgatgaggcgaagtcgatgttttccgagatggaagaggatcagaatgtgctggcttatttttcgcttcttgaggagcggtaccggatgatgctttatgatgcgaggggagagcggctgccgcgggagtcttattttaatgattcgcagatcgagtgcatcgagcagacggatcatatgattgattactatttctacttttttgaggcgatgcatgaagcgtacaacaagaatgttgagcgggcgatcagtctgtacaaggttgccgagaaaaaactggcgaaggtgcccgatcagattgaagcggccgagttttattttaaagtgtcctggctgtatatgtctcttcggcaaaatgcggtttctctcaattatgcgagagacgcgatgaatatttacaaaatgcatgacgggtacgaaaaaaagctggcgatttcccaagttgtgatggggacaaattacatgcagatgcagcgctttaaagatgcggagaagtactttgaagaatcgattgaaatttccaaaaagattgacgattcatttttagaagcgatgcttcatcacaatatcagcattctgtattccaattccggccggtctcaggaatgcattctcgccgtccagcatgctttgagcaacgccgaatggtgcaagtcaagctactatatcaactcgctttacatgctgaccagagagtttttcaaaatcggcgaaacagaagcggccctgttctatcataaaaaaggacaggaggaattaaagaaaaacgggaataagcattatgaaaagaaaataaatattatttatgagctgtattgccatgaaaacgtaaaaagcatcaaagacgacatccattccttggacgagatgaatgatttagacggtgtctgcgatctttctttgctcatctcaagctattttgagaaaaaaggagatgacaagaaagcgctggaatttgttaaaatattcatgaaagccgaaaacaaaatgagatcattagggagtgaggtattgtcatgaaaaaattaattctttgcttgtcgttaactgctatggtcttaggcggagctgctttatcccaaagccacaatcaggcgtcaggcggcgttcaaacagcggagctgccggttgggggttaatgttcgctgaagtccttttacagggcttcttttttaaagccatgaaacggggtgcgattaaagtgaatctgcaagagcatgaaatataaaaaccttccatattcgcgagaggccctccaatcgtttaaaacatttttagacataaaaattggagggaaatatcatgaatgacaaaacatttttatcatttttaaaacacgcagataagcctttcagcggctgggatttttctttcattgaagacacaggacgaatgaaaagcgacctgctttcatggtcatacggaagcatggctctgtctcttatccaggattccgaatcaatgttggatatggggacaggcggcggcgagtttttatccaaattggggccgtttccttcgtcagcatacgctactgaatgttatttgcctaatgtgccagtcgccaaggaacgattgacgcctttaggggttcaggtcgttcaaattgatgatgatgaagatcttccatttgaatccggccaattcgacctgatcatcaataaacacgaatcatattcagtacaagaggtgaggagaatcctttcaaaaggaggacggtttctcactcagcaagtcggcgggcttgattgcgaagaaataaatgaaaaacttggcgtgccgctaaatgaagaatttaaggattgggacttggaaacagcgttaaaagagatggaaaagcatgattttaagattttaaaaagcagagaagagtgtccgactcaaaggttttatgatattggggctctggtctattatttgaaagccattccctggcaggcgctcggttttgaagtgaatcaatataaggatgaattgtacgagattcataaaatgatcgaagaaaagggctattttgacgtcacacagtaccggtttatgattttagcggaagcagtttagagtttgatcaaagattgtgcctaagaagggtgtctcatattatatggtgacatccttttttattttcctatattttcgtaaagccagttatttatccatatatcaggaggaaaagcgatgtcatctcaaactgtaaccaattattttcttgatagtgtggctgcgactattatgcgctgattgtttacggtgcttgctttttattacattcgttcatttgaccggaatcgtgttttgattgcaggaatttttgttactgtttgtgaaaaaaaagcagaagaaaaacagcggaaaactcgcgtcttagggcggatttccaaaaaaatgtcgtaaattcgatgcatcaatttgatgaaatcgcccggccctgcggtataatagattttgtgaatgaaagattcaatgttgaaagagagtggttacatcatgggccgtaaatggaacaatataaaagagaagaaagcgtccaaggatgcgaatacgagccgaatctacgcgaagttcggccgcgaaatctatgtggcggcaaagcagggagagcccgatcccgaactgaaccagaacctgaaattcgtgcttgagcgcgccaaaacatacaatgtcccgaaagcgattattgagcgggcgatcgaaaaagcgaagggcggctctgaggaaaattacgacgagctgcgctatgaaggcttcggtccgaacggagcgatggtgatcgttgacgcgttgacaaacaacgtcaaccgcacggctgccgatgtgcgctccacatttggcaaaaacggcggaaacatgggagtgagcggatctgtcgcttacatgtttgatccgacggccgtcatcggctttgaaggcaaaacggctgatgaaacgctcgaattattgatggaagcggatatcgatgtccgtgatattttagaggaagacgatgcagtgatcgtctatgccgagcccgatcagttccacgccgtacaggaggcgctgcaaaacgccggcattactgagttcacggtggccgagctgacgatgctcgcgcaaaatgacgtcgcccttccagaggacgcgcgcgcacagtttgaaaagctgattgacgcgctggaagatctggaagacgttcagcaagtttaccataatgtcgatttaggggcgtaaaaagaggccctgaaaaaatcgggaaagaaaagatagatgaacaggaggacgacctgttttgtctatctttttttattgtaaagttaacttgacattttatttttttgttaagtatactttacgtatagtgaactttacattcccaatggaggaaagatgaaaacgttaataaaggaaaagcgcacttcgctgaacatgacacaagaagaactggctaaaaggcttaatgtgtcgaggcaaacggtgatttcccttgaaaagggaaaatataaaccttcactcgttctggcgcataaactggctcaaatttttgaatgtctgattgaagatttatttatttttgagggggatgaaaatattgactgaaacgatgacaaacatactgatcgctttagcgggcttagaataggcgtgctcgggatcgcaattgtttacaaagtaaacagacgaattggaaaaaaagagaggctgttcgatgagcgccagcagaagattagctatcaggctaaggcgctctcctggaacattacaatggcggccattttaattgcctgggcgttggtgatcattttccaaggaatatccttttcatttttcctaataacaggtttatatatcctgcaatatttatcaatgctgatcacaaccgtttatcttgctcagaaaaactgagcggtgctgttccccttgtatccggattttaccgatttatcggtaaaatctttttttatatccaaaagacccataagattgaattttcttgaaagattgccgatacataagatgtagtctaacttttcccaaaactgtttgataggagatggactgaatgattcaaataactgacctcaaccgtcaatacataggaggggaatggagagacggccaaagtgaaagcgtgttggccgatctgaatccttttacccataaaacgattgcctcttttcggaaagcgacgcgggaggatgtcgatgcggcttacaaagctgcgcttgaggcgaaaaagaaatgggatggcgtcaatccctatgaaaaaagggcaattttagaaaaagccgcggcttatattgaagacaatagagaagcgattgtgtttctcattatggaggagcttggcggaacacggctgaaagcggcttttgaaatcgatcttgtcgtcaatatgatcaaagaagcggcgggcttcccgctcaaaatggaaggcaaaattctcccttcaccggttgatgggaaagaaaatcggatataccgcattccggcgggagtggtcggcgtcatcagtccgttcaattttccgttctttttatctgtaaaatcagttgcgcccgcgcttggcgccgggaacggcgttgttttaaagccgcatgaggaaacaccgatttgcggcggcacgctgattgcaaagatttttgaagaagccggtcttccgaagggactgctgaatgtcgtggtcacagatatcggggaaatcggcgacagcttcgttgagcatccgattccgcgaatcatctcgtttaccggttcaacgaaggtcggcagctatatcgggcagctggcgatcaaacatttcaaaaaaccgctgcttgaactcggcggaaacagcgccttgatcgttctcgaggatgccgatttggaatacgccgtcaatgccgcgactttcagccgcttcacacatcaagggcaaatctgcatgtcggccaaccggattcttgttcaaaaagaagtgtatccggaatttttaaagctgttcagccaaaaagtatccgggcttaaaacgggcgatccgctggaccctgaaaccgttatcggccctgttattaatgaacgccaagctgaacatttaagaaaatcgattgaaaaaggcatcgaagaaggcgccacaccgcttctgaaaggcgatattaaaggcaatctcgtcgagccgacgattcttgcggatgtcacgcctgatatgtctgtcgccaaggaagagctgttcggtccggttgtatgcgtcatgccgtttgagaccgaagcagacgcggttgagatcgcgaatgacacgcctttcggactgagcggagccgtacacacgggaaatgtggagagcggcgttgccatcgcaaagcaaatcgagacgggcatgatccatgtcaatgacacgacgatcaacgatgagccgcatgtcgctttcggcggtgaaaagcaatcggggatcggaaggctgaacggagagtggagccttgacgaatttacgacattaaaatggatttccgtccagcaccaaaaaaggagttttccatattaagaggaggatttgatacatgaatgaagcagtaaaaacggacatccacccgctgctggatgcttttgtgaaagtggcgccgttcctgaatcagctgattcaggacgatgtgacagtggggatttacgataccgaaaagctgatcgtcaacatcccgggaaagacattttccctgaatgtcaaagcgggtgaccctttgcaggaaggcgatattattacagacgccatccgccaaaacaaaaagaaagtaagcatggtgcctaaggagctgttcggcttccctcttgcggcgagagcgatcccgctccacgacgagaacggaagggttatcggcggagtcgggctcggcacgagccttgaaaaatcggatcagcttcaccgcgtcgcggaaagcctgtcggtcatcgtcgagcagacggcttcggccattcaggatatcgccgaatctgtcagcggcttctccggacaaatgtccgacatctccaagcaggcgaaggaagtcagtgaaagcgccggagaaatcgagaaaatttcagtcaccgtaaaaggcatttcagatcaaagcaacctgctcgggctgaacgcggcgattgaagcggcgagagccggagagtcaggaaaagggttctccgtcgtcgccgacgaaatccgcaagcttgcgacacactcaaaagaaaacgtcggccagattgaccaaatcacgaagaaaatccacgcgttattaaaagaccttgagcattcgatcgaagtcatcaatgaacatacgagcggccaggccgcaggtgttgaacaaatttccgccacgatgcaggagatcagcagcaacgcgcaaaaccttgccaagatggcggaacaccaatttgaagactagaactttcacaggcccgctggcaaaatcggcgggcttttctaatttttcatttattaaaattttattttaaattttttagaggaattttccccggtcaaagcgaaaagtgatgaatgggaaaccgctttcaagggggatgggatagatgagagtatatacaacgactaaactgaccggattgttattggggccgatcagttttttgctgattctcggcttgataccggaagctgagctggcttacgcgccgcgaatcgttcttgcggttacagcctggacggccgtctggtggattacggaagccgtgccgattccggcggcatcgctcttgccagtcattttgctgccgacattgggtggtttagatatggaaacgacggccaaagcatacggcgatccgattgtgtttatgtatatggggggatttatcattgcgatcgccatcgaaaaatggaatcttcataaacggatggctttgcacattttaaagcggatcggggctgaaagccaccggatcgtgcttggcgtgatggcggcgactgcgtttttatcgatgtggatttcgaatgctgccaccgctttgatgatgcttcccgtagcgctagcagtcattaaagaagtgcaggaaaaagaaattttaaaaggcgaatcgctgcagaagttcagcaaaagcattttgctggctgtcgcgtatgcggcgtcgatcggcggacttgccacattggtcggttccgttccgaacgcggtgtttgccgcgatgtccaagcagatgctcaatcacgaaattatgttttttgaatggtttttattcgggttcccggtttccattctgtttcttgccattttatatgtttatttaacgaaaataaaatttaaagtgagcgcttttcaaggaaaaaagcctgattttatcgatcatgatttaaaggcgcttggcgcaatgacgagggaggaaaaatcggtttttaccgtttttttattaaccgcatgtttgtggatgttcaaatttatccttccgtttcaaatatcagatacgtcgatcgcgattttcggagcggttctgctgtttttaattccgagtacaaaggatgaacggattttggaatggaaggatatgcagtcgctgccatggggactgcttctattgtttggaggcggcttgtcgcttgcggccggtttttcggcgaccaatctgacagcatggatcggcggcaagctcaagctgttggaaggccacccttacttatttgtcctgattattttgacggctgcgattttatttatgactgaaatcatgtctaatacggctgtcgccaatatggtgattccgatgacgatcggccttggcgccgcgcttcaggtcgagccgtacgggctgatggcggcagctgcgcttgcttcatcgtgcgccttcatgcttccgatctccaccccgccgaatgcggccgtcttcagctccaatctgctgacgataaaggatatggtcagggcgggcttttggctcaatatcgcaggtgtcttcttgattgtgatcagcgcatatttttggcttccggccgtctttcaataatgtccgcgaaaaagctctcactagttttcttgcatcatctgcattaaaataaagttatgacattacgttaggattggtagacagatgagcatttttaaagcggaaggtttatataaaacttacggagacaaaacattatttgaccatatatcgttccatattgaagaaaacgaacggatcggcttgatcggaccgaacggaacgggaaaaagcagcttgctgaaagtgatcgccggccatgaatcgaccgaaaaaggagacatcacaaagcccggcagcctccatatcgagtacttggatcaggatcctgatttggacggtccggaaaccgtgcttgagcacatttattcgggagattccgtgatgatgcggacgatgaggacgtatgagcaggcgcttcaggagctgaatgcggcgcctgatgatccgaagaagcaggaaaacctgctggcggcgcaggggaaaatggacgaacatggcgcctgggacgcgaatacggcggcaaaaacgatattgacgaagcttggcgtcgcggatgtggcaaaagaagtgagctccctttccggggggcaaaaaaagcgtgttgcgattgcgaaaacattaattcagcccgctgacctcctcattttggatgagccgacaaaccaccttgacaatgaaacgatcgaatggcttgaaggctatttgagcgggtatccgggctccgtcgtcctcgtcacccatgaccgctattttttaaaccgggtgaccaacaggatctatgaactggatcgagggcgcctatacacatacaaagggaactacgaagtgtttttggaaaagcgggccgaaagagaagcgctcgccgaacaaaacgaaacgaagcggcaaaaccttctcagaagggagcttgcttggctgagaaggggggccaaagcccgttcgacaaagcaaaaagcaagaattcagcgggtggaggaactaaaggagcaggacgcgcctgaaaccggttcttcccttgatttcgcgatcggctcccaccgtctcggcaagcaggtgattgaagcggaaggcgttgacatcagccgcggcgggaatcagcttgtccgttcattcaatgaactgattgtgccgggggaccggatcggcatcatcggaccgaacgggatcggcaaaacaacactcttaaacgcgcttgccgggcgcattaagcctgacggaggacagatcacgatcggccagaccgtaagaatcggctattatacacaggatcacagcgaaatgaacgatgcgctgcaggtcgtcgaatacatcaaggagacggctgaggtcgtcaaaacggccgacggacaagtggtcacagcggagcagatgctggaaaggttcctctttccgcggagcgtgcagcgcaacttgatccgcaagctgtcaggcggggaaaagaggcgcctttatctcttgaaagtgctgatggaggagccgaacgtcctgttcctcgatgagccgacaaacgaccttgataccgagacgctcggcgtgctcgaagattatttggagcagtttcccggcgttgtcgtgaccgtatcccatgaccgctatttccttgaccgcgtagtcgacaggctgcttgtatttgaaggcggcggaaacgtatcgcgttttcaaggttcctacagcgaatatatggagaagcaaaaggagaacagccgtcaaaagccggcgtctgaagccgcagaacctgtcaaacctgagaaaaagaaaaggaagaaactgtcttataaagatcagctggaatgggacggcatcgaagacagaatcgccgctctggaagaaaagcataaacggcttgaagaggaaatcgccgccgccggcagcgattttgccaaaatccagacattgatggaagagcaggcgcaaacagccgaagagctcgaagcggcaatggagcgctggacagagctgtcgctgttgatcgaagagcttgaacaatcgtaagtgagactgccgggaaatcccggcggttttgatatggaaaaaggagtttgaacaaatatgccttttgaagaattgctcagctgtctgctgatggccgcattatgtgttctcttgtttataaaagcaatgggctgccgcaaagaaaacagaagaggctcgctggcattctttatgatgttcagcatcgtctgcttgaccacgctcatcattaaaattgtaaagctcggccattttttcggccgagctttttaacatttggaaaacgatagccgcgccacggcatcgtgcaagtgaatcgattcttcgttccggcattcgatctcaaaggcggagatccagtccatttcgtataagtcggcagctgttaagcggaggacgtcttctacaaatcttggattctcataagcctgttcagtcactctcttttcatcgggtctttttaagacgggatggagctttgcgcttgcgttcgtttccgctgcggcaagaagctcggctttgaaatcgtccggcatctccgcctgttcattgatatgcgcggtgatcttgattatgccgcgctggttatgggcgctgtattcgctgatttcttttgaacaagggcagagcgtcgtcgcatgggcggtgatgccggcggtttgcgaaaagcctttgttttcatgataagagactgtcatatggatatcggcatgcatcagtccggacaatttggtttccgggctgatgcgttcgaaataccatggaaaactgacggagacggatgcgctttcctgttccatattgccggctaaatcctttgcaaaatctttcagtgtatggaagtcaaccgtccagtttgcttcgtgatagcgctgcagctgttctgtcaggcggctcatattgattcctttgcggtcgcgcgcaaggctcgtcgtaaaggaaaaagcgccgatcgtcgtttgtgtaaacggcttgagcgaggaagcaatcaaaatcggatgcgaaacgtttgagacaccgacatggtcaatgtcaaaaaaatagtcgttcggtgtattttgaatatccttcatctgttctttatcagtcggttttattcctttcacggcttcgacagatccgaagcggcggtggcgttcgggttttgcgggcaaatgcagtttgcgttccattgatgagacccctttcttcagtaaatcgaaatagttcctatttattttgaggcaatgctgtgataaaatcaagtggtcatgtctaaagcatgcaaattaaatcgaaatgatttcgtttagggagtggttgttttgcagcatagcgaaatcgtcattgttggagcgggacccgcaggtattggaatggggatcgttctgaaaaaactcggttttaaatcgtttacgattttggaaaaagaccgtgcaggagcttcattccgaagctggtctgaagaaatgaaactgataacgccgtcctttaccgggcagggattcggggctttggatttaaacgctgttgctccgggaacatcccctgcctttacttttcaacgcgagcacttgagcggacgggagtatggagattatttggcgcttttggccgatcattttcagcttccaattcaagaaggcacatcggttcgcagcgttcataaagacgacggcggtttttcagttgaaacagataaaggcactatgaaggccaaagacgttatttggggagccggtgaattccaattcccgaaatattcgtttcatggtgcagagattggcatccacaacagcaaggttgccagatggagccaatttgaaaaagcccattattacgtggtaggcggctatgagagcgcaatggatgcggcggtacaactggcgtcctatggcagcgatgtgacggttgtgatgccgaattcgctccgcgaaaacgctgaagccgatccgagcaggtcgctttcaccttacacatgggagcgtctagaagatgcgtatgaaaaagggaaggttcagtttttggaaaaagccgttgtagagaaactggcgaaaaacggaccagcctatgatttatatttgtcagacgggaggaagatccgttcggaaacacggccgattatcgcgacaggctttcattccggcgcaaaacaaatcgagcatttgtttgaatggggagagaacggcaagccgcttttaacaaatgaagacatgtcgaccgtgacggacggtctttatttaatcgggccgagcgttcagcatcaaaacgcggtcttttgcttcatttataaattcaggcagcgattcgccgtcatcgccgagcatttgttgaaaaaacgaaggttttcgatcgatgaaaaggtgctgacagaatacagggaaaatcaaatgtttctcacagatttgagctgctgtgaggtgcagtgtgaatgctgaaagaaccaacgcggcggcagcgcatgctcttcatcggactcgaatcggtcggaaaaacaacgcttttttcagcgatcactgatcagagggcaggcgaagcagcaaatgtgaaaggatcgacgatatttgcggctgaacgggagatcaaaagccttccgggctggcaagccattgatacaccgggcattcgggaggatggcagcgtgtcgaaacgagcgctgaaaaaagagattgaaaaggccgatgaggtggttgccgtcttgcgcggcacccatttttctgaagagctgaacgcggtcttggagctgattccgccggaagcccggcgcgtctgctttatcgttacgtttcaggataaaatgacggacgccatgcgccggaagctttctgagcaagtggccaagcacagtctcccggtcctgctggttgatacgagaaccgtgacagacgataaaaaagagcggatcatcgcttttttaagaaaagaggctgaatttcatccgctcaaacggaggcggatgaaacagattgaacttgaaagtgtggctgttcagcagtctgtgtttcatcgtcccgtagcggggcctgtagtgagcgctgcacttttatgtttgttgtttatggcgccgatcgtattggcttatcatacatcagagtgggtgcagcaatctgcggacaaatgggcggttgtccgctccaaaatgcggtcgggggcttgccgtcatggctgggcgcggcattggcggggaactatggcctgttatcccttggcatttactcgtttgtttgggcgtttcctgtcgttttgtttatgtctatagcgaatgcggcagcggatgattcgggtttaaaggaccggatcgtcgattcattggacccgctgatgcggaagatcggtctgaacggccgtgatttagttccgcttttgaccggatttggctgcaatgtcgtggccgttcagcagacgcggtcatgcagcatgtgtacgagaaagcgctgtgtatcgtttatttctttcggatcagcgtgcagctaccaaatcggtgcgacgctgtcgatttttcatgctgcgggaagggagtggctgtttattccttacctcgctgttcttgttgccgcagcggccgttcataaccggatatggtatcgcatcgatcagaaatgggccgcttacttcgagcgacggcaaacgtttttgcagaagccgtcctggaaagggatcgtctttcgagtaaaagaagtgcttcagcaatttatctttcaggcgatgccgatctttctcatcatttgcctggcggcgaccgtattgaatgaactcggtgtcatccgtcttgtgacattgcttgtctcgcctgttttaagcctgttcggcgctccagaagatgcggcgcctggccttgttttttccctgatcaggaaagacggcattctcttgttcaatgaagggaatggagcgcttcttgacatgctgccgggagcaacgctctttctgctcatttacttggcatcaacctttactccatgcatggtgacggtttggacaattgccaaggaactggggatgaaaacggcggcagccattatgggaaaacagatggccacttcagtcgtttcggttttgagcatcatgatcatctggaagctgacgctttgcatttttaaataaagtgtggtgaaataaaatatacatcgtaataattacgatttgataagaggaaggagaatgaaaaaatgagtaaaaagattcctgtgacagtattaagcggatacctgggggcgggtaaaacgacgctgctgaatcacatattgcaaaaccgccaagggctgaaagtcgccgttattgttaatgacatgagcgaagtcaacattgatgcagggcttgtcaagcaaggcggcctgtcgaggacggatgaaaagctggtcgaaatgtcaaacggctgcatttgctgcacactcagagaggatttgctggttgaagtcgaaaagctggcgaagcagggaaatattgattatatcgtgatcgaatcgaccggtatcagcgaaccgatcccggtcgctcagacgttctcttacatcgacgaagaattgggtattgatttgacccggttctgccgcttggacacaatggtgacggttgtcgacgccaatcgtttttggcacgattttcagtcgggggacagcctgctggaccggaaagaggctgtcggcgaagaggatgaacgcgacatcgccgatctgctcatcgatcaaatcgagttctgcgatgtgctgattttgaataaatgcgaccttgtctccgaggaagatctgcaaaagcttgagaaagtgctgaaaactttgcagcctaaagcaaacatcatcagagcggtcaaaggagaggtcgatccgaaggccgtcttaaacaccggtctcttcaattttgacgaagcgagcggttcagcaggctggatcagggaattaaaccaaggacaccaccagcatacgcctgagactgaagaatacggaatatcttcgtttgtatacgaagcgcgccgtccttttcatacagagcggttttataactggattcattcgctgccggaaaacgtcgtcagggcgaaaggaatagcctggtgtgcgacgcgcaacacccttgcccttttgatgtcgcaggcgggtccttccgtgtcgctggaaccgatctcttattgggtggccgcactgtccaaaccggaacaggaacaaattctcagacagaaccctgagcttttaaaagaatggaatgaagaattcggagaccgccatacaaagctcgtctttatcggattggatctgtcgccgtctgaaattaccgcagaagcggatcgatgccttttaacagattcggagatggcggccgactggtcgcttttatctgacccgttcgattggcagattgaaagagctagataattctaaaaaaagacaaaagagagacatctcttttgtcttttttatttccaacaaaccggtgttttggacgcgatgttgacatatcaggaaaggaatactaatattttattgtaatgttaactctaattaataataggttaacatatgaacgagaagggggatgaaagcatgaagggggaagcgtattacagtgtgagaatgagagcctccgagaacggtccccatgaagaggggggaaaacacatatccggaggagagcggcttgtgcctttcatcggtttaaatgatgccgtcagcgatttattggaaaaaggtatgtctcattcgcggggcaggccggactttatgcaaattcagttcgatcttgtaaacgaaccgataaagcttgttcaacctttgcgcattgaaacgaatgaaacggtatcagcggaagaaggacaagcgctcgcccgtgagctgatcagccgcgccggcgtgccggaaagcgcggttgaaaaagcgtttcaaggcattgccgaatactggggcgtgaggggcgccgttttgtttgatattcattccggccggcggattgacggaagaaaagaaaaaggagtgcgcgtctcgcggctcgattggccggaagccgattttcaaaggtgggccgctttgtgcggggtgccgccaaatccacggttgaaagaggcgcttgccatcgcctcaaaggtatgtgagcacccggccgtcatcgccgaattatgctggtcggatgaccctgattacataacgggctatgttgcggctaaaaagctgggttatcagcggatgacaaaagatgaaagagcatggggacgaaagcggctgccggattttttttgttgatggatcagcagatgtaaaaagctgcatagacgatttggaaaaacagcctgtattcattggtcaggaggtaaatcatgaatcaatcattcgttgagaaaagcaaacaatatctttggctgccttttacccaaatgaaagactatgacgaaaacccgctgatcatcgaaagcgggcagggaatcaagctgaaagatatcgacgggagggtgtactacgacggattttcttcagtatggctcaatgtccatggccatcgcaagaaggaactggatgaggccatcaaaaaacagctcggcaaaatcgctcattcgacattgctgggaatgacaaatgttccggcgacagaacttgccgaggtgttaatcaagatcacgccggaaaatctgacgcgtgttttttattcggacagcggcgccacagcaatggaaatcgcgctgaagatggcctttcaatattggaaaaacatcggcaagccggagaaacaaaaattcatttcgatgaaaaacggctatcacggcgatacgatcggcgctgtcagcgtcggtgcaatcgagctcttccaccatgtatacgggccgcttatgtttgaaagctttaaggtgaacgttccatacgtataccgctcgaaaagcggcaacccggacgagtgccgcgatgaatgtctcgcagaactcgaacggctcctgagcgagcggcacgatgagatcgccgcgctgtcggtcgaatcgatggttcaaggggcatcagggatgatcgtgatgcctgaaggatatttggcaggcgtccgggagctctgcacgaaatatgacgttttaatgattgtcgatgaagtggcgacagggttcggccgaaccgggaaaatgtttgcctgtgagcatgaacgtgttcaacctgacttgatggcggctggaaaggccattaccggaggctatttgccgatcgccgtaacgtttgcgacagaggaaatttatgaggcgttctatgatgactacaacaaactcaaaacgtttttccacggccactcatacacggggaaccagcttggttgtgccgttgcgctggaaaatttgcgcctgttcgaatcggaaaaaatcgtcgctcaagttgcggaaaagtcgaaaatactggaatcgctctttcatgatctggcagcgctccctcatgtcggcgacatccgccagctcggttttatgagcgggatcgagctcgttcagtcgaaggaaacgaggcagccttatccgcccgaagagcgaatcggataccgggtgtctttgaaaatgagagagcttggcatgctgacgaggccgctcggggatgttgtcgcatttcttcctccgctcgccagcaccgccgatgacctgcgcgccatggtgtcgattatgaaagaagcgattcaagaggttacaggccgtgcgtattgacgaatggctcagcagccggctcgcaaagacgaaagcagccgggctttaccgctcgcttaaactgcctcaagctgaacgtacgaattgggcgtcaaacgattatttgggcctggcgaacgacaaacggctgattcatgccgcagaaacagcgctccgccgctttggagccggaagcacaggatcaaggctgacgtcaggcaataccgcatggcatgaaaaacttgagcggaaaatcgccggttttaagcagacggaagcggctctcttgttttcaagcggatatttggccaatgtcggcgtgctttcgtctttgcctgaaaaaggagacgtcatattaagcgatcaattgaaccacgccagcatcatcgacggctgccgcctttcaaaagctgatacggttgtttaccgccacaaggatatgaatgatcttgaagaaaagctccgcgccgcacagagccgtgcacgccgctttattgtgacagacggcgtgttcagcatggacggcacgattgcgccgcttgacgaaatcatgctgctcgccaagcagtaccgggcctttgttatcgtagatgatgcccatgcaacaggggttttgggagaagccggcaggggaacgagcgagtatttcggcgtctctcccgatgttgtgatcggtacgttaagtaaagctgtaggcgcagaaggcggcttcgtcgcaggttctaaaacattgatcgattttttgctgaatcatgcgagaacgtttatctttcaaacagctgtcccgcccgcaagctgtgcggcggcatgcaaagctttagatatcatcgaagacagccgggctaaacgccggcttttgcaatcatcggtgaacacgatcaaacggagtctcgtggatatcgggtttacggtcaacggagaagatacgccgatcatacccgttatgatcggagatccccaaaaagctgttcaatttgcaaacggcctgaaggagaaggggattgaagccccggccatccgaccgccgactgttgcagaaggagagagccggatcaggctgaccgtcaccgcagaacgcaggttgaaagatattgaagatctattagaggggtttaaattaatgggaagagagttgaacttggtgaaatgaagggtttttttgtaacgggaacagatacgggagtcgggaagacgtttatcgcttgcggtcttgccgctttactgaaagagcagcatgtagatgtcggcgtgtttaagccgtttttgagcggcgagctcgctagcgatccgcagagtgatacagctcttttaaagaacatgtctgaaacgcctcttactgatgaagaggttacgccttttatttttaaagagccgcttgcaccatacacagctgcgaagctcgaagggaggacagtcgggctggaagatgccgtgaaccattggaaaaagataaaggatcggcacgagtgcttcatcgttgaaggggcaggcggaattgctgtgccgctcggggaggattatttcgtcagcgacttgatcaaagcgctcgatttgccggccgtcattgtggcgcgtcccaatctcggaacgatcaaccatacgtatttaaccgcccaatacgcaaaacaaatggggatacgcgtgatcggcatcgtgatcaacggcatcagcagccggccgggacttgacgaacagacgaatccggacatgattgaaagattttgcggtgtgccgctcctcggcgttacaccgaagcttgaagacgcttcaccaacacaaattcaccacatgatcaaggatcatgtcgatgtttccttgattatgaatcaaatgcaaatgggggcagaaaaatgaatcagtggatggaacttgcagaacgtgtgctggatggcggggaagtaactgaaaaagaggcgctttccatcttggaatgcccggatgacgacgttcttctgcttatgcatgccgcttttcaaatcagaaaacgctactacggaaaaaaagtaaagctcaatatgattatgaatgcaaaatccggcctttgtccggaaaactgcggctactgctcgcagtcttcgatatcaaaagcgccgatcgacagctaccggatggtcgacaaaacgaccttgcttgaaggcgcaaagcgtgcgcacgatttaaatatcggaacatactgcatcgtggcgagcggcagaggaccgtccaacagagaagtcgatcaagtggtcgacgccgttaaagaaatcaaagaaacgtacggtttaaaaatctgcgcatgcctcggactgctaaagcccgggcaagccgagcggctgaaggaagccggagtagaccggtacaatcacaacatcaatacatcaaaaaccaaccattcaaatattacaacgtcccacacgtatgatgacagggtgaacactgtggaaacagccaaaaaatccgggatgtccccatgttcgggcgtcatcgtcgggatgaaagagacgaagcaggatgtcgttgatatggcgaaaagcttaaaggcgctggatgccgactcgattccagttaattttttgcatgcgatcgacgggactccgctggaaggggtcaatgaattgaatccgctttattgtttaaaggttttagctttgttccgctttatcaacccgacaaaggaaatccgcatttcaggggggcgcgaagtcaacctccgctccttgcagccgttggggctgtatgccgccaattcaatcttcgtcggagactatttaacgacggcaggacagaatgaaacagaggaccataagatgcttcatgatttagggttcgaagtcgaatcggtcgaagaaatgaaagccagtttacagcggtagcacgggggagatataacatgacgacagaactgcacgaggcagggccgagcctgaaatcggattcggatttttggagagatccatatctgttttacgatcagctgcggtccattcatcctgtatataaaggaaccgttttaaagcatccgggctggtatgtcaccggatatgaagaagcggcagcgattttgaaggaaccggcatttataaaccgcgttcctctcccagaagcttctactaaatatgaacaacttcagcgattgcagcgaaatatgatgctgtttcaaaatgagtccggccataagcggatgcggacgattgccggcaaagaattcatgccgcagaagacggcaactttccgccctgctatagaagaaaccgtccatgaattgctcgatcagcttgaaaacaagaagacggcggacatggtatcggaattcgcctttcctttggcaagccttatcattgccggcatgctcggcgtcccggaagaggaatggtaccaattcaggcaatggacggcggatctcattcaaacgatcgatttgacccgtacacgaaaggtaatggcaaaaggcggtgataccgttgccaagctgacggcttattttaaaaatttaattgaaaagcgaaaagcgcatccttctgaagacctgatcagcacattcgccggtcatgagcagcttgctgatgaagaagtgcttgcgacgtgcatcctgcttgtgattgccggacatgagacgacagtcaaccttttgacgaacgggttgtttttgctcatgacacatcctgaccagctcagtgagctgaaagaaaatccgctgctgattgagtcggccgtcgaagaatgtcttcgctatgaaagcccgacacagctgacagcgcgcaccgcgtcggaggactgcgaaatcaacgggaaaatcatcaaaaaaggagagcacttatatatccttttaggcgccgccaaccgcgatccaaagatatttcaaaacccgcatctatttgacatcacaagaaagccgaatccgcaccttgcctttggagccggtgcgcacgtatgtttaggctcggcattggcgcggctcgaagcgcaaattgccattcccgcactgttggcgcggctgcctaacttgaagcttgcttcaacagacgttccatttcgcaggctaatcggctttagatcgctggccgagctgcctgtcatcctcaattaaagacgacgaaaaaaggggctggcttacaggtgccggccctttttaatctttcttttcattttgggtaatataggtttgcagaagcgcctttaattctttgacttctgcgcgcagttctttgatttcttttgtatcctctttcagctcgcctgtctcatcctctatttcctgagaaattttttgcgcattattcacgatttccccgacgatcaagttgatcataatgaaagtcgcaatgacgataaatgaaacgaaatagagccatgaccagccgctctcggcaaaaatgggcctgaatatgccgcttgcccacgattcgagcgtaaaggtttgaaacagtgtcagaaggctgagctgcaggttgccgaagtattccggcgcgatggcggagaagaacatcgtaccgatgacggcgtacacgtaaaaaatgatgctcatcaggataatgacgctgctgatggtcggaatcgccataaacagcgcgttgacgatccgtcttaatgaggggaccgaagtgatcgtccgcaggacccgcagcacccggaaaatacggagaacgctgacgaaattcgtattgtaaagaatcaaactgccggcgacgatcacgaagtcaaaaacgttccagttgtttttaaaaaagtgctgtttttgaacgaacagtttaagagaaagttcgattacaaatatcgttaaaaacaagcaatccacaataaaaaatactttttgataaggcttaaagaaagcgtaagtttccaaaccgatcgagatggcattcaacacaatgaccgtcgtgatgaatgactgaaacagccggcaattaatcaatgccgaaaccttgctttgaaccgaatatcgattttgatgagtgttcactcttgttatttgtcctcctgttttgatgtatttctatgatacgttacaacagcaggaagatgtcaagtcagttcctttatttttgcatcgaaaacttaacgtttacgtaaaagtataaaggtagtataatagaaaagaagaaaaatctcggggggatatggacgtggagtggatgaagattgatcaaatggccaagcgaagcggcctgacgaaaagaacgatccgcttttacgaagaaatcggtctgctttcttcaccgaagcggacggaaggcggagtccgtctttactctgaagacgatcttgaggaacttgaaagagtgatcagcgcgaaggaagtgctgggattctcgctgcaggagctccagcagttcatggaaacgggcaagcacctggagatgaataaagaaggatacctattgtcgctggataaacgggaacgaaaagaaaagcttgaagacattcagaggatgctgaatgaacagatgagaatgattgatgaaaagattgaaaaatttcaatcattcaagaagcgcttggaaggtatgcaggcaaaagccgagaatgccctacaatcaattgattaaacaagacaaacgctattttcatagcgtttctttatttggaaagaaggtttgatagataatgaatgaacaaccacctgagaactccagtatgtttaaacagccaaaagcggtctgggcggtagcctttgcctgcgtgatctcgtttatggggatcgggctcgtcgatccgattctgccggcgatcgcgcagcagctgcatgcttcccccagccaggtttcgcttttatttacaagctatctgttagtcacaggttttgccatgcttttatcaggcgctgtctcgagccggattggagcaaagctgacgttaatcagcggtttgatcctgatcatcgtctttgcgggcctgggcgggctctcgcattccatctctcagcttgtcggcttccgcggcggctggggactcggaaacgccatgtttatctccactgcgcttgccgtcattgtcagcgtggcttctggcggaagcgcaaaagccattattttgtatgaggctgctttgggattgggcatttcggttggaccgcttgccggcggagagcttggcacgatatcgtggagagcgccgtttttcggtgtatcggttttaatggccgctgctcttttggccatcttttttcttttgccgcctgtccaaaagccgcagaagaaaatttccgtcagtgcgccgatcaaagcgcttcgttataaagggctgttgacgctgtcaggagccgcattcttatataatttcggtttcttcaccctgcttgcatattcgccgtttgttcttgacttaaatgaacggggcctcggctatgtctttttcggctgggggctgtttcttgcgatcacttccgtttttatcgctccggccgtacagcggatcttcggaaccgtccgatctctgatccttctgtttatgctgtttgcagctgatttgctcgcgatcgggatttggacggagcacatggcgctcgtcatcggggcgatcatcatagccggaggtattcttggcatgatcaatacgattttgacaaccgcggtgatggaagccgcgcctgtcgaacggtctgttgcttcatctgcctacagctccatccggttcatcggcggggccattgcgccttggatcgccggtgtgttagccgatcattttactgcgcatactccatattttgcaggatgcatcgccgtgcttgccggcatcgccgtcttggctggaggccgccgttatttggcgggcatcaaagccggtcattaatgaaaaaagcttgtttccctaaaaggaaacaagcttttttgtttataaaactttcgttgtccatgactcgcaattccatgtttctgtcgctatgtccatatagaattcaggttcgtgagagatgagcaggacagagcctttgtattctttcaaagctctttttaattcttcttttgcttcaacatcaaggtggtttgtcggttcatcgagtacaagcagattcgtttctgaattgataagcttgcatagtctgacttttgctttttcccctccgcttaatacggaaaccctgctttcgatatgctttgtcgtcagcccgcacttcgccagggccgcgcggatttcgtactgtgtaaaggacgggaagtcgttccacacttcttctatgcatgtgttgttgttggtctctttgacttcctgctcgaaatagccgatatgaaggtgttcgccgcgttcgacttctcccgacagcggtgaaatttcccccaggaggcttttcagcaatgtcgtttttccaatgccgttggctccgtacagagcgattttttggccgcgctccattctcaagttcagcgggcgggacaacggctcatcatagccgatgacgagctccttcgtttcaaaaatcagctttccggatgttcttgcttgtttaaagtgaaattcaggcttcggtttttccgaagggagctcgatcatatccattttatcgagctttttttgccgtgacattgccatatttcttgtgctgacgcgcgctttgttgcgggcgacgaagtctttcagctctgaaatctcctgctgctgttttttgtaggcggcttcaagctgttgttttttcacttcatatacttcgcggaattggttgtagtcgccgacatagcgggtcagctcctggttttccacatggtagatcagattgatgacgctgtttaaaaacggaatgtcgtgagaaatcaaaataaaggcgttctcgtactcctgcaaatagcgtttcagccattcgatatgctgttcgtccagatagtttgtcggctcatcgagcagcaggatgtcgggcttttccaagagcagtttggcgagcagcacctttgtccgctgaccgccgctcaattccgcgacatccctgtcaagtccgagatcgttgagcccgaggccgcgggcgatttcttcaacttttgcgtcaatcgcgtaaaagtcgttgttggtcagggcgtcctgaatcgttccgacttcttcgagaagcttttcaagctcgtcggggtcggcctcgcccatttttgtgtagatggcattcacttcttcttccatcgcaaataaataatggaaagcgtttctcagcacatcgcggatcgtttgtccgcgctcaagcgatgtatgctggtcaagatagccgacccggacgttttttgaccattctacttttccttcgtcaggctcaagtttgcccgtaatgatattcatgaaggtcgattttccttcgccgtttgctccgatgagaccgacatgttcgcctttcagcaagcgaaaggatatatcatgaaagatcgcccggtcgccaaaaccgtggctcagctttgtaactgtaagtaaactcatgttttgcacctcaagaaatataatctgtattctataagattatatcgaactcggagggaacaataaaagaaaaattgcgaagccgcttttgttttgagatactaggagcagaatcaacctgataaaaggagaaaaacatgacagaaagatggccatttttaaataaagcaaaaccgtttattcaagaaaactggaaggcgtcgggctttcaagatccgacgaatgtccaaaaaaacgcggtcgatctgattttggacgggcgtgacgtgatcgccgagtcgccgactggaacgggcaaaacgctcgcatacgtcctgccgattctggaaaagctggaggcggatcaaaagaacgtgcaagctgtgattctggctccatcccgcgagcttgtcatgcagatttttgatgtgatcgttgaatggaaaaaaggctctgatatcagagccgcttccctgatcggcggcgccaatatcaaaaagcagcaggaaaagctgaaaaaacacccgcacatcattgcaggtacgcctggacgcgtatttgagctgattaaaatgaaaaagctgaaaatgcacgaagtgaaaacgatcgtccttgacgaaaccgatcatctgcttacgccggagcaccgcgggacgatacaaagcatcatcaaatcgacgctccgcgacaggcagctcctctgtttttcggcgactttaaaagacgatgccgaacgcgagcttcgtgaaatgaccaaggatgcggaagttctcaagatcaagaggtcgaaagaagaatcggcaaaagtcaaacatcaatttctcgtatgcgaccagcgggataaggtgaaaattctgcagaaattctctcggcttccaggcatgcaggcgctcgtctttgttaaagacatcggcaatttaaacgtatatgccgaaaagctcaaatttcatcatgtagaaatcggcgtccttcacagcgaggcgaaaaaaattgagcgcgccaaaatattgcaggcatttgaggcgggagagttcacactgcttctcgcgaccgatatcgcagcgcgcgggatcgacatcgaagatctcccttatgtcatccacgccgatttgccaaacgttgaaggctatatccaccggtcgggaaggacgggaagagcggggaatgaaggaaccgtgatcagccttgtcaaccgcattgaagaagaaaggctgaaaaagctggcgaagaagcttgaaattccgcttcagcggatcgtgtatgaaagaggacggattattgaaagataagaaaagaggcctgccgccggcaggcctctttttatatgaatgctcaggcattgtcggaatcggcgactttgatcagctgcttgccgaggttttttccttcaaacaagcctaaaaatgcctcaggtatccgctcgaaaccttctgttatcgtttcctcatattgaagctgtccgcttttcacccattcggcgagctgtttgattccttcaggaaagcggtccctgtaatcgtttacgacaaatcccttcatcagggcgcttgatttaatcaaggccgtttgtacgcgcggtcccatatcttcttctgcgcttttgacgttataagaagaaatcgccccgcagaccggaattcgtgcaaacttattgatcagggtgaagacggcatctgaaatcgcgccaccgacgttgtcaaagtaaacatcgacaccgtccgggcaagcttgttcaagcgctgaagccatattttccgttgttttataattgattgcttcatcaaaaccgagcttttcttttaaatatgccgttttttcatcagagcccgcaattccgacgactcttgcccctttgattttggcgatttgtccgacggcggagccgactgctccggcggccccggagacaacaaccgtttcaccggcttttggctgtccgatgtccagaagtccgaaataggccgtcaaaccggtcatgccgagaattccaagaaaagcggtaacaggtgcgagggacggatcgattttctggagattgtcttcgcgaaccgctgaatactcctgccagcccaagcggcccaaaacaatatccccttttttgagcttgtctccttttgcagatatcacttcgccgatcacgcccccggtgatcacttcatcaagcggaaatggctcgacataggatttcgtatcctgcattcttcccctcatataagggtccactgagacataaagcgtttttacaagcgcttcaccgttttttgcttccggaatttccgtttcttttatgcggaaatcgtccataacaggtatgccctgcggacgtcttgcaagttcaatttgcttttgcggcataatgattcctccttttacttataacttaccacgtaaaaaagaggtttagcaaaagatcagcggattgcacgaaatgttttcttcagtacagaatcgggcagaaaaaggtgaaaaacatcggcatttctttcatttaaaagatattgattggcattttctcttgaatattggaacatgtcttttgtgataaaagaaagcaatgacaggagataagaagagaggaggtcttcggtgctgcttgccgttctcctttcttccggatcgccgatgttcatgatgatcgaaaagacataatcgatattgatgccgaatcgtctggcggcaaatgattcaaatcgatgagtatcagcttcctgatgaccctctcttgaaaaaatctgcttgaccaaatcgctaatgatccatgcgttgtattgctgttccggtgaaaaataatacacgctaaatcaccccatctaaaagccttgtctatttgttaatgtacctgaattggcaacccttccaaacattttgtctgaaaatttataacaattgtaacattgaaatgaaaatgtcatgacagagcattcctccgtttagccgtgtgaacaaagggtaagttttaaatacaacatgaaaaagggaggagattcatatgaaaccagtagtaagacaatatacaaacgatgaaaaactgatgaaggatgttgaggaactcagggaaatcggagttgcaagagaagatatttacgttttgtcacatgacgacgaccgtactgaaagacttgcagacaacgcggatgccaatacgattggagccgaagagacaggcatcaaaaatgccgtcggcaatatcttcaacaaaaaaggggacgagctccgcaataaaattcatgagatcggcttttcaaaacaagaagcagaacaattcgagaaacagcttgatgaaggaaaagtcctcctcttcgttacggatcatgaaaaagtgaaatcctgggtataatttgcaactgccgacatggtcggcagtttttttaataaaataaaatttgaatgatagcttgaaaggagtagaataataaacgaaaacgatatgaataggaggaaaagctgtggctaaagaaaaagatgcagaacaaaaatcggcactgaacatcattcctcttgcggtcacgattttagtcggagcggttatttggtttattccgtcgcccgccggattggacccgaaagcatggcacttatttgcaatctttgtggcaacgattatcggctttatatcaaaaccgctgccgatgggggcaatcgccgtattcgcattggcgatcacggcgctcactggaacgctgtcgattgaagaaacgctcagcgggtttggaaacaagacgatttggctgatcgtcattgccttttttatttcgcggggatttattaaaaccggtttaggtgcgcgaatcgcctatttatttgtacggatgttcggcaaaaaacactcggactctcgtattcactccttgtcagcgatttgattttatcgccggcgatcccgagtaataccgcacgtgccgggggaattatttttccgattatccgttcgttatccgaaacttttcagtcgacgcccaaggacggcacggaacggcgcatcggcgctttcttgctgaaggtgggctttcaggggaacttgatcacttctgcgatgttcttaacggctatggcggcaaacccgctgattgccaaacttgcccatgatgtggcaggtgtgaatctgacctggacaagctgggctgtggcggccatcgtcccgggacttgtcagcttgatcatcaccccgcttgtcatttataaactgtatccgcctgaggtgaaaaaaacgcctgatgcggcgaaaatcgcaacagagaagctcaaagaaatgggcccgttcaaaaaatcggaactctctatggtcgcggtctttttgctcgtcctttttttatggattttcggaggcaacctgaatattgacgcgacaacaacggcattgatcggtttagccgtcctgcttttgacacaggttctgacgtgggacgatattaagaaagagcaaggcgcatgggatacgctgacatggtttgccgcgctcgtcatgctggcgagcttcttgaatgaactcggcatggtcggctggttcagcgatgcgatgaaatcgtatgtttcaggattctcctggatcagcgcatttctcattttaattgcggtttactattattcgcattatttctttgcgagtgcaaccgctcatatcagcgcgatgtattcggcctttctcgccgtgattatcgctgcaggcgctccgccgcttctcgcagcattaagccttgcgtttttcagcaacctttttgcttcgacaacgcattacggagcgggagcggctcccgtctttttcggggccggctatattccgcaaagcaaatggtggtcaatcggcttcatcttgtcgattgttcatattgtgacatggcttgttgtcggagggttatggtggaaattactgggcatatggtaaaatgaagggcgggagagatcctgtccttctttttatgttcatatcgacgctgttgatttgaaattccacgatttgtagtctagaaagggtttgtttaaatacaccgaacgtaagggggtgaacgttaatgttttggtcagttgatttcatgctgctcggtttcttgtatgcgatcgtctactttttgtacgacattgtgaaaaaccgaaaaaagacaagtttttttagaaaaatagtgtttgccagttttattgtttatttgagcgccgtttatcactatacgataggcggaatcaacattccgccgcagccggcatacgctcaaatgaacattcagctcattccgttttattttgtcactgaatgggtgcaaatgtatcagcagagcggctttgattggtttttttggaattccgtcaagcttacattttttaatgttttattgctcattcctttaggtgtgtatctttccgttctatggagaaaaacttcgcttaaaaaagcggcagtttttgtttttttgacgagctttttgattgagagtctccagcttgtgctgtctgtgacaggattaataatggcgagaacctttaatgtggatgatttaattttaaatacggccggcggtgtaatcggtttctgcctgacgtctttcatgttcggagctaaaggatcagattcccgcaggaaaggtctgcatttttgaagaaagcgcgaaagttggttcccggctaggcaatcatcttttttagttaaaattgaaagctcaggctcttaaatcggtgcatgcctgtgccgtgctgtgccagtccgtgtttcttcaagtgccgtgccgcatgtccggcttcctctaaaatgtcaggagcaagaccgagctgatgatgcccgccgaaaaccttttttacgcgcccgatagccgaaactttttcaagcgactgaaccagttgagccggatcagtcgtcggatagaatgcatagattggagctccggtatacagcagatcgccggtaaacaagtagcctgacgctggatcaaagatgcaaatatgccccggggagtgtccaggcgtatgataaataacaagcggccttgagtcgcagccgaccgtatctccgtcttgcagcgttcccgacggttcgcctctgaacggggtgtatgtttcagcggaaaagccggccggaacaggcttggtgatatctctcgagacatcgcggcgaatttgctcgatcggaagtcctttgattccgtccgtcagccattctctctcagcttcatggacgtaaatgcgctgatattcatcgtggcttccgatgtgatcccaatggacatgggttgtgatgacgctgaccggcagatcggtcagaccgtccgtcaccgtcttcatgctgccgatgccaagacccgtatcaattaaaacggcatccttcgcccctataagcaaataagagtgtactttttcccaatgcccgtattcgctgatcgcatatgtggattcatcaagctctgtcacagtaaaccactgactatctgccattggtttgtccctccttcatttttttcaaaggtgctcatcgatgcatatctcccagtcaaatgtgcaaaataataaaatacataataggtgagagtggtgaacatgatgagtgatccttacatgcctttgacatccgttaacagcggggtcctggaggagtatgccgaaggtgtatttggtttgacggtgcaaatcgtcaatgtgtattttattttcgatcccgattcgcgggaagccgttttaatcgatgccggtatgcccaagtccgctccattcattttaagagaggcgaaagagcggtttggcgattttcggcttaaaggaatcgttttgacacacggacatttcgaccatgtcggcgctttggaaagtcttctcgaaacatggccggttccagtttacgcccatgagaaagaaatgccttatttaatgggaaaagccgattatccgcctgcaaaaccgcaagtgaaaagcgggctggttgcaaagatgtctccgttatttccgaggcactccatcaacatttcgtcccatgtaaagcagcttaataaagatggttcgcttccgtttcttgaaggatggaaatggattgagacgccgggccatacaccggggcatgtttcgcttttccggcagtcggacagaaccttgatcgcaggggacgccgttacaactgttgagcaggagtctctatttgaagtggcaattcaaaagcaggagctgaacggaccgccggcttatttcacaatggattggacaaaagcagcagattcggttcggaagctggcaggattaaaaccggctgcattattgacgggacacggtgtaccgatgaaaggaagcgatttttccgaagcgctccttgatctatcagaccgcttgcccgcctctgattcgtaaattgtcatatgctgcgcttaaaacattcagccaggctgaatgtttttttatagggaaaaactaaccattttacatgtgatgatggccgtccattgttctaaattccggatgttgatgtataccaaaggaatcattttctgaaattttagacaaaatatgttgatatttcatttataatgcaggtatgcctgaaaggagctgagaaaagatgaaaattcaaaaaagggtccaagctttgctggcaacttcggcaatgtttgcaggactgatgctgtccgatgcggtgtacgctgcggaaaccccttactatggaaagaactatactcagccagagcaagtgtcatcattatatccggagcctgaagaaacattctcaacccctgcttttgtaaaagaaggggaagcctttacgacacaagaagaaatgatgaagtttataaccagtctgacaaagaaaagcccgaatgtcaaaatcgggaatatcggtttttcaattgaaaaaagaaatattcctgtgctttacttcacaaaggacaagcaaatacgttccatatcaaaaaaaccaaccgtctggctgcaaggacagatacatggaaatgagccggcagcgggagaatctgctctggcgatagctgaaaaactggccggaccgtatggcgacaaagtgttggacaagatcaatgtcatcgttgttccgcgggtcaatcctgacggatcatatcagttcaacagacggctggcgaacggaatcgacggaaacagggatcatgtcaagctcgagtctccagaagtgcgcgccattcaccaagaattcaataagtattcgcctgaagtcgttatcgatgcccatgaatacggtgtcggccaaaacgaatttcagagcataggcgaaaaagggtcattaaaataccatgatattttaattttatcaggaaaaaatttaaacattcccaagtcgatcaggcatgcgtccgacagcctttatgtgaacggcgtcagagctaaacttgatgaaaaaggattttctaatgatgcttattatacgacaggaaaaagcaaggacggaaaaatcgaaatctatgaaggcggtacagaagcgagaatcgggcgtaatgcattcgccctccagcctgccctttccttcctggtggaaagcaggggaatagacatcggacgcgaaaattttgcaagaagagtcgcggctcaggttgctacacatgagacgatcatcgacacgacagtgaagcatgcagccgagatcaagcgccttgtctccaaagaaaaattaaagctgatacaaaacggcgctaaagtgagcgataaagaccaagtggtcatcaacagtgagtttgcaggcccgtttaaagacacgcttaaagtcgctgatattgcctcaggacaagcagttgacgttcctgtccaatattacagcgcctcagaggccgttcctgtgctgtcaagaactcggccgaccgcttaccttgtccttccgggccatcaagatatcgaacagaagctgaaggatcagggattaaagagcgtgacactggctttcaaacaaaaactcaccgctgaagcgtatgaggttttatcgaaagaaacagcgggagaatctgagggccggccagtgatcaaggtagaaacgaagctcaaaaaacagaaaaaagagtttcctaaaggaacaaaaatctattttacagctcagcagcaaagcaatctgctgtcaatcgcacttgagccggagtcggttgacagttatgtaagcacaggttacattccttctcaaaaaggcaaagagctgccggtttaccgcttcatgctgaacaccaaaacgcttaattttaaggaataatcaccaggcatccgtctttgacggatgctttttagcggttttttgttttttcatacataattgttttaaactgagatcgaaacctatacaataaatatcagtctgaaatctggaaggagagaatccggttggaatcacatgaagaattatggagggaagccaaggccttcatcgagctctgctacggggaactgtcgaagtccgaagaagaaacaaggatgcgcttacataaaatagataaagaaatcagagaaaccggaagctatacacatacattagaagaaatcgaacatggagccagaatggcgtggagaaacagcagccgctgcatcggcaggctgttttggcactctcttactgtcatcgatcaaagaggcgttcaaaccgaggcagaggtgcgggatgcgcttttccaccatattcagcttgcaacaaacggagggaaaatcagaccgttcattacggttttccccccggaacaaaacggacaaaaaaaagtgtccatttggaaccaccagctgatcaggtatgcggggtatgaaactgagcaaggcgttatcggcgatccggcgtcattggaactgacaaaggcgtgtgaagcgctcggctggaaaggcgaaggtacgccttttgacgtattgccgcttgtttttcaaatagatgggcgtcctcctgtgtggtatgagctgcctcgtgaaatcgtcaaagaggttcggattgaacatccggagattgaaggcttcaaaagtttggggctgaagtggtacgctgtaccgattatagccgatatgaagctggaagtcggagggattcattataatgccgccccgtttaacggctggtatatgggaactgaaatcggagcgcgcaacctcgcggatgcagaccgctataatgcgctcgaaaaagtggcagccattatggggcttgatacggagcggaatacttcgctgtggaaagacaaggcgcttgttgaattaaatactgcggtgcttcactcctataaaaaagccggcgtcagcatcgtcgaccaccatactgcggcaagccaattcaagcggttcgaggagcaggaggctgaagccggaagggagcttgcagcaagctggacgtggctgattccgccgttatcgccggcagcgacccatatctttcacagctattatgaaaataaaacgctgaaaccgaattacttttatcaggaaaagccttaccttaacaaataaaatcctcaggaaaagcggctacccaacaatgccgccttttctgaggagaagctaaaaggctccaaatcggagcctttttgaatcgtctcagcttttcatattgatttccttccggtacaaaacataagaataaatatagggcgccaaaaccgttgccaaaataaccggaagcatgatttctggactgattgataacaacccgtccgcagctattagaagtcctgccaaagtaaatactttcgccgcaaatctgtgggtttttttccagattgaatcactgctcaatgtccaagggttcttgatcccgaaaaaaaagttggagcggactctcggtaggtaattgcctatgacgattaatagagcgcctacaagaaccggtacgatgctgcccgccggcagatcatacccgagcccggtcatgataacaagcacgttgatcagagaaaatataagcagcatggcattgatgagaatgtaataagtcttcgaaaaaagctgatagttttttctgcgcggatcgattttcggcgttaagaacatcaagacatatacaaaaacgagcagcccaatcatggcaagcatcgcttccattttggaagcatacctgtcgatttcccccgaagatgaccaatggattggaacttgaccggaaatgtgcggataagcgattgcccacatgattagattcatagcgattatagcgagcgaaaaaatgtgttttctcattttgcatcccctttatctttgccggcttgttcagtaaaactgaaagcccagccgatgatttcttgaaacattgtagtgtttagcgagtagatgatgtattggccttttttttcatcctgaattaattcagcctgttttaaaatttttaaatgctgagaaatacttggtttagacatttgaaactggtcggaaatttcaccggcggtcatatcccggtccttcagcaggttcaaaatctttcttctcgtcggatcagctagagctttaaaggtttgattcatatttagcatccttagaataagtatttagttatttaactaaatactaaaataaaagaaaaatttagtcaagatttattaaaaaaatccgccatctccggcggatttctcaatagctgatattaaacttttggaatccgtccaattctttggtttcttccacttttacatccgttacttttgagaatggacttcctttttgaattgcttttaaaaattgcttcaggctttcctcaagtccctcggcgcggatttcaactgtgccgtcgtcgcggtttcgaacccagcctgtcaatttgtgtttatctgcttccatttgaacaaaatagcgaaatcccacgccctgaacgcgtccgtctacaatgattctgtattgaagcatcgagaacaccccttttcttttatgctaccatatttcccattttgagatcatgggatagacatgcttcggatgaatcgttaaaatatgaaaataaaggaagggcgtgaggttttggaaaatcaggagtatgaaatcatatctattcatgtaggccgtccgcgtacatacgaattcgacggtaagcaggtggaaacggcaatcgtgaaggagcctgtcagcggacctgtctatttgagccgtacgaattttgaaggggacgggcaggcggatctgattcaccacgggggagaggataaagcggtttgcgtctatccggcggatcactacatgtattgggaaagcgtcttgaagcgaaagctgccagaggcggcatttggagaaaacgtgacagttaaagggctcaccgaaaaagaagtgtgcatcggcgatatctttaagctgggggaagctcttgttcaagtcagccagccgcgccagccttgtttcaagctggccaaacgtctgaatcaaaaagatatggtgttaaaagtgagggacaccgggtacagcggattctatttcagggttctcgaagaaggaattgttgcgcctgattcgcggctgcagctcgtttcaagagatgcgcatgaagccacggtctcgtatgccaatcatttgatgtaccatgacatgggcaatcacccagccattcggaagatccttgaggttgaagcgctgtcggaaagctggagaagctcatttttaaagcagctgagcgcataaaaacaagccgtgtctgaagaggaacacggctttcagcgtgtcgacaaaccctcgcattcgttgtcaggcctgctaagtcggtgctcacgaatagaggaaggatcggcggctaaccgccaggcgtcctgcctgaacgccgccgtaatcacctcctgtgaaagtctgcttcgatgctcggccttcctagactgcaagggttgcgggtcacgctgagcttaaaggatgtttattgtttgacgctttcaagcaggttggccaaaaagtgttttttatagctttgaagctttcttccttcatacttcgtcattcccagctttttcagttcttctacataccagcctttgcttccgtaatgcatggcagaaaactcccttctatatttcgatgcaattgggattctaacatctatagaaaaacgctgaaaagggataggcggcaatttttaaaaactgagtctttcgacatagtctggaagtttgagggcaggcgtcagccgtgtgtcaaactggtgacgatcatcacaatgatcgcgatgctgaggacgatcccaatatattttaagaagccgttcttttttttatgagcatatacgattaacaggatgctctcgataaaaaagatcagcccgatgatggcaaacagcatgcggtaaagctcctttcggcacagtttgtcttttattttagcataaaagcccgcgcttctatgagccgggcttttttatgcgtaatcagtcaagctgtgttaaaatgatcggttcgtttttcgtgatgacgatcgtatgctcgatctgcgccacaaagctgccgtcaggcgttttgaatgtccagccgtctccggcttcgatggtatgttctgcttttgtggaaacaaacggctcaagggcgatgacggttccgtttttaaagagcgcattatcaaacgggtcatagtaatttaagatatggttgggcgcttcatggaggttccttccaatcccgtgtcccgtcaggtttttaatgacggtaaatccgtttgcttttgcttcattgtatacggctctgccgatttggttttgtttcttgccggcgcgcgcctgcaaaagccccttttgaaaagcgctttccgcactttggcaaagcttgtgcagcatttcatcgccttttccgagtacaaaagaaatgcccgtatcagaatagtagccgccaaattcagcggagatgtcgatgttgatcaaatccccttcttttaaaattctggattcgcttgggatgccgtgggcgacttcatcgttcacactgatgcacgtcgttcccgggaagtcgtattctttttccggagccgatgcggcgccatgggcttcaagcacttcttttccgatgagatccagctcttttgtgctcatgccgggagctgcttttgccttcatttcctccctggctaaagcgacgattctgccgattttcttgagcccttccagctcttggtcattcgttacaatcacaattcattcccgctttctttttttatattccatttcaagcttaccatatttgtttgcgaaaaaggaacagagcggcttcaagacaaaaaaagcacccgcttatttagaagcgggtgctgtctgtttattgtccggaatccgatttcgttgtttgcgccgcatcagattctgatgttttcggattgtggttggtatagtcgtagtcgctcggattgatcgctttaaagcccttcggtttatagaagcgcagcaaatctccgtcgacgattttatccgacatttcgagttcttttttcacggcctcttcgatgttcggatcgatgtctttttcgttcagtagctctcctgttttcgtgtcatagtagtttccgttcgttttcgtatattccggagagacgaaatcgccgttgcggaacggaataatttcacggtgttccggtgacagaaggtctgaaccgctcatcaggtaatctttcgtattcacgcccatcaaatgaagcagggtaggggctacatcgacttcgccgccgtatttatgggatttgattcccttgaccccaggcgcgtggatgaacagcggcaccctttgcaattgggcgttttcatatggtgtgatgtctttgcccaaaactttggccatcgctttgttgtgattttcagaaataccgtagtggtccccgtacatgacgacaatcgtattatcatacagtccggcttttttcaggtcgttgaagaattgttcaagcgcctggtccatgtagttggccgactggaaataatggtcaacgacgctgtcgccggtatccccggcagggaagtctgtatcgccttcatccatctcgaacggaaaatggttcgaaagggtgataaacttcgtatagaacggctgtttcaggcttttcaacagcggcattgattcttcaaagaacggtttatctttcaacccgtagtttttcgttttatcttcgctcatatcgtaatacgtagcgtcaaagaatttgtcataaccgatggctttatacatttcattgcggttccagaacgttttgtagttgccgtggaacgccgctgatgtatagccttgagacttcaaaatggccggagccgactgcagcgtgttttgcgctttattaatgaacactgacccttgcgataaaggatacagcgagttgtccatcataaattcggcgtcggacgttttaccttgtccggtttggtggaaaaagttatcgaaataaaacgtttcattgtcgtgcgccagtgaatttaagaatggcgtgacttctttgccgtcgagcttataatcgatcaggaaggtctgaagtgattccagtgaaatgtaaaccacgttcatgcctttcgcttttccgaagtattcggcattcggcttatcatgattggctttaatatagttctcaacttccgttacgtcgctggaacttgccagtgcgcgctggctgtttgacttgatattttgcaccgcatcatagattgtgaagttgtaggttcccaaatatttcacaaggtagttgcggtcaaaagaacgggtcagaagctccggacgatcgatctcggcaacggccaggttggcgaggaagacgaggatgcttgctcccatcacaattttaaacggacgcttcgttgttgtttcagatggtctgttatagaaaacagccagcccgattaaaataaaggtgtcgatgaaatacagaacatcaagcgggtgcataagcgagaagatgctgtccccgagctgtcctccgtttgtttttgcctgcatgattgcaggcagcgtgataaagtcgctgaaaaatctgtagtatacaacgttcgcatatagcaaaaaagacattaaaaaatgaatcactataatcgctgtctgctgtatttttttcttgaacaagagtcccaatccaagaaagaacaagcttgagctaatcggattcacaaaaagcaaaatgtgttgtactgtgttggttattcctaaattaaattcaattacatacgcagcataagtttttagccatagcaatatagcggctatcaggaagaaggcaaggcctctttccttaataaatcttttcaattgttacactccttttttccggatcagtaaaaaccatcggaacgaaagaaaaaaacgaatgtataaaatataccatgaaataccgatttagaaaagcggaaaccggccttgcgaaaaaaatcgcaaaacccctgtcaaatcagggttttacagctttaaaaaagatgtttgggaatattttacgcttgtattgcattggcgggaactgatctttatggcagactgttgttagtatatgaacgaaaagggaggatttagaccatggatttttcgagcatcgtttctgaagacaagattaagcaggccattaaggacggcgaattcgaagggcttccgggaatggggaaacctttgaaaaaagacgatgccgcccatgttccagagcatctccgcatggcttacagagtgatgaaaaacgccggaatggcgggggatgaaggcgctttaaagaaagaactgatgacgattgacgacttaatcgcaaagtgcgcggatgaagacgagcgcgagcgtttaattgagagaaaaacagaaacccggctcaggctcgacaggctcgccgacaaaaaaggcatgttttccaagcctgcctcagcgttttataaagaaaaagtgtaccgaaggctgagcggaaataaaaagcgctaaaagcaggtttatttctcccctgtagtggtattgacccgtaaacgaacaaaagggtgataggatggaacgattattgaattgggttgaatacatatcagattggctgtgggggccaccgctgatcatactgctgacagggacaggagtctacttgacgatcctgctgaaattttttcaatttcgctatcctctctatatctttaagcagacgatcggaagtgtcggcaaaaagccgaaaggagaagggacggttacaccgctgcaggctttgacatcggctctcagctcaacagtcggcgccgccaatatcgtcggtgtgcctgcggccatcatgttcggcggtccgggagccgttttttggatgtggctggtcgcgctgtttgccatggcgatcaagttttcggaaagcgtcctcgccgtccactacagagaaaaaaatgaagaaggcgaatatgtcggtggaccgatgtattacattacaaaagggctctccatgaaatggctcggcgtctttttttcagtagcgctgatgatcgaacttgtaccgagcatcatggtgcagggaaattcggtttccgcatcgctggctgagacgttctcgttcaatcgtttatacaccggaatcgggattgcttttttgatcggtttagtggtgatcggagggattaaacggattggaaaagtgacggagctcgcagttccgcttatggcaggggcgtacatcggggccggtttcctgattgtcgtcacaaacctttcctctgtacccgcttttttctctctcatcttttcgaatgcgtttacatcttcttcggcattcggcggctttgcaggtgcggcagttgccgaaaccgttcgctgggggtttgcacgaggcctttattccaacgaagccgggatggggacggcgccgattgcccacgcagcggcgatgaccgaccaccctgtgagacaggggttctgggcggtgatcggcatcgtggtcgatacgctgctgatttgcacgaccaccgccttcgtcgtgctcgcatcaggcgtctggaccggcgaaaacgcatcaagcgatccgggggcgctggccgcagccgcatttcgcagctattttggccctgtgggcggatacttcgtctctgtctcgctcgttttctttgtcttatcaacgatcacagtggtcattttttacggtgtaaaacaagctgaatttctgttcggacggctcgcgggacatgtgattaaattcatctacctggccgccgtcgtcatcggtgctgccggaggagcaaaggcgatatggggattcctcgatctcgcgctcgttttcattcttcttccgaatattttggcggtgctgctcttgagcagaaaagtaaggtctttatatgatgagttttttacatcagaaaagtattatttgaaagacatcggtcagcaggacggcgtttatgaaggtgacgaaaaagtgaacaatttatgatcacagccggtttgttcccggctcataaatcggaggaagccttgctctcctacgttttatgaagggaacatccggcttttttaatttttgaaagcgctacaaaaatatattgactacttgtatatacaggaatacaataaacctataacatgtatatacaggttataagaggagaaggagggattggaatgactgatttgaatcaatcagcgcgacggattgtcgatgctgtcggcggtgctgacaacattgcagcggtaacccattgtgtaacgcgtttgcgatttgcattgctcgatgaaagcaaagtcaatcaagaggtgctggagcaaatagatgttgtcaaaggatcgttttcgactaacggccaatttcaagtggtgatcggccaaggaacggtcaacaatgtgtacgcggagctggtgaaggcaacaggaatcggcgaatcgtcaaaggatgatgttaagaaagcctcagagaaaaatatgaatcctttacagcgtgccgtgaaaacgcttgcagatatatttattccaatattgccggcgattgtcactgccgggctgctgatggggatcaacaatatcctgacggctcaagacattttcttcagcggaaaatcaatcgttgaagtctatccgcaatgggcggatctcgctaatatgattaacttgatcgcggggactgctttcgcatttctccctgcgctaatcggctggtcggccgtcaagcggtttggcggaaatccgctgctcggcatcgtgctcggcgtcatgcttgtgcaccctgatttgttaaacgcctggggatacggggctgcggagcaaagcggagagattcctgtctggaatttattcggtttggaagtgcagaaggtcggctaccaggggcaggtgcttcccattttgctcgcttcttatttgctggcaaaaattgagcgctttttgacaaagcggacgcctgagagcattcagctccttgttgtggcaccgattacgctgcttgtcacaggttttgcttcatttattgtccttggaccgattacatttgccatcggaaatgttttaacatcaggccttattgctgtctttgaacaattcgccgtactgggcggactgttatacggagggctttacgccgctctcgtcattaccggaatgcatcatacattccttgccgttgaccttcagctgatcggctcaaagctcggcggaacatttttatggccgatgctcgcgctgtccaatattgcacaaggttcagccgcgcttgcgatgatgtttattgtcaaagatgagaagcagaaaggcctgtccctgacatccggaatttcagcttatctcggaattaccgaaccggcattgttcggagtgaatctcagatacagatttccgttcgtgatcgcgatgatcagttcggggattgccggtatgttcatttcctcgcaaggggttttggcaagctctgtcggcgtcggcggcgtacctggaattttctctattatgagccaatactggggagcgtttgcgatcggaatggcgatcgtgttgatcgcgccgtttgccggaacatatctctacgcaaaattaaaaatgaaataagagagggagaggggcgcgcatatttgtctgcccttttcccattttcataaagaagaaagcggtggtgttgaaaatggaaacgaaagaaaatccatggtggaaaaaagcagtcgtctaccaaatttatccgaaaagctttaaagatacaacaggaaacggtgtcggcgacatacgcggcatcatcgaaaagctcgactacatcaaggagctcgcctgtgatgtcatttggctgacgccgatttatcaatcgccgcaaaacgacaacggctatgacatcagcgactattacagcatccatgaagaatatggaacaatggccgactttgaagagcttcttgaagaggcccacaagcgcggcataaaggtgatcatggatcttgtcgtcaaccatacatcaacagagcacagatggtttaaagaagcggcgtccggcaaagaaaatctgtaccgcgacttttatatttggaaagacatgaagccgaacggcgctccgccgacaaattgggaatcgaaattcggcggctcggcgtgggagtttcatgcagagagcggacagtattatctccatctctatgatgtgacacaggcggatttgaattgggagaatgaagcagtcagaaaaaaagtgtacgagatgatgcatttctggtttgaaaaaggaatcgacggcttcagacttgatgtcatcaatgtcatctcaaaagaccagcgtttccctgatgatgacgagggggacggacgcagattttatacggacgggccgagggttcacgagtttttgaatgaaatgaacagggaggttttttcaaaatatgacagcatgacggtcggagaaatgtcatcgactacaatcgcagattgcatccggtatacaaaccccgaaagccgtgagctcgatatggtgtttaactttcatcatttaaaggccgactatccaaacggggaaaaatgggcgcttgcggattttgattttctaaagctgaagaagattctttctgaatggcagacggaaatgaataaagggggcggatggaacgcattgttctggtgcaaccacgaccagccgcggatcgtctcacggtacggggacgacggaaaataccgcaaaaagtctgcgaaaatgctggcaaccgcgattcatatgcttcagggaacgccatacatttaccagggagaagagcttgggatgaccaacccgaaattcgatgacatctccctttacagggatgtcgaatctctcaatatgtaccgtatcctgaaagaagcagggaagccggaagccgaaatcatcgaaatcttgaaagcgaaatcccgtgataattcgcggacgccggtgcagtggaacggagaagaaaatgccgggtttacggcgggcacaccgtggattccggtgcctgacaactacaaagaaatcaacgcagaagaagcgctcaacgatcctgattcgattttctaccattataaaaagctgaatgagctccgcaaggaattcgatatcattacaaccggcgattatcagctcatactggaagacgatcaagagctttacgcgtatttgagaaacggagcggatgaaaaactgctggtgatcaataatttttacgggaaagagaccgagtttcagctgcctgacgatattgatattgaaggctatgatgccaaggttctcatttccaatgacaccgatcttcccgagtcatttaaacgcttcacagtgaaaccatatcaatcgattgtttatcatcttgccaaaccatgctaaactaagcgtggtggtaaaaaaatgaagatcaacaagtatatgatgatttacaaacaaatcgcggaacaaatcgatcaaagcatactgaatgccggagatatcctgccgtctgaaaacgaccttgccgaacagcacgacacctcgagggaaaccgttcggaaagcgctgaacgtgcttgctcagaacggatatattcagaagattaaagggaaggggtcagtcgtgctgcacagggagaaaatgcagttcccggtttccggtttggtcagctttaaggagctttcagaaacgctcggaaaagagacaagcacgacggtccatgagttcggcttgacgcatccggacgcatatattcaaaagcagctccgcacttccggagatgaagaggtatggcgggttgtcaggtcgcggaacatcaacggagagcgtatcatcctggataaagactattttatccgcaaacacgtgccgcttttaacgaaagaaatatgcgaggactcgatctatcaataccttgaagatgaatgcgggctcgtcatcagctatgctcataaggaaattgtagtcgagccatgtacggcagaggatcaagagtatttggatctgaacggatacgagcacattgtggtcgtgaaaaatttcgtttttcttgatgatacgaccttgtttcaatatacggaaagcagacaccgccttgataaattccggtttgtcgattttgcaagaagagaaaagtagcacggttcgcctgacggcggccgtgtttttttatgaagccgtttctcattacgtccgcattgaatatgctacagcaggtgtaaatgagaaatggaggatgtaagcaatgattcatgaaactgcaaagatcggaaagaacgtggtattgggagagcatgccgttattgaagaaaatgtggtcatcggggacaacgtaacaatcggtcatcatgccattattaaaaaggacactcatatcggcagcggggtgaaaatcggcgatttggccgtccttggcaaagcggcttcttcaaataaaaaaatggctcgccagccgaagcaggcaggagcccctttgcggatagaagatgatgccatagttggagcaagcgctgtgatttaccgagacgtgctgttggaacaaggcgtcttcgtgggggatatggcgagcattcgcgaaaatgtcgcgatcggcagagaaagcattataggacgcaatgcgatggttgaaaacaataccagaattggaagtaaagcaacaattcaaacgggctgctatatcactgctgatatgacgattgaggatgaagtgtttatcggtccctgctgttccacgtcaaatgataaatatatgggaaagggaaactacccgtatcaaggtccaactattaaaagaggagcgaaaatcgggaataacgcaacattgctgccggcggttgtcgtcggggagggggcggtcattggagcgggtgccgtcattacaaaagatgttcccgcaggcaaaacggctgtgggcaatccaggccggttgatgaagtgacggtttttcatctcagccgtgttatataacgtgtctgcataaaaagagagatcataggatatagtgcttcaatgtcttttaaagatcattgcaggcggaaaatggaaagaatgggggtggaaaaaatgtccattcaaaacgcggtgatgaacggtggttttgagacaggtgctttctcgccttgggtaggcgtaaacacatctgttacaagccagttttcgcattcaggatttttctctgcgagatttttgggcggaacagccacatcatatattgctcaatttgttccggccggtgcgggggaaggaagcgaatttcttgtttctcttgcgaaagcgggatttctcccggcaccttctgtaacgatacaggttacttattttgacagccagtttaattttctcggatatggtctatttgccactgtgacgtcaagcagaataccggcagccgaaaatgggacatggcttgaagtctatcaaacaacttcaccggctccccttggcaccacccaggcattcattttgattaacaatattccgcaggcgggaactgccagcgtgtttgtggatgatgttgctctattgagtgttgagggtggaggagccccaacgggagcgaccgggccaacaggagccaccggcccgacaggagcgacgggtccgacaggagtaacaggtccaacgggagtcaccggagcgacgggaccgacaggagtgacgggtccaacgggagcgatgggtccaacgggagccaccggagccacaggaccgacaggagtgacgggttcgaccggggtgacgggagccaccggagcgacgggtccgacaggagtgacgggtccaacgggagcgatgggtccaacgggagccaccggagccacaggtgcaacaggagcgacaggtgcaacaggagcgacaggtccgacaggagtgacgggagcaacaggagcgacgggtccgacaggagtgacgggagccaccggagcgacgggtccgacaggtgcaaccggagccaccggcccgacaggagcgacgggtccgaccggagcaacgggagccaccggcccgacgggagcaacaggagcgatgggtccaacgggagccaccggcccaacgggagcgaccggtccaacaggagtaacaggttcaacgggagcaacgggagccaccggcccgacgggagcaacaggagcgatgggtccaacgggagccaccggcccaacgggagcgacgggtccaacaggagtaacaggttcaacgggagcaacgggagccaccggcccgacgggagcaacaggagcgatgggtccaacgggagccaccggcccaacgggagcgaccggtccaacaggagtaacaggtccaacgggagaaacgggagccaccggcccaacgggagcgacgggtccaacaggagtaacaggagcgacgggtccgacaggagtgacgggtccaacaggagtaacaggtccaactggagcgacaggtgcaacaggagcgacaggtccgacaggagtgacgggagcaacaggagcgacgggtccgacaggagtgacgggagcgacaggtccgaccggagaaacgggagccaccggcccgacaggagcgacgggtccgaccggagcaacgggagccaccggcccgacgggagcaacaggagcgatgggtccaacgggagccaccggcccaacgggagcgacgggtccaacaggagtaacaggtccaacgggagaaacgggagccaccggcccgacgggaacaacaggagcgatgggtccaacgggagcaaccggcccgacaggagcgacgggtccaacaggagtaacaggttcaacgggagcaacaggagcaacaggagcgacaggagccacaggtccaacgggagccaccggcccaacgggagcgacgggtccaacaggagtaacaggagcgacgggtccgacaggagtgacgggtccaacgggagccaccggagccacaggtccgacaggagcgacgggtccaacaggagtaacaggtccaacaggagcgacaggtgcaacaggagcgacaggtccgaccggagcaacgggagcgaccggcccgacaggagcgacgggtccgaccggagcaacgggagccaccggcccgacgggagcaacaggagcgatgggtccaacgggagccaccggcccaacgggagcgaccggtccaacaggagtaacaggtccaacgggagaaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacgggaacaacaggagcgatgggtccaacgggagccaccggcccgacaggagcgacgggtccaacaggagtaacaggttcaacgggagccaccggagcaacgggagccactggcccgacgggagcaacaggagcgatgggtccaacgggagccaccggcccaacgggagcgacgggtccaacaggagtaacaggagcgacgggtccgacaggagtgacgggtccaacgggagccaccggagccacaggtccgacaggagcgacaggtgcaaccggagcgaccggcccgacgggtccgacaggagtgactggagccgccggagcgacaggtccgacaggagtgacgggagcaacaggagtaacaggttcaacgggagccaccggagcaacgggagccaccggagcgacgggtccgacaggagttacgggagcagcaggagcgacgggtccgaccggagccgccggagcgacaggtccagctagtccacaaactgctatattctttaacaatctatttgggtctacttcagtttacaatccaccgactattcctttaaataccgaggtaactgttgtaaacgtccctaatgtgccggtcactagcggtcagaatattaaggtggattatgcgttggcagtagaagcggtgaatactgctaacagtaatatagtttttgaaataagactttatagaggcggaactttagttcaatctagaatctttaatagaagtcttgcatccgcaggaactcaaagatttccattggccagtacaattgttgatactgttccagccaccgcaacaattgactattcagttagagttgcggtgacaactgcttcaaatgttacttctgcggcagcattcaatagagatttaaatctaattcgtttcccttaaaaagggtaggggaggttcttttagagccttcctttttgtataacagtatctattcgaacatttgtaaatgtgttttaaccgtatggaaaataacgtgacctcatcatgaaagaatacatagtatatgttagcttcgaccttaaaaggggtgaagcaaatctaaaaaaaggaggtttaaatcttagatgtccattcaaaattcggtagtaaatggaagttttgaagcgggatcactctctccttgggcggggcaaaatgctgcggtcaccactcaattttcccattcgggcttttggtcggcaacattattgggtggagcaacggtatctttcattgcccaatttgttccagtagatgaaggggaagggcttgagtttcttgtttcgttggctaaatcaggaatcctaccatctccccaggtgcagattcaagtatcatattttgatagtatgtttaatttcttgggtcagggactttttattaatattccgtttaatagattacctgtcgtgcaaaataatgcatggcttgaagtttatcaaacgacatctccggctccttcaggttctacaatggcatttatcttaataaatacactgcctcaagcaggaacagcaaatgtcatagtagatgatgtagctttgttagatatagaagttgcagatgtaatcggcccaaccggcccgaccggagcgacgggtccaacgggagcgacgggtccgaccggagcgacaggcccgacaggagcaacgggagcgacaggcccgacaggagcaacgggagcgaccggcccgacaggagcaacaggagcgaccggcccgacaggagcgacaggcccgacaggagcaacgggagcgaccggcccgacaggagcaacaggagcgaccggcccgacaggagcgacaggcccgacaggagcgacaggcccgacaggagcaacaggagcgaccggagcaacgggagcaaccggcccgacaggcccgacaggagcaacaggggcgacaggcccgacaggagcaacgggagcgaccggcccgacaggagcaacaggagcgaccggcccgacaggagcgaccggagcaacaggagcgaccggagcaacaggagcgacaggagcgacaggagcaacaggagcgaccggagcaacgggagcaaccggcccgaccggcccgacaggagcaacaggagcgaccggcccgacaggagcgacaggcccgacaggagcaacgggagcgacaggcccgacaggtccaacgggagccaccggcccgacgggagcaacgggagcgaccggcccgacaggagcgaccggagcaacaggtccaacaggagcgacaggagcgaccggagcaacaggtccaacaggagcgaccggagcaacaggagcgacaggtccgacgggagcgaccggcccgacaggtccgaccggagcaacgggagcgacaggtccgaccggagcaacgggagcgacaggagcgaccggagcaacgggagcgaccggcccgacaggagcaacgggagcaacgggagcgacaggtccgacgggagcgacaggagcgaccggagcaacgggagcgaccggcccgacaggagcaacaggtccaacaggagcgacaggagcgacaggagcaacgggagcaacgggagcgacaggtccgacaggagcaacaggagccaccggcccgaccggagccaccggagcaacaggagcgacaggagcaacgggagcgacaggtccgacgggagcaacgggagcgacaggagcaacgggagcgaccggcccgacaggagcaacgggagcaacgggagcaacaggtccaacaggagcgacaggagcgacaggagcaacgggagcgaccggcccgaccggagccaccggagcaacaggagcgacaggagcaacgggagcaacgggagcgacaggtccgacaggagcaacaggagccaccggcccgaccggagccaccggagcaacaggagcgacaggagcaacgggagcgacaggtccgacgggagcaacgggagcgacaggagcaaagcaacgggagcgacaggagcaacaggagccaccggcccgaccggagccaccggagcaacaggagcgacaggagcaacgggagcgacaggtccgacgggagcaacgggagcgacaggtccgacgggagcaacgggagcaacaggtccaacaggagcgaccggagcaacgggagccaccggcccgaccggagccaccggagcaacaggtccaacaggagcgaccggagcaacgggagccaccggcccgacaggagcgaccggagccaccggagcaacgggagcgacaggtccgacaggagcaacaggagtgacaggagcaacgggagcgacaggtccaacaggagcgacaggagcgacaggagctacgggagcaacaggagccaccggcccgaccggagcaacgggagcaacgggagcgacaggtccaacaggagccaccggagcaacaggtccaacaggagccaccggtccgaccggtccaacaggagcgacaggagcaaccggagcaacaggagccatcggcccgaccggagcgaccggcccgacaggagcaacaggagcgaccggcccgacaggagcaacaggagcgaccggcccgacaggtccaacaggagcaacaggtccaacaggtccaaccggtgcaggattagtttctgcattaagtgcaagaaaccagggaacggttactgtaggtgtaggcggtttagttccttttgctacacctgaagaatcatttggaactgatattactcaaactgctaccacaacattcacaattagttctcctggatattattctgtaagatttattctgtatacagcagctctatctcttctgggaggagcacaaattgtagtaaatggaacgccagtatcaggagcattcactttaatcagcgtaggtactccattagtgggagaagctatgattgaagttactgctgtcccttctactattcagattgccgtcactggattagcgttaactcttgctacaggaaacagcggtcatatccaaatcgaaaaactttctaattaatattctcattaggaagctgttccgtaggtttttcttgcggagcagtttctctttaaagaaaactaattgtacaattgagagttacacattgtctgtccaaatattaaacgatgcttgtaaaaacatcgaatattccactagcattttcattctaacagatttgcatatattctcggtccaactgtctcttaatctacaggtgaatgttttttttcatggaagttcgctgtattgttatgtgaatgaatcaggtggtaaatctatggtttactacctgtttttttattcttgtattaagaataaaaaatatcccgttcactattctctgtgaacgggatattttgaactaatcaaccttaaatttgataaatgattgtatggctgaaaccacatgatctaaatcgacttcatcatggcaagggagggtaatcgtatgttgttcaagaaagagagaattcgattttagctgttggtatttccggcggtaatagggagtgccgcttaaacaataagtgccgaaagtcgactctatatggcagtcgctcaaatattgaatcaattcgtcgcgaacgatgttttttggaactttgaaaacggcggattgtatgttgtgtacaacggctggaccgattttttgactttggaatccgaggggttcaagctgttcactatatgctttctgctgaaggtttctccgatgaatgatgtcatcaagtttttggagctgtttaattccaagagcggcttggatatcggataatctgtagttgtagccgaaatctataaaatccaattttccgtcagagatggcagcgccatggtttaatttgaccgaaagccagtctttcaactcttcccggtcggttgtaattgccccgccttcgcctgtcgtaagcagctttcttgggtgaaagctgaaacaggtgagatcggcaatttttccggatttacagccgtattcgctgctgccgatcgcacaagcggcatcatccacaaggggtaagccgtactccttacaaatttgcttaatgttggtgatgcctgtcgggtttccaagagcatctacaaaaagaacggcttttgtacgggacgtgatttgactttccagttcttctggaagcatgttaaatgtttcaagatcaacatcggcaaaaaccggcttggctcctaaatcttctattacattgacagtggcggggaacgagaagtctgagacgattacttcatctccgggttgcacgttcaggcttttaaggcacatcgataaagccgttgttgccgatgttgttaaaaaagcatgctttgcactgacatactgtctcatatgatcagcaaatgttctgacataagggccttttgtcagcatgccagaggaaaatatctcctttaattctgcttgcacttcttcaaatgtaatatacggctcgatcaatctgatcatgagagatcctcatctttcattcttcggtttttaatcacctttgccggcacgcctactgctatgctgtacgggggaatattgcgattgacgacggcatttgctccgattttggagtgggcgcctatcgtaacgcctgctaggatagacgcaccgatcccgatgttgcagttttcttcaatatgaataggagcgaatgtaagcggcgaaaacaaaatggtactgtcgggtttatcaggatcggtatggtaagcggcatgtatccggacgttcggaccaattcctgcaaattctccgattgtaaccccgccggcaccgtgtataaaacattgctgcccgatccagctgtttgaaccgatgatcaggtcatgcttataatagccttttaaaatcgtgtcatggccgatataaacgttatctccgatatagatgttttccggatgaaaaatgcggaccccgtcttcgataacgacattttcgccacagcccccaagctgggaaagagtgaattcaccttttccttcgcttttccattgtttcaacaatagcgcctcctttcttattgatccaaattttttttaatgctttcagctgttcttctgatgccttcttccagatcaactttagcgctgaaaccgagcatctcttttgctttattgacctgagggatgcgcagttcaatatcggcttcttttttctccccaaagaagatttgtgattttgatccgagaactctgataatcgtgcttgccaatccgtatacggtgatcacagtgcgttcattgccgatgttgaaagactctccgatggcttccttcatcgtcaaacaacgcaaaattccgtcgatcatgtcatctacgtaacaccaggcccggatttgcgttccatcgccgtgaatatagatcggctcatctaacagagctctgtgaaccatcgttttgatggcgccttcgccgacttgttccggtccataaacattaaaagggcggacggtgacggtcggaagcccaagttctttaaaataggcatatgccatatgctcctcggcgagtttgctgacagcatatgtccagcgggcttctcccaccgctcctaaaacagtatgactggtctcgcgcgctctgaaagcgatttggccgaacacttcgcttgtactgaaacagacaacccttttgcattcggttaaaccggcagccgcttcaagcagattggctgaaccgatcatgttgacctgcatcgttttaaccgggttttgaatgaccgtgtcaatcccagcgatgccggcggcgtggacaatgtggctggccccctggatcgcctttttaagcgcgttcaaatccaaaatgtctccctgcagcactttcaagtgaggatggtcccggtaaggcttataccggagggagtctcttgaaaaattgtcatatacggtgacgctgttgcgctctatcagctttcctattaaagaggatccgataaagcctgctccgccagttatgaaaatatgctggccggataactctgtcatatcgctcatcaattgttcacctgcttgtttcgtttttttttacatacaaatcccgcgacgggaaagttgttcaacttcattccgaaagtagcgactgataaacagccaatgtttttttgctgtttttcaccatatcatgatgaacttctgcatactttcttcctttctggccgatttccggcagcatatcccggtttttaagcacattttcaatcacctctgtaatgttggcgggatttgctcttataagaggcagttcggaaggatagtgatccttcataaaatcactgatccagcagataacgggtttccccattgccatcgattcgacggcaaataatccgtagctgccgatatgaagctgatcaatgatcaaatcagccttttggtagattttctttgcctgttcatgagaaactccttgtactaggtgaaaatgaaaatcgtatttttcttttaaagattcaaccgccttaaggatgtggcgggttccttttattccgggagaggtgggggcatgaacgatgagcggcttttcatttgacctgtagtcgggagtatagcggtcaagctggatcatggtcggaatcatgtggacatgctcataatagtcttttacatactcgtaaagctccatatcggcgacgatgcagtgctggacatattgggaaattcgtttgaggtggtatcgaattcgagcttcgtttttcgttttgacaacggcgtatggatttgttttagccaatgttgaataaagcctcacatcgctgccccaatgatgcatgaccattggtttctcagcctgttttaaaatgggataatccgacatgtccagcgtgaagcttgtgccgaaatgaaaatggaacaaatcataggatggcaggagatcattggcaagccttctcagcttcgcattcatggcgggcgtattgcgttctttcagcaatgaccaggtgtagtcggcagcgtaatttaaataatacggatagtaatttaaagtgtgggcaagcgcgccatgctgtgagagccctttagccaaggtattcatttgattggcgatttccattgtgccttgcaaaatgcggatttgcccagccggaggttcggttttttcgtcaacaggaagatccagcttcggccagcttgcggtttctgctccatctcctttttgaagataggccgcgctttctttttcccttccggtgcgcaggcacacttttcccatcagcagatttaaagatctgttttcaggaaaaagatcaagccctctccagagccacagccaagcgttatagtcatggccgagatagacagaaagagaggcttgaagaaaataaaagtcaggctcgttatgcgatccctgggcttcccactcctttaggcgcttcatggctttgttccactctttttgttccagacaatgaatgatatctgatttgaaatctttcatgatgacctcccatcgatcatgctgattcaatttctccttttaaataacagaatacaaaaacactttgtgcgctctatcatacgtataaatgaatctatatgactgtgtatttgtgcgagagtataagagaaaaaccttccacagagcggaaggccttatatcagctggatttttttaatatttttcatatatcgttcatactgattgtctgaagcgaggcttaattggaagtattcatccattttatccaggagcggctgaatgcattcttttttggcgtcttgatctaaatgccgggtatatccgttttgtgcgtatctccgggccattctccaaaaggtttttccgatgctgaaatatttcaaggactgtctttgattttcctcaagctccttccatttgatatgaggaaaatagacgctttcgtcaaattctttcacaatataatccatgacgtacacaagcgattgaattcttttatgcaattggtaggaaatgtttttttggtggcggcggtagcataatacaggtttttttaaatagcgccgcttccagccgcgcttcgtgttggccaaacaattcagcacatcccctgcaagcggcttttgcggatcaaccagccaagtgaagcctttttgctgataataagatgctttaaacatgcccaccatcgggacaatgcctgagccgcccctttgaaaaatagtcctcaccagctcctcatcgccatactcttgatatgtccacagacccgcatttttcccgtgttgatcaacgagcaaaaggtcgccgtaaacataatccaatccctcttcttcaaaaaagcattgcataaagtcatggatcaccaaattgtgcgggaggaaatcatctgcgcttaaaagcaaaacatattctccctttgcctcttggaagatttccttaaaagcgagatcaggaagttttgtattttcgctgtggcatatcgttcgaatgtgcggatgcgttttttgatagctgctgattttttgcatggagtcgtcagttgaatggtcgtcaacgatcagaatgtcgatattagggtagagttgatttaaaacggattgaaggcattcatcaataaaattactgtaattatagttgatgatgcctaccgtaatcagcggcggatttggcataaccgtcaactctgactgctttgcaaagcctgaaatcatctcttcaattttgcgcatgctcaggtcatatgaataatgctcttcaataaacgaccgataatggagagatgtataatcaccgcttgtgatcatggccacgaattcatctattgtattccaaacaactgattcatcgtatatcgtctttgcgccgtaaaaattgtgaatcagcggttttatgcctttagccatcgcttccatggccgacatatgctgactttcaagaaggctcgtgcaaatcaggtaatgcttatcttccaagtattgattcatatcatcctgccatccgtcaaattggacgctgtcagtcagccgcagttcatcaatcatttgcttgaagtacaactgatagcgggcgtcctgaaacgtcccggcgataaacagtttgtatcttgggtctttgtcaatcagtgctttgaaagcctgcagcaaaagcatcggcccttttttatagttgatatagccgacataagcgatgtgaaagcctttttgcctttgtttaaaagtgtattgatctagcttgattccatttggaacgacggccgttttctcttttttcaacgccttgacttgatccaatacgtattcccgcaaatgctctccgtcaaaaatcacttggtccaccgcttgccaatatacctttttaatataaaaagtaaatgcttcatagctgtggagtctgcatattaatgttttagccgctgcagaagggactttgctcccgtggatcaataaatcatcgcaccattcaaaccagcaaatatccgcccattgcatgccagcgtcgatttgattcaggtcatgaaccacgattttttttgtccggtaagttccggaaaggtgctcaacgacagaattcaaaaaccggtccaaatccggtttgacgaaaaaaatgatttttggacgcctgaccatttttttgaaaaggtcttctttctccttcatgaggcgaggtcgatgttcgcgcctgacaaataggagggcatcatcatataattcagacgctctctgagcctgctgctttttttcacagacaaaagcagcgcttatcagcaagccgggatcgaagggagcggctttcagcttctcttcaagcttctgcgcagcatcgtgccatttgtgatgaaaaatcagttgggatatttcagtttctctccagctaagcccaacagagtctagcagatattccaattcattatccatctgaaacctcctggttaaacacattttcgctagtagtatctatattcaaacgaaaaaagaaagttctatgaaaaatactttggaaatggcgcagccttgaaaatataaaacagtgatagtggcacaaacgcgatcagctgctgtttcatattttatgggtagattttaaaaaagagtctcagggagtgaaggctttggttacaatcagtctatgtatgattgtcaaaaatgaagaagaagtattagcgagatgccttgatacagtgaaagacattgtagatgagattaatattgttgatacggggtcgacagataaaactgtagagattgcgaagcgatacacagaccgcgtctttttctttgaatggatcggcgattttgcggctgcccgcaatgaatcgttcaaacacgccactaaggattatattctctatctggatgcggatgatgttttgcttgaagaagatcagaaaaaactgaaagagttgaaggaaacgcttgatccttccgttgattccgtgtctatgtactatgatgctggaaccgacgaattcggaaatgtgacattaaggtaccgccgcaaccgtctggtgaaaagggagaagaactttaaatggaaaggcgactgccatcaatatttggaggtattcgggaacatcatcaatgccgatatttcagtgacgcataaaaaaatccgccactctgtcggacgaaacctcaatatttaccaaaagaagattgatcgcggcgacacgtttaccccgcgcgactatttttactacggtaatgaattaagagaaaacagacactacgaaaaagcgattgaaagctacaataaaaacattgaaatgaaagaaggatggattgaagacaaagtatacgcctgcatcaacaaagccgactgccaccgctttctcggcgacatggacaatgagctgagatctctgttccagtcatttgaattttctaaaacgcctcgtgccgaaacatgctcaagaatcggctataactttcagcggaggcgggaatacaaggccgctatctactggtatgagctggccacaacattggtgcctgattcaaataaatggagcttcacctatccggcatactatacttggtaccctcatttgcaaatgtgtgtgtgctattacaatttaggagactttgaaaagtcgtatcatcataatgaagaggcgaggaaataccgtcccgaagacaaatccgtccttcataacaaacagctgctggaagggaaattaggcattaacaattagcattgtaaagacttactgaacaagtaggtcttttttttatgaataaaatcaagccgtgccaatttagcggcaggcatcataacttattttggaactttttgaatttagaggaggaacaaaggatgatcccgttagtcaatttaaaacgtcaatttcaaacagtaaaacaggatattttaaaagagtttgaacatgtgctggacagcggccaatatatattggggccaaaggttgaagaattagagaaaagaatagctgaaaagcttggtgtaaaagaagcggtcgcggtcgccaacggaacggatgcattggtgctgacgcttgaagctttcggcatcggcaaaggggatgaagtgattacgaccccgttcacttttttcgccaccgccgaagccgtctcaagggtgggggctgaacctgtgtttgctgatgtcgatcctgaaacatacaatcttgatccgaaaaaaatagaagaaaagatcacccctgctactaaagcgatcattcccgtccatatcttcggacagccggctgatatggacgagatcatggagcttgccaaaaaacacggactgcttgtgattgaggatgcctgccaagcgttcggcgcatcgtataaagagcggcctgtcggcagcatcggggatgccgcctgtttttcatttttccctacaaaaaacttgggaacattgggagacgggggaatggtgacgatttcagacccggatgcagcccggcaattaagaacactcagaacccatggcactagcaaaaaatacttccatgacaaaatcggtttcaacagccgtcttgatgaattacacgccgcagctttactcattcttcttgagaaaatcgacggctggaatgaacaaagaagaagagtggccagccgctacagagaaggtttgaaaacggcggagcacctcacactgccggcagagaaagaggaccgcacacatatctatcatctctattgtatcggcgcgaaaaaccgcgactacatcatacaatcgctgaaagagcaggacattcattcaggtgtgtattatccttgctgccttcatctgcaatcggtctattcttcactgcagtacaaaaaaggcgattttcctatagccgagtccttgtccgaaacccttttcgccattccgatggatccttttctagccgccgaggaacaagatcagattatttctgcgctgctgaaaaaaggaggaggggaaaagtgacggttcattttggtttaatcggctgcggctatatgtcaagaaaacatcttcaagcactggccgagtgcgatgatgcaaagttgtcggccgtcagtgatttgcaggaagaaagaatgaaggaagcggaagaatactatgcttccctcgccggtgaggaaagccgaatgacccgctatccgcagtatcaagcgctgctttcagatcctaaaattgaagcggtcattattgcggcggtttcgggactgcacgccgaaatggccaaacatgcgctgctggcaggcaagcacgtcatcgtcgaaaaaccgatgaccttgtcattacgggatgccgatgagcttatagaactggcggagcagaacgggctgaagctcatggtctgccaccagatgcgccaccggccgatcatgaaaaaactgaaggaaacgattgaggaaggaaagctgggaaagatctacttgggcacggtatcgctccgcttaaacaggtcccccgcttattatgaagcggcatcctggcggggaagctgggaaaaagacggcgggatgctggtcaatcaagggatacatctgatcgatctgctgcaatggtttttaggtgatgtaaaaggcgtttacggagatatgctgggcggctccggagctaaagaaacggaagatgttgctgtcggtattctgacgtttgccagtcaggcgaaaggtgtagtagaagcgaatatcgtcacacagccaaacaatatcggaagctctctctcgatttttggagaaaatggaacgatttcattggaaggtccggcattaaaccggatcagccgctggtacatccacggggagaaggcggatgctgaagaagcggcaaagctgattgacatcggcggcgaacaaaccgcaatgtatcaaaactttataagcgccctcaagcgccaagacacgctattggttgacggctatgaaggaaaaaaggcgattgaaaccatctttggaatctatcaatctgtgctgcagaagcaaccggtgcagctgcctctttcttcatttcaaacaactgatatgaaaaataaataggttttgttttggtagatcgtccctttcaaaaaaagatttgaaacatagtttattaaaggaatgtacagaaggggcgagttgataaatgagcaaacaggaaattcataacgaaacgatagcggtcatcggcttggggtttgtcggtctgcccttggccatgttgttgatatcaaaaggaatgcgggttatcggtgttgatttggacaaaaagaaagtcgaggcattgcggaaaggaaccagctatatttcggatataaacgatcaagcggtgcaggacggaataggcaccggtttctttcgtcctgtttcggactacagtttaatcggtgaagcggatgccgtcatcatctgcgtgccgacgcctttgaatgatgatgcgggtcctgatttgaattatgtgaaaagagcggcgcaattgattggagcgcacttgaaaaaagggcagctcgtcgtgttggaaagctcgacatatccgggtacgacaagagacatcgtcaaaccgatcctggaaaaaagcggccttgtatgcgggaaggatttttacttggcttattctccagaacgcgttgatccgggcaatcagttcccgattgaggtcgtgccgaaggtagtgggaggagcgacggatgcatgccttgaaaaggtgcatcaattatacagcggcatttatgaagaggttgtgcctgttacatcgccagaaacagcggagctgacaaagctgctcgaaaatacgtaccggtttattaatatttcattcattaatgaattcgcgatgatatgcgacaggctcggggtgaatgtgtgggaagtcatcgaggcggcaagcacgaagccgtatgggtttgcggctttttatccaggccccggcatcggcggccattgcatccccgtcgacccgctgtatttgcagtttgtcatgaaacaaagcggattatcgagcgactttatcgagctgtcggaagcgacaaatgatagaatcgtccgctatatttcagagcgctccttgcagctggcagggaaagacaaggcgacagacgcccgcatcttaatctacggcgtcacctataaacgaaatatcgcggatgtccgcgaatcaaaatcgcttgatattatagagaagctgatcggcatgggagcagatgtttcctaccatgatccgcacgttccggacctcgacctcagcggcaaaaagctagcaagcgtgccgatagattcaaagatgctgaaagagtatgactgtgttgtcattttaactgatcatgacgcactcccgaaagagctgttattaaaccatgcaaacgtgatatttgatacgagaggagtgctgagggaagcagccggaaaagcaaaagtcatccagctcggaaacgggcgctcctgaatcaatttttctgcagcgactcacgcccagatccgttcggaatacaataagttaaaacaagaacgaaaagggtgagggccgtgtggatcggaattctgttgatggtctctgggattgggatcagtattttcgccgtcagtctgattgtcagctatttgtttgttttgccgaaccggagcacatatgaagaaacttttttcagcggactcaaacacggcgagatcatcgatgacgtgtttgagtcccacgacaaagaagagctgtttttgacagcaggggatggatgccggctgcatgcgctgctatttcccgttcaaaagagcaggaaagccgtcatcatctcccacggcatcaagtggtcgctgtttggcgggtataaatacgtcgagctgtttcagtccatcggctacaatgtcctgctttgcgacagcaggtgccacgggttgagcggcggttcacacgtttcctacgggttttacgaaaaggatgatttggcgaggtgggctgacgagcttgagaacaggttcggcaaagatctttggatcggggtgcttggcgaatcgctcggagcggcggctgccatcgagctgatgaaacaggatcggagaatcaagttttgtattgccgattcctgcttcagcgatttaacagagctatgccgctttcagctgaaagccgccgtcaaattgtccgtgccgtttctcatcccgttggcaagcgggctgatcaagcggcgccacggctggagccttgctgatatatcgccggtcagcaaccttgagcagtcagacacgccgctgttgatcatccacggcacaaaggatcagcttgttccgccggaaatggccaaaagcctgtatgagaggaaaaagggattcaagaaactgtactggattgaaggcgccggacatgtcggcggatttcgccacaatcctgaggaatacttaaataaaatcaaagactttatcttgaaaatcgagccggccaattagccttgcgattccagtttttcagcggctgccgatctttggcgcgcttccttgattttgccggcgtaggacgttccccaattcatcatttgccggatgatcgggatcagcgtcttgccgaactcggttaaactgtactcgactttcggaggaacctgtttgtaaattgtacggcagacgatgccgtcgcgctcaagctctcgaagctggagggtcagcatccgctgagtcacgccgggaattaagcgccgcagttcattaaagcgttttttatcatcgatcaagtgatacagaatgacgcttttccatttgccgccgatgatatcgatcgttgcttccaccggacatgaataaccgtccggtgcttcgcatgctgccggatgttttttcattttcttctctccttagtataaaaaatgatactatgccacaaaaatgtgcgtactttcttattgctattataatgattagaatgaaattgagaaaggaatataaactatagagaaaaggagagaacataatatgacagagcaatccaagaagcaagagattcttgacgcattccaatttagacatgcgacaaaagaatttgatccggacagaaagatatcagatgaggattttcagttcattttagaagcgggcagactgtcgccaagctcggtcggcctcgaaccgtggcaatttgtcgtcgtccaaaataaagagctgcgtgaaaaactgcgtcaagtctcatggggtgcacaggggcagcttccgacagccagccatttcgttttgctgctcggacgcacggctaaggaaatgcgacgtgattccggctatgttgcagatcaattaaagcatgtgaaaaaaatgccggaggacatcattgaaaatatgctgaaagaagacggcgttctggaaagtttccaagacggcgattttcatttgtacgaaagcgacagggcgatgtttgactgggtatcaaagcaaacgtacatcgcgctcgccaacatgatgacggctgccgctttgatcggcattgactcctgcccgattgaaggctttaactacgacaaagtccacgacatccttgaaaaagaaggggtgttggaggatggccgctttgacatctcggtcatggccgctttcggataccgtgtgaaagagccgcgtccgaagacgagacgggcgcttgatcaaatcgtgaaatgggtcgaataagaaaagtgcggttctgcataagcagaccgcactttttatatttagatctggagcttgcgccgcttcctttggtaaaggtacaggccgcttccggatataagcaacagcaggccgagcatcagccaatgataggcgtttgaagcggtgtcaggcaaaaaaccgccgtttgaaccatcggaaggttcatttccgtcatctgctccgccgctgtcatgaccgcctgatccgtctccgccgctgccggcgccgggcgaagcagggggttcaccgccgctgccgccatccggagtgtcatcatcgccggaacccgtcggaagggaaggcgacccggcatcattgtcattcatcacggtatactcgctgaaatggtcgacatagcctgcaacggtacggcctttcgtatagccgtttgttacttttgtgaagctgttgtttttgcggtcgacataatagacgctcaaatgtttatcaggagcatcgacttggaacaacagtccgacaggctctttaaatgtgctgaccgttttaccattctgctgaatgttgaaatcatatacctttgtgaccgcctgtttgatatccttggcgattttaatgctgatttttgtcttttcgcttgccagattaacggctggaagctgcatcgcaatgcgatcgtttttcagggtgatgcttggatcaccggttctttctttgacaaggtcagtctgtgcttttgtcatattcagcatgatgtgttccttttctgtgtcagggaaataggcaatcgcctgatttgcgtttttcgcgtatgtttcgaacggcttttccgcaagcgtccaagagccgtctgcctgacggtcgggaaggaacacttctgtgattctgttctcgatgttcggtgaaacagaatcgtataaggcaagctgctctgtaaaaatgtcgtaatcggtaaagccgagatcgacaccgtttttcgcttctttaaaaacggaatagccgtctccgccgccgcccatgaagttatttgtagcgacacggtaggttttgtccaaatcgagcggaacagcgtcccctttgtcattgactaggttcacatcaaggattcgctcaccttttggcttgctcagtgtaaaggtgaaggatagacccgaaacatgcggaaacgcgcctccgccttcttcgacttggctcaccccgtgctcaagcgcttctttgatttgcgcccccgtcaaatcagcggcataaagggtgttgccgaacggcatgaccgtcagcacatcgccgagtgtgatttcgcctttggcaataccgcttctgattccgccgccgtttgtgatggcgatgtcagctccgccggcttgttttgctttcttcagcatgccgtccgcgataaaattgccgaggttggtttcttttgagcggacatgctcgcgttttccgtccagcgggacatcggcatagcctacttttttctttttcagttcgtcaatatcttctttaaagccgtcaagcacttctttcccaggagggtcttcgtccactttgtcgtcgatcgcgatcaaattgaaccttgattggtccgtttgaacgacgccgttctcatcaaacaccacatcgacccttcccaaaaactgtccgtagtctttcacttgagcgacgattgtcggttcttcgttctccaccactttcaagtgatcgacaagtgtatgcgtatgcccgccgataatcaaatcgatgcccttcactttcttggcaagctccagatcccggttgtagccgaggtgggtgagggcgatgattttgttgaccttttctttttctttcagttccttcaccgttttctctgctgactgataagcgtcatgaaacgcaatgttcggaccggggcttgatgtatatgacgtatcttccgtcgtcaagccgaatacgccgacttgttcgccgtttacatcaagcagaatataaggatagatgccgctttctttcttttttcccgctgctaagactgcaggctctttctgaaagcttcgcagcttcggctcttttgatacatccacattggagctgacgatcggaaaatcgggcttttccagctggtgtctgtttaacgggtcgacggctgtatagtttccgctgagaaagtctgcgagcactttaggccctttatcaaattcatggttgccgaaggtcatggcgtcatagcccatcatgttcatcagtttcaaatcggcgagtccgttccattttgtaaaatacagatcgccggaaaagacgtcgccggcatcgagcagcacattgttttctgtttcactgcggatttctttcactttggcagcgcgccttgccgctccatcaaggtgggcatgcgtgtcgttcgtgtgcatgacggttaatgtccagttttcatcatcaactggaggctctgaaccgtcaaagttcagcttatagacgccatatcctttgttttcggattccctgacaaaatcgatgtcattcgctttttcagcaaacggtttggcaaggagggaagactcgaatgtcacgtcggctcctttaatcggagcgatcgaccagttgttgtcggcggcgggattgaccgttttcttctccataatgtagttcatgagcacctgcctgttttcatcagccgccgcataaacgactttgtcctgagtcagatgcgggaatccgccgcccccggaggcgcggtaattatttgtgacgacaaggaattcctggtcgtcgcggacgggttttccgttgtaagacaactgtttgacgcggttcgcctgcggatttttcaccccgcctgaggcattgtattttgcaggctgtgtgacatcgatctggtaggtcacaccgtcaatgacatcgaaattatacgacctgaaatcggggttgaggagcgcctgttcacccgattttgaaggatcgatctgattgaactgcccggccgacatttcgatccagtccttcacttcgcttcccgtcagtttgacgatatagagcgtattgtcgtacaaatacaaatcgccgatgtttttgatcgcaaggtttcctgctttaatgtttgtataataatcagcaccgttgcgtcctcctgctttgaacggcgcgcccgctgataaaatcggcaggttttcgtattccgttcccttcatgacatcttccgcataccatttttgtgcatctgtgacaatctggattgaaggatcgtcttttacctgcgcgaaaaagctgttaatatcagcttctgtttggccaaccggcgcgcggacgtattcgagcgttttttcgtgcgtatctttaatcgcggaaacgacggtttcgtttcgcgacgtcacatttccggcaatcgcttccgtttttgcgctggcatctttcactttccatttgccgccgtccagttcaagctgcatatcgataattcctaaatggctgccccagttcttcggcatgacgacaggaatgccgttgatcgttcctttttggttgtcgatcacgccgttaccgggatagtcggtgccggggaacagaccgtgctgatgtccggagatgatcgcatctattccttccgtcttgagagccaggtcgtatacggcgttttcggctcccgccgcctgttcgccattttcaattccggagtgggcgatcgcgatgatcacgtcggcgccttcctgtttcatttttggaatcgtttcttttgctgattcggtgatgtcctgcactgtgattttgccgtccaggtgctttttatcccatgttaaaatctgaggcggaacgaagccgatatagccgactttaagctggtgctttcggccgctttcatccgtcagcgtccggtcttcaatatgatatggcgtatatttgttctttccgtccggtgttttaatattggcattgacgatgggaaattcggccccttttatcgtgccgtcaaggaattcaaggccgtagttgaattcgtggtttccgagcgtgccggcgtcatattgcagtttgttcatgacatcaatgatcgggtgtgttttcgttccggagataatcgattcacgttcatgtttgaagatgtattcccctagagggtttccttgaattaagtcgccgttgtcgacaagaatcgtgttaggattccggctccggtacttttcgatcagctgagccgttcgtgccagtccgaattcagccgtttctttgtcggcatagtagtcataatccatcatatgggcgtggatatctgtcgtacccaagatgctgaggctgatcagcgggtgttcgttttgttcttctgcatatgtctgggtgtttggcatgagtaaactgagtatcatcactgaggttagcagaatacggagaatgtttttccttgaaaaccgtcttttctgtattcccaccatttctccacctttcagattagagtaacaatttctattgtaagaactttttgtaaagttttgtagaactttcgttgcgaatattgtaaacactcagaaaatgattccaaagtctgtctctgtctgccgggtgacttaggtactttgtcgcgagggcgtggggatgttttatttagtgtggcaggggtaaatagatttatgtagacagaagcttctgggagggtgatcaatatgagcaaaaaaattgcagttgttctgacagattactttgaggattcggagtataccgagcctgcgaaagcgttcaaagacgccggacaccagcttacggttattgaaaaagaaaaaggcaaaacgctgaaaggcaaacaaggcgaggcgcaagtggaaacagatgcgtccattgacgaagtcagcccggctgattttgacgcattgttgattccgggcggattttcgccggatattcttagagccgaccagcgtttcgtatcgtttgcaaaatcctttatggatgacaaaaaaccggtgtttgcgatctgccacggcccgcagcttttaatcaccgccaaggctctggacggtcgcggtgcgacaggctacacatcgattcaagtcgatttggaaaacgccggggtcaaatttaaggacgaggaagttgtcgtctgccagaaccagcttgtcacaagccggacgcctgacgacatccctgcgtttacacgagaatctttgaagctgctcggctgatgaaaaaagaccggaatagatttccggtctttttttatgtttattttcggagtgcggccagttcctctgcgattgcctgcatttcgctcggactgaaagatttctttttcatcaccatttggtgcaggtattcaaggtcttcaagcttttcattgctgaagtcttcagctttaatgacgccgatgttcagcatgtttaatttctgtgagatctcttcgatcattttgttcagctcggctgttttttgatctgacaagaaggcacatcctttctcactgatttcgtagtctttattgtaacagaattaagcgagaagaaaaggacggctgtcaaaaagcatttggcttaaacagatacgctgttttgcttttcttctttttcggctttgattttggcgaggatctgtttggattcatagacgacaatgcctgtcaaaccgagcaggccgatcaggttcggaattgccatcaggccgttcagcatatcggcaagcgcccagacgaagtcatttttaaagaccgctccgaaaaagacggcgatcacaaagatgatacgatagacgatcgcatatttttcattcagcaggtaggtgaagcatttttctccgtagtacgaccagcccaaaatcgtcgagtaggcgaacagcagcagtccgatcgcgacgattgtcgatcccgcaggaccaagaaagtgtgcgaatgtcatcgatgtcagggcatcggttttttctgtcagatacatatttcccatgacaattgatatccccgtaatcgaacagacaatcaatgtgtcgatgaaaacctgggtcatagagacaagcgcctggcgggccggcatatcggtttttgccgcggctgcggcgatcggcgccgagccgagacctgcttcatttgaaaatacgccccgcgctacgccccagcggatcacggttccgatcgcgcctcctgccacggcttgcccggtaaacgcgtcagagaaaattaaaccgacagcgccggggacaagttcaaagtttgtgacaagaatgatcaatccggcgatgacataaaataaagccatgaccggcacgaacagcgaggtgactctgccgatgcttttaattcccccgagaatgacaagggcggtaaaagtcgtgacaataatgccggttacccaggcaggaacggaaaaagtggagctcatgactccggatacagaatttgactgaaccatattgcctattccaaaagcggcaagcgccccgaatatggcaaataacacgccaagccacttttgcttgaggccgtgttccaaataatacatcggaccgcctgacatttcgccgtttttatctttcacgcggaatctgacagcaagcaccgcttcagcatatttcgtcgccattccgaagaaggcggcgagccacatccaaaatacggcgcccggcccgccggcaataacagctgaggcgacgccgacgatattccctgtgccgaccgtagcggcaagggcggtcatcagcgcctgaaagtgggaaatatcgccttcggaggatttatcctgatgccttgaaaaggcgagctttaaagagtaaggcaaaagtctgacctgcaaaaaagccagcctgaaagtcaaataaatccctgttccaacaatgagaatcaaaagcggaggcccccataaaaaaccgttcattgtatctacaatatgtgaaataaattccataggcgaaatatccccctttaattttgtgtctaactagaatattctgaaagtttgttagatttgtcaatagcattgtcatcttttcttcccaaagttgaaaaaaacagaaaaatctttagtataaaagcaaaagtgttttttctttctgaaaagtggggaaagaatagaggaggctcctgagtgatgatcaaagtgttatttgtctgcctcggcaatatttgccgatctccgatggcagaagctgtatttaacgatatgctcaaaaaaagcggactggaggaccggatcgaagccgattcggctggcacaggaagctggcatgtcggcaaaccgcctcatgaaggcacaaggtcgctgctgtctgaaaaaaagataagctgcgaaggcctgtatgcaaggcagattactgacaaggacccggaagcgttcgattatatcatcgcaatggatgccgaaaatgcaggccatgtgagaagccttgccggctacgggagcaaagccgtcatccggaggctgctcgactatgtcgaagactgtgagacggcagatgttcctgatccatactacaccgggaactttgaagaggtgtacgaactcgtcgcgaaagggtgccgcgaattgctgaaggacattcgaaaagaacacaatctataaaaacgaagggagagattttttatgaaaaacgaccgcgttttcatcagaaatatcctcctcggcgcttcggtcggggcggttatgtcactgctgcacaaaccgactagggaagcgtgcggtgcaaagcttaccgcgtgcaaaaacaaagtccgcctttaccgtgcaaatcccggcatgctcaccgaatgcgtgaaagaaaaaatggacgaagccaaaaagctgacggcttccatatcggatgatttgagcttcttaaatcaacagataaaagagctgaaggaaacgacgccaaaagtgatcggcctgattgaggaaacgagggatcacttcacagccaaatccaaaggacgtacggagccggaaaaagaatgagttttttgaaagagctgggctggcgttttttccttcatgaaggaccgagcaaatcggcggaacttgcctacttttttctattgtctctgtttccgtttatgattttcctattgacattgatcggctacctgcctgtcaaaacgggcgatgtcatcgggctgatcgaacagtatgccccagaagacacgatgtccgtcattgaagagaccctgaataccggaaacaggggcctgctttctttcgggatcattgcggcgctctggtctgcatcaaacggattgaacgcgattgtcagggcctttaaccatgcttatgaagtagaggaaaaccgctcttttatcatggttcggctgacatcgctccttttgaccgccgcgatggttttcacaatattggtcgcgcttcttctgcctgtattcgggagggccatcggccattttatcgccaatctggacggtacgccggagatgtttctgacggcatggtcagcgcttcgctggggaatcagcccgcttgtgctgctgatcgtctttacggctttgtacttttttgctccgaataaacggctgtcatttaaattcgtgcttccgggagctgttgcagcgaccgccggctggatcctcgtcagcgtcctgttctcatactatgtcagcgaatttgcaaactacagtgcgacatacggaagcctcggcggcatcatcgtcctgatgatctggttttatttaagcggaatgatgattattcttggaggggaaatcaatgcccttttacataagcgtaaaatcattcctgaagaaaatccgcggaattgagcaatctataatagaacaattcatgagttcaaaagcggagggatcatcatggcaaaacacacgaaaaaaggcggcagccataataaacaaaattcaaagcaaagtccgaagaacaaaacgagcggaagcgccaacggacaaaacggatatcattaaaaattgccttaaaaggccggctccagcagccggccttttttacattggcgccgcctcagattgttcgagagcgccgtttttcttcgttttgccaaagagcaccccgatccagatcaacaccatcacgcatgtaatcaaataaaacaggttgctgttatggaatatctgcatataccacccgcctgcaaccggaccgaaaatgcttccgaagctgaatgtaattccgcacatcaagttcccggccgggagaaggcgttttggaagcaggtcggccataaaactgatgccgagtgaaaaagttgatcccacagccattccggctatgaaaaaacatgccgcaagcagaagaacggattcggaaaagcccgcagcaaagaagcagcctgccccgacagccaatatgacaaggagtacatttcgccttccgtacttgtcgctcaacacgccgagcggatactgaaagacgatgcttccgatcgcaaaagccggaagaatgatcgatacgccttcgacggaaatgcccgaccggagcgcatagacgggaaaattgccgttcagggcggtttccaaaaagccgtagccgaatgtcggcaaaaacgcgacccacccaagcaggaaggcttgagcgaaacgcttcaagctgttatcgctgcggctttcagagccgcttttctcagggaaatcgttttgcaggcaaaaaataaacagccatgccagcaggctgaacgcacctgagacgataaacggcaatgatggggcgatgttgacaagcggcgttaaaaaaggcccggctgcaaatcccaaaccaaacgaaaggccgtacaaagagatattgcggccgcgttttttttcagacgataatgtggtcacccaagtttgcgttgaaaagtgcagcatatgatccccgattccgatcaagagccgcaaaaagaaccaaacgataaacgactgaataaaaacaaaggcgaacaaactcgcgcacaccatcaccccgccgatgacaatcagcggtttaaaaccgagcctgcgaagcggtgcttccatgaaaggcgaagcgatcaggacgccgatgtagaggcctgtcgcatgaagcccgttcagtgcagccgaatggccttcctgttcgaaaataacagagatgaccggaaggagcatcccttgcgaaaaacctgatatactgacaatcaaaacgagaatgaaaaagtgaaatctagtcatcggccgattctccttatccgtaatccttctttgatcgtacaactttcagaagttttcaggcaaggcgatttttctttttctttcataagaggtgtgattcatggaaatcgtgtggaatcagaacggctttgaggctgatctggaatatgggaagcttaaaatatcaagcaatgaagaagcgggattcaggccttatcaattgctggccgcttcgattgcggcatgcagcggaaccgttcttcgtaaaattttggaaaagaaaaggatacagctgaaagatatgatcatcgaaacaaaagaagaacgcatttccgaagaggctggccgcatcaaaagcatccatcttcacttcatattgaagggagaaaacctcggtgcagaacaaatcaaaaaggcgctgagaatagcgctgaaaaactgcgccatggtgaggtctgttgaaaacagtattgacatcatcgaaacatttgagattcgctgatgtttaaaaacatgcgccgctgcggaatagatcagtatgccgtatataaagcgaaaagttcgcacaaaaataacctacaccaaaaaagaaaagaggaatgaaaaatgagccgttttttcttttggatgatggctgcgggtgttccactttctgtcgcagggagccttctgcattggccgcaggttttattgttcatcatatactgcctgacgatcatcgcgcttgcaagctatatgggaagagccaccgaaagccttgcgatcattgcgggaccgaggatcggaggccttttaaatgcgacgttcggaaacgccgttgagctgatcatttcgattttcgcgttgcgggaaggactgatcggaattgtgctcgcatcgctgacaggatctgtcttgggcaaccttctcctggtcgccgggctttcgtttttcatcgggggcctgaaatataagcgccaggaattcaacgtgtatgatgcgagacacaattcaggtctgctcatgttcgcggtgattgtcgctttcgttatccctgaagtgttttcagctgaaatgacagagccgaggaagctgtcgatgagcgtcggcatcagcatcatcatgattttgctttacctggctgcactttatttcaagcttgtcagccaccgcggggtttaccagacgaatcaaaatgagcaggaagaatcgcatgaagagccggaatggtcgggaaagcgcgcaacattgatcttatttttggcaactgttgccgtcgcctacatttccgagcacctcgtccatacgtttgatacggtggccgaacaattcggctggtcggagcttttcatcggggtcatcattgtcgcgatcgtcggaaacgcggcagagcatgcttccgccgtcattatggcctataaggacaaaatggatgtcgcggttgaaattgcgatcggatcaacgcttcagatcgcgatgtttgtcgcccctgttcttgtcatcagctctttgttttttccaacgagcatgccgctcgtctttaccttgccggagctggtcgccatggcttccgccgtccttttgatgatcatcatttccaacgacggggacacgaactggtttgaaggcgcgacattgctggccgcttatatcatcatgggaatcggttttttccttctttaaaaaaatcgggataaacagagagcatccggaaaacaataaggaaaaagaaacagaaagagtgatagtatgaaaaagcttttgtgttttacgctgactgcgtttttatcctttagttttttcgctgtacaggaagctgacgcagccaagccgatcaagattccaagctctgtcacgaatatttccaaagagaacacataccctaacgcctctcaggatcagccgaggctgcagccgagcgaattagccgaagagctgctgaaaacaaccgatattgcgattgaaaatccgcatctgattaaaatgctgaatgagtcaagcatttccggcacaccgctggcaatcggctatcgggcgacgatttatttgggcagatgggcgctaggttacacctcgaatgaaaccgttgcgaactgggaataccgcaaaatcaacacaaaccgctttgacaaccggggcgggaaagcacctgcagaactcacgtattcccaggaacagacgagcaaaatcaaaggcggcttaacagcgaaagttccaaaggcggaagatgtcaaaaatatgatgatgctcaaagccatggaaaaaacaaagctgccgctcgcctttgaaacagtggtcggctccggtacaaaacgcgatcagatttataaagtgcagccgaaaaaactgggaaatttacacgcctatgcacctgccgtcaatgaaaaaggaaaagtcacctacggcgaagtgtacatcgtattaaaaggcaacaaaagaaagctagtcgtcaaaaatatcacctcgcaaggaatcggcgcttggattcctgtacaggatcacctgacattcggctttcagctcagccatcagccgaaataaaaaagcaagcctttgcggcttgcttttttcatactcttgctgttctggaagtaaaatcaacatcttgataatagctgtttttgacgagcacattcggtccgaggcaccggacgtgcgggcagtggcagttgagttctttggcaagctctgtttttctccacttcgcgtaggcgcttggcaggctgtctgtctgaatgttgccgagcggcggagtatctccgaaatcggtcacgatgatattgccgtcaaaaatattgacgttcaggcgcgatctgccgtcagggtcgtttctgacggtgacgtttttcgcttcgcgcagccgctgtaagagggcgtgatcttcaggatcagggctgcacgcgtaaaacggcagagtgccgaacagcatccacgtattttcgtcgcgaatgtcaagaaggcggtggatcgcttttctcatgtcttttaagcttaaagattcaagtgcgcttgcaaagtcgctcggatacatcggatggacctcatggcgctggcatttcatgtcttcgacaatttgccggtgaatatgctcgatatgaggaagcgtccgtttgttgagcatcgtctcggcggagaccatgaccccttcatcaacaagcgtccggctgttttcgatcattttttcgaaatagcgcgcccgctgtgcaaacgtcggctttttatccatcatagcgaagccgatttctgcaaagtcttcgaccgttccccagttgtgggaaatatgaagcacatccaggtaggggatgatcagctcgtagcggccgatatcgagcgtcaagtttgagttgatctgcgtccgcacgccgcgttcatgagcgtattttaataaaggaacgacatattcctttacagattttaatgagagcatcggctcgccgcccgtaatgcttaaagaacgaaggcggggaatctcatcaagccgtttcaacagaaggctgactggcagcgcgtccgggtccttcgtctggagcgtatacccgacggcgcagtgctcgcagcgcatattgcaaagagtcgtcgtcgtaaattcaacgttcgtcagctgtatatctccaaattggtcaacgtccatgtaggcttcccacggatcatattccggggtgatcggacgagcctgcattttttctgtcatgacatatctaactcctttatgataggacatactaatatagcccaactattcattttagacctgatccttgaggcatgcaagtcatggatgattgaaaaaaggccgtttataggctacgataaaggaacaaaaggaggagaatcatgggtaacgcagtacatgacaaagaacagcaagtcaattatttgaaaaacagattggatatgtttatgtcagtcatcgattctttagacccggaatcgaccgaccttgaagatattgacagactgatcagcatgctcgacgatttggaagccaaatacgagcgctttaaaaaagactggaaataaaaccgcgcattctctgccgcggttttttttgttttccaagtgttgcttggtatgaaatgctcagcccttctgcacaataagaaaaaataaaactgggagcgagaagatgatgaaacgaatctgtgccatatgctgcggattcctgctgacgctggcgttcagcggcaatgctgaagcgatttccaacaaggcgatccattggggtttttcaaaaagcaaaaaccatcagccggcagatgcgggtcaagagctgaccaaccttttacagcagtacgacgccttttatttgggcaacacaaaggaaaaaacgatctatctgacctttgataacggctatgaaaacggctacacccctcaggtgctcgatgttctgaaaaaacaaaacgtcaaagcggccttttttgtgacgggccattttgtcaaagatcagccggagctgatcaagcgaatggccgaggaggggcatatcatcgggaatcattcatatcaccatccggatctgacgacgaaaacaagccgcgtcattcaagaggaattggaatcggtcgatgaggaggtttacaaaatcacaggcgaaaaaaacaacctctacctgagaccgcctcggggcattttcagcgagcgggtgctcgaagaaacgaaaaagctcggctatcaaacggtattctggtctgttgcttttgtcgattggaaaatcaatgcccaaaaagggtggcgctatgcgtacgacaatatgatgaaacaggctcaccccggcgccatctatctgcttcacaccgtctcgagagacaatgccgaagcgcttgatcaggcgatcaccgacttgaaaaaagaaggttatacatttaaaagcctcgatgacctgatgtttgaaaaatctattgatgcttgagaccctttgaaagaacaatgccccggccgctttgccggggttttgctttggctgaaaaaattgatgcttcaggctctttttatttcccctagtcaattctatagaataaaaatccattttatatacatatattactagatttaaaaagaaaataggtatatcattgatagtgaagggggaattaccatgtcaaaatcagtaaaatcagtcacatcacctaaaaaatttattacaggaaaacgactgctggagaacttgaacgactacattgaagattttggcgacaacgcatatatcatttgcgatgaattcattttggaacgcgctcaaaaagaagcggggaattcgattcagaaagccggcaatcaagccgtttttgaaaaattcaattacgaatgcacacaggaagaaatcgatcgcaaccgggagcttgcacgcaatgcaggcgctaatatcatcgttgggatcggaggcggtaaaacgcttgataccgcaaaagccaccgcttattacgagaagctgccggttgtgattttcccgacaattgcttctacggatgctccatgtacggcccttgccgtcatttataaacacgacggatcgtttgaccgctatctgtttttgccgacgaacccagatgtcgttcttgcggactctgagattttggcatccgcgccgccgcgctttttcgcagccggtatcggtgacgccttggcgacgtattttgaagcgcgtgcctgctttaaagcaaacggcgataacctcgtgctgatgaagccttcaacaactggattgggacttgcccgtctttgctatgatacgctgttggaaaacggtgtgaaagcgatgcaggcggttaagcacggcgtttccacacgagcggtcgaagatacaatcgaggcgaccatctatttaagcggcgtcggtgccgaatcaggcggtcttgccgccgcacacgcgatccacaacggaatgacagccgttccttctctgcacagggctcagcacggcgaaaaagtcacgttcggccttttggcgcagcttgttcttgaaaacgcgccggccgaagaattggagaccgttattgactttatcaaaggcgtcggtcttccgttgacattaaaagacctcggagtcgacgaatttgtcgaagaagaatggcgccaagtcgctcaaagcgcttgcgcggaaggcgacacaatgggcaacatgccgttcccagtcacccctgacgacgtctacaatgcgatcgtcgccgccaacgcgattgcagaatcttatcacgattaatagacgaaaagccgtttccgtgaaggagcggctttctgctttgggttagtatattagtttgtgaatcggcggtctgtccgtgcttttgaatatgaattgtgtggtacgtttcccagagtaaaattatgaatttcttttatagcagtttcccaaaaacgagctgtttgactcgtgtgacagccgttcatttcaccactttaatcttcaacctcggctcttcttcaattccggatgcaaatgcatcctcatttcccggagccgtaaaggtgacgctgtacgtttcctgtgaatgcggcgacagttccagctcttccggctgaaagtcaaattcatttattatatcaggggtgagctggacgcgtgcggtctttttcccgtagttgttgactttcacctcacagtccatgcttcctgcttccatatcgccctgatagctgcaagcgcttccccttttcatatattccacggcgctatcgccttgtgcattccatttttgaaagaacatcagctgttctgtgaccagcgggtaaaatactgaaataccgatgataaacaaaaacagcttaaagcggatccacggtactccataataatggcgccacgccataatgaagccggcgatgatcataaacatgcagatcagaaccactaaattccggatgggcagttttaaaaagcccgaaagcgcgtctgctacagacgcgccttgatgattctcggcgctgatcaacaggccgataacaatcatgatgatgccggcaagccctgtatgtaccttcatttctttccctcctcagttgtagaaatagtcgaacagagaggaaaaaggtttccggttttacttgaaaatgtcaaaccatcctttatgccggaaccagaagatcatgccggcgacaacggctgccattattccgaggatgaaaaaatagccgtagcgccaatgcagttcaggcatgttgtcaaagttcatgccgtacactccggcaatgaaggtgagcggaataaaaatcgttgagacgatcgtcagcgtcatcataatggcgttcatccggttggagttgagcgtctggtagctgtccctcaaatcggctgtcatgtcacggttgttttcgacgatttcggccagcttcaagagatggtcgtaaatgtcgctgtaatacgcttttcgttcgcggttttcttttgaaatttcaatgtttaaaatccggtaaagcaaatcccgcatcggaatgattgttttcctcagctttaaaaggtcgccacggatatcaaacacctcgttcatcagcgttccatacgttttcctgctgtcgctttcggcaatttcattgaggcggtcttctattttgtaaagaatcgggaaatattcgtccacaagcgtatccatgaccatataggcgatgtggcccggtccgtttttccacaactcgctgttttccgaaagctgtcttcttactttttcaatgccgtctgagtgatgaaaatgaaatgtaacgatgaaatcctttccaacgaataaatcaacttcttcagacgccaaagtcttttgattcaacgcatgtatgacgaaaaaaagataatcttcgtattgatcgagcttgggacgctgcaagcgatgtacgcagtcttcgaccgataaagggtgaaagtgaaaatggcttttgagcaaggagacttcttcttccgaaggctgatcgaaatcggtccaaaaccactcaatatcttgatctgtcagcctttctgctttgttgtcggataaaagccgtccgtcctttgtcatcgcaaaatgtttaatcatcgatacccctccgcttacataggatgctgcgctgtgctgtgattcattcgatgaaaaataaaatgttgttcttttttaagagaatttgaaacatggtatactgtggacaaagaagaaaaagggatgggaagcgatgtggaaggaaactgtaagcgtaacaccgccttatcattttgaccgcgtgttggacaggctttcgcttgatccgctcaatgcggtcaacctcgacaaaagggaggtcaagctgccgctccgcaatcaaaacaaagagcctcgggttgtcgctgtgcaggcgacgggaactgctgaagccccggcgtttgccgtcagcggaatagacgatcgagatgacatgataaaagaagtgaaacggatcttcagatgggaagaaagtcttcagcctgtactggatcacttttcacaatcaagcctatcatcgatttttgaggagcatgccggaacgccgctggtgctcgattttcatttgtatcattgcctgatgaaatgcattatccaccagcagctgaacctgtcttttgcttatacgctcacggagcggttcgttcacacttttggagagcaaaaggacggggtctggttttatccgcttcccgaaacgattgcacagcttgactacaacgatctgcgcgaacttcaattcagcatgcgaaaggctgaatatgtcatcgatacatcaaggatgatcgcagacggccgtttagatcttgatgagcttgatcaattatcagatgaagatattatggaaaagctggtgaaaatcagaggaatcggcccgtggaccgtccaaaacgttctgctgttcggactcggccgtcccaatctgtttccggcagccgatatcggcatccaaaatgccatcaaacgccattttggcttaaacgataaaccgacaaaagaacaaatgcttgaaatgagcaaagaatggcacccttatttaagctatgcttccttgtatttatggaggagcatcgagtagaaatggagagaacaccagtgaaacgtgacaaaaaaggatcatcagcagaattaaaagtcggacagcaatttccgctgacgatcaagcgcctcggcatcaatggcgaaggcgtcggctacttcaagaaaaaagtcgtcttcgtccccggcgcgctgccgggagaagaagtcgtcgtcgaggcgacaaaggttcatccgaaattttccgaagggcgggtcaaaaaggtgcgcaaacgttcagagcaccgcgtcaagccgccctgcatcatctatgagcaatgcgggggctgccagctccagcatctggcttatgaagagcagctgaaaggaaaacgggacatcgtcattcaatcgctcgaacggcacacccgttttgacatcggcaaaatggacatcaggccgacgatcggcatggaaaacccgtggcactatcggaataaaagccagtttcagctcgggctttcgaaaaacggaaagatggtggccgggctgtacggccttgactcgcaccgtcttgtcccgattacggaatgcattgttcagcatccggcgacgaacaaaacgacgcaaaccgtcaagcaggttcttgaagacttcggcatttccgtctacaacgaacggaagcgcacgggcgatgtccgcacgatcgtgacgagggtcggcttcgagacgggggaagtgcaggttgtccttgtcacgtcaaaagaagacctgccgcgcaaggagctcattgcagaagaaatcaagaagcgtctgcctgaagtgacatctgtgattcaaaacgtcaacaaagccaaaacatcggttgtcttcggcgatgatacaaggctcttagccggcaatatggtcattcaggaatttctcggagaggtttcatttgagctgagcgcccgcgctttttttcagctcaatccgatccagacagtcaagctgtatgacgaagtgaaaaaagcggcaaaactgaccgggcgcgaaaaagtcgtcgacgcatattgcggcgtcggcacgatcggaatgtggatcgccgacggggcaaaagaaatccgcggcatggacgtcatcaaagaatcgattgatgacgccaaccaaaacgccaaaaagcacggaatcgaaaatgcgcgctatgtaacaggaacggccgagcactggctgccgaaatggacaaaagaaggcttcaggcccgacgtcgtcatcgtcgatccgccaagaacaggctgtgaccgcacgttccttgatacgatcaggcaggttaagccgaagcggttcgtttatgtctcatgcaatccgtcaacacttgcgaaagatttgcagtacttggcgaaggattaccatgtagaatacattcagcctgtcgatatgtttccgcagacggcgcacgtcgaatcggtcgtatcgctgaagctgaaataaaacgcctttttaaaggcgttttttagcggaaacaaaagggggatacatgatgaaaagactttgcatcatcccgtgcggggcgaaaaaaatctgggatgttgatccggacatcggcccgtccgccgcaaaggatgtctatctaagcccatttcaccgggcgtgccgcgcatatgcgcagacattttttacggattgggtgattctttcagcaaaacacggttttttaaaacctgaagatatcgttcctgaaaactatgacgtcacatttgggatgcgccacccagagattatgccggatggcgggctgaaggctcaaggtgaacggaaaaacctgatggattgcgatgaaatcgtcatgctcggcggaaaaaaatacaggcctgtactgaggaacgtgtttggcagcggacagcagatcatatacccgctggcgggataccggggaatcggctatatgctgcaggcgctgaagcgggctgtcgatgaaggccgggaacttggtgaacatgaaaaaaatgagtttttttaaaatcgctggcagggccctcaaaataaaggacagggcatcatccgagagaccggaagatgtttgtttggcgattgggatatcgggaggcaaaatgaaatattcatttttgtctcttttttttatgtgatttttgtaacgaaaagaaggtcagcggtactaataagtgaatggaaaaattaaagaaacagcggaagatttaacacaggaagcattttatcaggctgtgaaaggctggctcccacacatttttgggaaagccgacaatcaaaacacgggtgtttgcgattgctaaaaaaacactttcgttcaggagcgtcgaaagccggggcaaacacaatgattcaccaagttaaggctgcttgcttatctccggaagaacacttcctgaaaaccgtgaaagagcggcggcttctcgaggaaatcaaccggcttgatgagaatttacaggagattgtcagcctccgcatctacgaaaatcggcatgctcacaggcaaaaccgaaaacgatgccatggtgggggttcacagggcgaaggtcaagcttcagcaagaaatggaggggtatgatgaaggataaggaacgcagtatattcgaagatttgcttcctttataccatgaggggctgttaagcaaagagacggctgaatggattgaggaagcggccgaaaacgatgaggagcttcaaaagcttttgaagatgtcggaagacgagcttccgaaggaacatatcgagtcgtctgttcatgaagggcaaatgtttaaaagaatcaatcgaaagctctccttgtaccagctgatgtttatggcgatttcattttttctcgcgattcgcacatccctgttaaatgaaagcttcggctttattttgtggtacgccgtgcttgggtttgcggggtatctgtttttccgggatatgaaactcgtaatgctcctcacctatgcgccgattttcgtttgggggatgggggatattctggccgaatgggacgcatccggcggtacaggggttgtggagcacctgctgtatgccgtctttggcgctttcgtgctcgctgttattcactgttttttcgccgcggttgggatgatgatcggctggctgttcttaaagctgaaggaaagaagttgatatgatgaaaaagaaagtcttgtatagcgtgttgattgtgctgctcgtttcctttgtgcttgccgcttacaacgccttcaacggaaatcccgtaagcaagaagctgtctcaaacggcgcttgagcattatttgactgaccgctatcctgaaaaagacttgcggatcgacagcggcatctataatttcaagttcacggaatatgtatttgaagtcactgacaccggtgatccaaagcgcaaagatccctatctgcttactttgagagggtttgttcaacctgaagtatacacggacggaatctatgaagagaacctcaatgaaccgctgatggagcggcttggagaagaagcaggaaaagaaatcaaagcgcttttatcaaaaagcatagaccaactgaaagacgttgacgtgcatgtggaagtattaaaaggaaagctgaaaaatgacgcaaaatgggagaaaagcatccgcttagacaagccgatgcagattcatattttacttgatgccgaaaatgccggccgaaaagaagtatacaatacggcgcaaaagattcagcgcctgttgaatgaagaagggtacgactacgaaagcgtgacgattaatgccaacatttttgatggggaagatattaaagacgaggagatcggctgtcttaaatacagcacctcctttgaaaaaaatacggaaatcaagctgaaggatgttgaagagctaaatgattaacgatccatccttcagtttgaaggatgatatcatacatgcaagccgccgcagaaggcggcggttatctgtttaatataagtgtctttagcgactttttgaaaacggccgccagccaatgcgccagacgagaagtatccgtataaagatgacagaaaagcgaaggcctgtgaatctgcatctccctttttcatcaggtttttgtcctgcatcgtccgaaagtagtctgttaaataacaaaggagctcctccatatgctttaacagagaaccgaaaagatcagtcatccttccgccgtcttgaacagcgataaggtagagcggcttgtttttttccatatgaagcaaatacgattctgcaatcaatgttaagtctttctccaggttccaagtgatatcgttttcaaatacgcgctgaaaggctggtatataagaaaattgttgaacggccgcttccaaaagtccaagcttagttttgaagtggcggtagaccgtcatctcgctgacgcctgaatgaagcgcgatatcctttattgtcaccgacttgaatccgtatttttgcattaagtctaaagcagcagatatgatccgttcgttcgtctcttgcaaaggtgtttacccccattttatgatagttagtagtaactaacatcagtctaatcaggcgctcaattgatgtcaacctgtttcaaaaaggataaaaaggagttatgatcatgaaaaatattctaatcgtcaattttccggcggaaggtcatgtcaatcctacattagggatcaccaaagcatttgctgacagaggcgacaatgtgcactatctttcaacagaaaagtataaagacaggctggagggcgtcggagctaccgttcatttatacaaagatctggtgagaaacgcgcatattgatccgaattcaccgtccggccttcttgaatttttaaaaattcatctcaaaacctcgctgtatattctagacattgtaaaagagctgtccaaaagcatttcgttcgatgtcgtgtattatgacacattcggtgcgggtgaattggtcagggattatttgaacattccgggaatcgcttcgtcggcttcatttctcttcggacaagaacataagaagattctgccgttgcatccggattcaggcgcggagctgcacttggacaaagaatgtgaggacctgcttgcggaactgaaagaaaagtacggcgtctcgcctaggcatacaggacagtttatgagcaatcaggcggagctgaccgttgtgtatacaagccggtattttcagcctgacagcggccgttttggggatgatgtgctgtttatcggcccgcgttttccaaagcgcctggacaagaccgattttccggtagaatcgttgaagaatgagaaagtcatttatatttcaatgggaaccgtacttggcaaaactgcggattttttcaatatgtgcattgatgcttttcgtgatttcgacggcaaggttgtcatcgccgctggcgaaaaatcggactacgcggaaattaaagaagtgccggagcattttatcatcgccccgtatgtgccgcaattagaggtgcttaaagaggccgatgtgttcatcacgcacggcggcatgaacagcgtcaatgaaggcatccattaccgtgtcccgatggttgtgcttccgcatgataaagatcagccgatgatcgcccagcgcttgaaagagctgaatgcgggatatcctctgtttgcagaagaagtgaatgctgaaagattgagagatgcagcagaacaagtgctcactgacggaaaatatcaggaaggtattcaaaaaattgatgaaagcttcagcaactgcatggacattaaagatgcattggcgcgtattgatgaatatacggcgcggaaaaaagtcgctgcagccataacagaaagccgctactaagcggctttttttatgcataaacaccgcaaaaaagaaaaaaatagaatgaatcatagatcagaaaggatgttgcatgatgcgcaaactgtgcgtttgcctgcttctcgtcattccgctgtcatgtacggctgtcatgccctctgcctacggggaaacacgcgtttatcaagagttgacggacaagcagaaaaatgaactggcttctttgcaaaaggacattatggaaaagaaaaaacagctgatcaataagtatgtggagtacggaatacttgatcaggaaaggggaaaggaaatcaagtctcatattgaaaagcgctatgaaaaagagcgggaagacggatttttgccaaagtggaagcaccataaagaaaagtttcgcccgcatcacattcattaaactgaaaaagacggcgcctcattttcttcgtgacaaaagtgtaaagacaggtgtaaactaatactcatgtaaactgctaagagagtaaaagaggtgttgtgagtatgaagaaccgtcctgtttcagagcgcagactgcttggcatcgcaggcctcggctggctttttgatgccatggacgttggtatattatcgtttattatcgccgctttgcacgcggaatggaagttgacgccgcaggaaatgagctggatcggcagcgtcaactcaatcggcatggctgtcggggcatttgtctttggccttttggctgaccgcgtcggaagaaaatatgtttttattattacgctgctgtttttctcgatcggcagcgggttgtccgctttaacgacgacattgtgggcatttttagtgctgcgctttttcgtcggaatggggctcgggggagagcttccagtcgcatctacgctcgtatctgaaaccgttgcgcctgatcggaggggaagagtcgtcgtcctgctcgaaagtttctgggcattcggctggctggctgcagcgctcatttcgtattttattattccggcctacggctggcagattgctttattgataactgcgataccggctttttacgccttatatttgcggattgccctgccggattctccgaaatatgagaagcttgcgcaggaaaggaagccgaccatcatggaaaatgtgaaaagcgtctggtcccgcaaatatgcccggcctacggccatgctgtggatcgtctggttttgcgtcgtcttttcctactatggcatgtttctttggctgccgagcgtcatggtgatgaaaggattcagcatgatcaagagctttgagtacgtcctgattatgacgctggctcagctgcccggctatttctccgcggcatggctgattgaaaaagccggtcggaaaatggtgcttaccgtctacttgctggggacggctgtcagcgcctacttcttcggatcggctgaatcgctggcgcttttgcttgtgtcaggcatgtttttatcatttttcaaccttggtgcgtggggtgcgctttacgcttataccccggaacaatacccgacgtcaatcagggggaccggcgcaggaatggcagccggctttggccgaatcggcggcatcctgggcccgcttcttgtcggctatctcgtcgcccggggaacagagatttcaatgatctttttcatcttctgcatcgccgttgttgcggccgtcgcagccatcatctttttggggaccgagacgaagcagaaagagcttgcctaatgtctgaattctgcgtcataatagacggacgcgaaaatttggaaagagttggttgaattgaaaaagaaagccattatgaaaacattgagattgacagtatgggtttagaagggggaagaacggcccggctgcaaggaacgcgcaattgccacctgaatacgtagagaaggcgcttgtagcgccttctcttttttatatatgcaggatatataggtggtttgcactattgatgtccatggccgaagagaatagaatcatattaagaaccaatatcgccgggattgttactggtaaggcaggcaagacctaaaatgtgctaaaggaaccgcagcccttagtgtgcttttttgcgcctatcggctgatgctttcgcatgttttaggtctttttttgtttctttcgccagggggctttagacgtaatgacacatttttcattttgatcgtcttctgttgatttgataggatagaaaaattggaggaggtaggtgcgggtgcagcataaagagattgcaagagaactcttgcccctcattggaggcgcggagaatatcatcagcatcagccattgtacgacaaggctgcgcttcaatgtcagggatgaagaaaaaatcgatatagctgctattgaaaagatggagtctcagcaggggacttttttcagatacggtttgttccagatcattttcgctacaggtgtggtcaataaaatttataaggaaatgatccaatacagcgatccggctccttttgaagaagcccgtcgggaggcgcggccgaacatgaacgtattgacgcgatttgccaaaacgctgtcagacatctttgtgccgatcattcctgcaatcgttgcgagcggattgctcatgggtctcattagtgtgcttaaagaattcagcctcggcgcttatggcggcccgctgatgaaaatgctcgacattttttcaagctcagcgtttgtcattttgcctgtgctgatcgggttcagtgcggctaaacagtttggagccaatccatttttaggcgccgtcatcggcggtattttgacccatcctgatttgctcgatccttcaatgctcggcagccaaaagccggaatccatcgaagtattcggccttgaagtccctttgatcggataccaggggacagtcattccgattctcttatccgtctacatgatgagcaaaatcgaaaaattcttgaaaagaatcgtccccagttctttagatttgatcgttgccccgtttattacagtcatggcttccgggtttgccgcgctgtttatcatgggcccgctctcactgatgatcgcccatttcataagcgactgtctcgggtttgtttatcattttgcgggggcgtgcgccggatttttatttggcgggctttacgccttactcgttttgagcggcctgcaccacagtttttatgtgattgaagcgtcgctgctcgcagatcccgaatacggggtcaattttctgcttccaatatggtcgatggccaatgtcgcgcagggaggagcgggactcgccgtatttttgaaaacaaagaatgacggcatcagaaagattgcgattccggcttctctcacggcctttttgggaatcgtcgaaccggtcatgtttggcgtcaacctgaaactcgtcaggccgtttatcggcgcatcgatcggaggcgcactcggaggtgcatacgccgtcttcacacacgtggcggcaaattcttacggattgtccggcatcccgatgatttcaattattctccctcttggcaccgccaatctcattcattatttaatcgcttttgcgattgcggtgatttcagcatttattgcgactttgtgtcttggctttaaagatgaaaaagaataattccgttttcattcattaaaacaggatgaaaggaaggcagctatgaaagtaaaaaaaatcttaaacaacaatgcgctcgtcgtaaaggatcgcggcgaggaaaagatcgtattagggtccggaatcgcatttcaaaaaaagaagaatgatattgtcgacagatctaaaattgaaaaaatattcgtgatgaaagattcatcagaataccgccaattcgaggagatcttaaaaacattgccggaagatcatattcaggtggcggaggatattatttcttatgcggaaaaagagctcgggatcaaaatcaatgagcgaatccatgtcgccttttcagatcatttatccttcgcgatagaacggttaagcaagggaatggtcattaaaaatccgctgcttcaagaagtcaaagtcctctacacgaaagaatttcaaatcggccgctgggcaaaggctctcattaaagaaaagctgaagatcgatatccccgaggatgaagtcgccaatattgcgctgcatatccacacagccaaaacaaacgcgggagatatgacaaaaacgctcgatctcacaacgatgatcaaggatattatcgagatcatcgaaaacaaactcaacattaaaataaaggatgagacgatttcgtatgagaggcttgtcaaccatctccgtttcgccattcagcatatcgagtcgggagagacattttacgaaatggatggtgagatgatcagcctcattaaaaagaagtttggacaagcgtttatgtgcgcagaagaaatcggggcatttgtgaagcgggagtatggctttgaatttccggaaaaagagctgtgctacattaccatgcatattcagagattttatcagcggtctgctgtcgtgtaaagatgcctgcgtttaagacaaaacggagccctgttaacgggctccgtttttgtttaaagcttcaacttccgttaaaaccgatttatcgattagaaatcctttcactttgacgtgcaaagggattaacgggtgcctgcggatggcggcgacgcttttttgtacaccttcggccacgttttcgctcggtgacagccattcatcaatgctgccttgcgtaaattccggactgcagttttggaaaaggtactctaaagtttgcattctatcttttaaatctttgtctctatttaaaaggtcagaaatatcttcatctgccgatggttcgtatttgtcgcggacaatccagatttcttccgctttgttccggtggacaagggtgatgatatccctcatgaaatcaccgtagggctgtgaaatatcagggaagacgctttttaaaacgagggcgtcctccggctgaatatttgctgcccggcagatggtctgttcaagctgtttctccattccgataatcatgagtatttttttgttttcttccatgacatttcacctcattcatttatcgtgtttgtccagttcttccattttccctccggattaatagatgccagatgaatccatccgttctccgccttttgccggaagctgtgatcgcggtcaaggagccgttcgatatcatcatccggcgcttcaatcacgatcagcagcctgagaggcgcatgatagatttcgtcatctgaccgcatgacggactgccatgggagaccggccaaaagatcgcttgcatttccttgcataacgccgagaccggcagtgacggtttgagttgctttatttccgcttccataataatgcggtgcaacggttgacgcgtaatactgcagattgatccattgggccactgttccaggccctgaaatgatgccgctaaggatggagccgtcctcgtcattccgccagtcatagctgtgcagaaaagcccttccctcaaggtcggccccccgtgtaagccggcgtgtgccgatgatgaatgaggcatttcgggccagcccccattcgggacggatttcgctccaatcttcggcgaagcgctcaacttcattccgcggattttgatagccgagctgcggcagctcttctaagcgttcggctccgacagtacggctcacatcgggaagcacagagttgatgcggtcaaacgcttgttgagctttagccggcagctcaggtacatagagccagtgcagttcatccaaagttgtaatgtgctctgcggcagcgaataccgtatcatccggaataaaaatgccgtcggagcgaagcctctctctgacgcttggaagattgcataaagcggctaggacgcgtgcgttgaaagcgccagatgcgcctccgcaggcgccgcagtccagtgccgatgcataagggttattcgtgcttctgctgccgtgcccgcaaatgacaaccagcggagcgaaccggtctgtgatccccatcatctttaatgcctgtctggcataggcggctttttcttcttccgtaaatccgaccggaatgccggcttcagatgtttccgtgcgatcaagcgagagctttgtctgaggcttcttcagccatgttttccgcgcatttctgaatgcttggccggctgcgcgggggacaaggctgcgcgcggccatttgcaggctcagccaaggcccgctcacttcgggaagcagcatgcccgccaatagattctgtttcatcgttttaaaggcggagctcagtgaggctgccgcttttttatgttcttgatacgacttaaagggtaattcttcggccgtttcttctactcgatgctgcggttttaggatgaccggcagagagctgtggctgtgtttagtgcctagttcgcacgtttcgattgccatattgaaaaagcccgctgttccatatgtttcaaaagggcctgacttttccaatgccctgcggaacggctctgaacggacgtcaatacaaaatgcgaattgggccagcaccgtttcgcttttgtcagcagcggcaggtttgtttgccgtgatgagcttccttacctcagcggcgtatgtttgttcccaagcttccagccagagacgcctgcgcgttatatcatcaaagcggcgggcgagtgttaatctcgctttttgctctgctgcggaaagttcgagccattcttcaggcgtaaggccgccccaatgcagccaggacgcaatcaaaggaacgagctgcatctctttttcaggattcggcttaggcagcggtaaataaggctcaacaagcatccattccattgaaagccggacagccaaatactcgagcagcagttcttcttcgtcctgcgattgctgagaacgccaaagcatcatcccggcccatcccggcagagaaagcagatgagcttcaaggtatgcctgaacgtctgcattggaaatatcaaacgctcggagcgcttttttcatagcgtcccgcggctcttccggccatccattcaggcgttggcgttctgcgcgcgacagagcgggatcatgttcaacaagctgccgccatgcgctgtaaaaccctttctcacgatgcggaagccgccatgccgattgtgattcatcaaggaacagcttgcaccatttaatcacatgatggtcaaggaggtgagcacttttctgtccggcaaaaacgctgagcggtttgataaagcttgtttttcggccatcgattgtcccgcgggccgcttgtttggcaagctttttcacttgccgggatctcaagagctgtccaggtatttcgtccagcttgagggcggctttgcaaaatgcctccgctgtttccctctgcatgccgggctgatgtgaatcgagccaattgatcagctttttttcaagaatcgtttcatcgatttctccccgttgttttgcggaacggaaaatggaggactttgggtagatatcaacatgaagctgctgtttaagctgccgggccgtctgttcaaatgtttgttcttcaaggcccatccacggatgacgagcggcaaaggtttcaatcggccaaagcggcgcgatgacccgtgctgctgattgaaccaactcatccatattaaagtccgcagtctgatgttcatattggaatatcaattgtttagacaatgtgggtgctgctttcatgattggcgacctccctgagtaagatattggtcaagataattcggccgttcttcgaccgattcgaaatggggttcacccgttttcacaagacgtaaataaagtgcgccggaccatgcaaagcgctgccgaacgatcaacgcgccggccgcactgccggctaacaaaacgactgccgtcaaaacggccgccattgcaggcggctcagccccctgtacaacagcatccttcaggagcccgtgtaaaacggaatgaatgatggcgaacgcgagtgaagcccctgttaaaatgaaaagtccggcaattcgtgtgacgcgtccgtaattggctgtgacaagctgcctccaagcaatgaacagtgcccagcctaaaacaagggcgctgatcaattgatagccatcgtccgtagctgaggcccagattccgatgacgagagcaagagcaaagacgccgcctatcatgttccaaaaaagagccggtctgcccggtttagatgcgaacgattcataacggcgcaccgctgatccggcttgcaggaaaagggcggctttgaacaggccgtgcaaaatgaggtgaataacagccgcaatataggcccctaatgcgcattggacgagcataaaacccatctgcgcgaccgttgaagctgcgagctgccgcttgtagtccgtttggacgatcatcatgcccgttccgagcaagacggaaaggacggcgggtacaagcagaataagctgcagtacatcaccgctgaacatcggtgcaaaacgagtcagcatgacgccgcctacatttacaagtccggcgtgcatgactgcggaaacgggagtcggagcgattgctgaatcgagcagccaacgatgaaacggccactgtgccgcaggaatcatcaccgttaaaatgacgaggaggccgatcccggttttctcccatgagctgagctgtacaaggctttcttccgctatggcggatgataatcgccagtgtcccgtcgaaagagacagccaaagagcggcagctgctatcgccagccagctgagcgcaaagatccggcccgcatacaaagcggcatttttcgccgcctgccacgcgctgtttaagccgattagcgcagtcaagccgagcagcgtgatcccccagcataaaaggagccagcgaagatcatcgttcagccaggcgcatgaagctcctcctgtcgtaagcgtcagcagcacaaaaaatttacggtaggagcggtcgccgaataaataccggacagagtagcgctggacgatgaagccgatagtcaagacaaacaaggcgatcagccaagcaagcgaatccaagcgccaagaagcttcagcctgcccgggatttgccgttatcaatgctgccagcgcggcaagcggaggcagggcgatgattttggcatgaatccgtacatatgccaatggaacctttcgattcaggacgagcagtgcgctgaacaaacaaagcgcaagcgacgcgaaaaatattttcagccaaaataaagaatctagcatatcaaacatccggcatccctccgtcggggtgatggaatagaacatactgtttcatatcttgccttcctttctgaaaacgtaaaaaaagccggtatattcaggactggcctatttcagccaatctttctgaatgataccggcttatctttaactcatgttcatgctttaaagatcttccgtttttctatgacaattttttttgcaggtcgtttgccaatttaaacaccataatccgttcgcctgtgcgcgtgctgatatccgtatgaaagctgatcgtctcttcaccggtcagcttcttcatcatgcggctcagctgctctatacccgattccaccaaaccggagcgggttcttttaattgacagcaggccttcttttgtactgcaaagttcgtattcggcgggcgtcaaaataccgttcagggaaacgatgaccatatttcttataatatctgttttaacagatacggatccgcgtcccaaatagtctttttcccattgggttaaggctttgcttatctccgcctccaaagaccccttcgtcaccttctgtttttccaatgctatatcctcctgaaaaacggtatatttcttttccttatacaagagtatagggaaaatgaaatataccgtcctatcaaaatgttaatgtcatgcatggtaaaggttgctttttcatgcgaccataatgggattatagccgaatgctaaagctcttttgcatgagattacgattattgattttacggaattactttttaaatatcatatcttttaagatttatgatgtcaataccgtcttttattggataaaaaagaggaatgccgtcttagcagacgagcattcccttggcgactgcaccggctttttccttgccgttcagcagttcggcaagcttgagggcaaacgggatcgtggtcgccggccctctggaagtaatgatatttccatcaacgacgacgttttcatgtgcggtgacatccgcccctgttaaatgttcttcaactcccggatagcaggtcgctttttttccgctgacaagccccgtttttccgagcgtcatcgttgccgcacaaatggcggcaacatattttcctgcatttgccgcttctgtcagcatcttatgcagagcttgatgctccagcatttttttgctgcctacatttccgcccggaagaatcagcatatccgcttcttgccaatcagcatcgtcaaacatgacgtctgcctcgacgacaatgtcatgtccgcctttcacgctgcgcgatggatcaagcgagacggtgacggtctcaacttctgcccttcgtaaaacatcaattgttgctatcgcttcaatttcttcgaatccgtcgattaaaaaaacatacgctttcttcatgaaaaaacctccttcgtctctaccgttcattctaaccgcggcaacgacatttccgcaactgacgaagtagacaaattgagacatctgtctcgttttgtctcttgttctgaaaggatgtccgcctgaaaagcggcttatgttcgcttcggagagctggcacgatttttgcatcataacgtgtgagtaaaaaagataggaggttttttcatatggaagaggcactgacaaaggaaaaagcagtgtggatgtatcaaaaaatgctggaaatccgctatttcgaagatcaggttcatcagctgtttgctaaaggaatactgccgggttttgtccatctttacgccggagaagaagcggtcgctgcgggcgtctgcgctcatctgaatgatgaagacaccatcacgagcacacatcgcggccatgggcactgcattgcaaaagggtgcgacttgaaaggcatgatggccgagatatacggaaaatctgcaggactttgtaaaggaaaaggcggatcgatgcatattgcagactttgacaaagggatgctaggcgcaaacggaatcgtcggcgggggatttcctttggcctgcggagcagctctcactgcaaagtataaaaagactaaaaatgtaagcgtttgcttttttggcgacggcgccaacaaccaggggacatttcacgaagggatcaaccttgccgccatctggaagctccctgtcatatttgtcgccgaaaacaacgggtatggcgaagcgactccgttttcctatgcgtcaagctgcgagtcgatcgcagatcgtgcggccgcttatgggattccgggcgttcgcgttgatggaaaagatgcggccgcggtcttccaggctgcgggccgggcgatagagcgtgccaaaaacggagaaggaccgacgctcattgagtgtatgacataccggaactacggccattttgaaggagatgcccagcgctacaaaacaaatgaagaaaaagcggtgcatcaggaagaaaaagatgccattgccgtgttcaaaagcgaactgctggcaaaagggctgatgagtgaagaagagcagtcgcggattgaaaaagaagttgaagaagcggtcgaggaagcggtcgcattcagcgaaaaaagcgcttatccggaagaaaccgaactgctgacggatgtatatgtatcctattaattcatgaagggggaaggaaacatgacgagggaaatcagcatgtcagccgcattgaatgaagcgatcaaacttgcgatgagaagggacgatcacgtcattttaatgggggaagatgtcgcaggaggagcgaatgtcgatcatctgcaggatgatgaagcatggggcggtgtgctcggcgtcacgaaagggattgttcaggaatttggacgggagcgcgtccttgatacgccgatcagtgaagcggggtacatcggcgcagccatggctgctgcttcaaccggtttaaggccgatcgcggaattgatgtttaacgattttatcggaacatgtttggaccaggtgctgaaccagggagcgaaattccgctacatgtttggcggcaaagcggaagttccgattacgatccggacgacccacggcgccggctttagggcggccgcccagcattcgcaaagcttgtatgccctatttacaagcattcccggactgaaagtgattgtgccgtcgaccccgtacgacgcaaaaggattattgctcgctgcgattgaagatcaggacccggttatcttttttgaagacaaaacgctgtacaacatgacaggcgatgtgccggaagaatattacacgcttccaatcggaaaagcagatatcaagcggaaaggcgccgatgtaacgattgttgcaatcggcaaacaggttcatacggcgcttcaagcggcggaacagctctcagcgcggggaatcgaagccgaaatccttgatccgcgaagcctttcgccgcttgatgaagaggccgtccttgcatccgtagaaaaaacaaacaggcttgtgatcgtcgatgaggccaatccgagatgcagcatcgccgcggatatcgcatcattggcggcagataaaggatttgattcgcttgacgcaccggttaaaaaggtgacggctccgcatacgccggtgccattttcaccgcctcttgaagacctgtatttgccgacgccggaaaaagtcgtgaacaccgtgcttgagatgctcggagaaacatcaacacatacggtgtaaagattggaaaggagaggagaacatggctgtcgaagtggtcatgccgaaattggggatgtcgatgaaagaaggtacggtttccgtctggaataaaaaagtcggggaagccgttgaaaaaggagaaagcattgccagcatcaattccgaaaaaatcgaaatggaaatcgaatctccggcaaacggaaccgtgttggacatccaagtatctgaaggagagggagtgccgccgggaaccgtcatctgccgcatcggaaatgaaaacgaacaaacgcaggagagccaaacaaaacagccggatcccacgaaagaacggattaaaatttctccggctgcgcgcaaaattgcgcaaagcgcaaatatagacatcaaaacgctgaagggcacaggccccggggggagaattacgaaagcggatgtgttgcaggcgcttcccggccggccgaacaagcaggcggctaaggctgaagctgaagagcggccgccggcaagcccgatgaggaaaacgatagccgcaagaatgacggaaagcctgcaaaacagcgcccagctgacgattacgatgaaggcggacatcacgaaattaacagtcctgcaaaaacagcttaatgaaaccgctcaatcaagatacgatacgaagctgacgatcactgattttgccgccagggcagctgttttttcgcttttggatcatccggccatgaacagtgtttatcaagacggaaggcttgcgacctttgagcatgttcatttaggagtggcggccgctttggacgaaggcctggccgttcccgtcatccgccatgccgagcggctcccgctgatcgaattggccaagaaaatcaaatggtacgccaaaaaagcgcgggaaggccggcttctacacgatgaaatagaaggatcgacatttacgattacaaacctcggcgcatatggtgtcgagcactttaccccgatcttgaatccgccggaaaccgggatactcggagtcggccaaatgtattcggcacccgtttatcaagacggagaactgacaaagggcgccattctgccgctcagtctgacttttgatcaccgcgcgcttgatggtgcgcctgctgcagcattcctttcagatgtgaaaaactatttggaagatccggcatcaattcttttatagagagaaggtggatagactgtgacacttgcaattataggagggggacctgcgggttacgtggcggcgattacagcggccaaaaatagcagagaagtcatcctgattgaagatggttccctcggaggaacgtgtttaaatgaaggatgcataccgaccaaagcgcttcttgaaagcgcagatatgttcgagaaaataaaatccgccggcgcattcggaatcgggctgtcaggcgaaagcccgacggttcagtgggaggccgtccaaagccgtaagagagagatcattcagcggctcgccgggggtattgaatatttgatgaataaaaataaaatcaaggttctgcaaggaaaagcatcgtttttgtccgaacacgacatacttgttgaaaaggacggaaaacaggaggtcatcaatgccgggcatgtgattatagcggcaggggcagcacctgccgcactgccttttgcgtcttttgacgggagctggatcatccacagcggagatgccatgtcattgccgtccatccctgaaacgatttttattatcggcggaggaatcatcggctgtgaatttgccagtatatacagcaggctgggagcgaacgtgatcatagccgagcaggcggaacagattctgcctgaggaagatccggatattgccgcctttcttcgcacaagtctcgaggagtccggcgtccgtgttttcacatctgtacaagtggagcgtcttgatcctgccaggcagcgcgtctttctgaaaaatggcgatgacagctttaatattcaagctgatcgatgtctcgtcgccgtcggccgaaagccgaggactgatgatctgaagcttgaccatatcggagtccaatatgacaggaaagggattcatgtcaaccagcatatgcagacaaacatcccgcatatttatgcgtgcggggatatcacaggcggggttcagctggcgcatgccgcttttcacgaaggaaccgtcgccgcatcccatgcctcaggcagagacatgaaggtcaacagtgacattattccgcgctgcatctatacttcgcctgaaatcgcaagcgtcggcttaaatgaaaaaaaggcgagggagcgctacagggatgttcgtatcggagagtttccgttttcttcaaacggaaaagcgcttattttgaatgaaactgccggcaaggtcaaaatcatcatagagccggagtatcaggaaattgtcggggtttcgatcgtgggtccgggagcaaccgaactgatcggccaggcagccgtaatgttgcatgcagagctgacggcagacgcaatggagcacttcatcgcggcccatccgactctttcggaaacgattcacgaagctttgctgcaagccgcaggtcgggccattcactgctgaataagggagaacttcgcacagcgtgagagtgcggagttttttttatcgatattgaaagcgcttttataatataatgaggaaaaagcatgaggagaggatggaatgaatccgacgccctgctatttaaatacgtggaaacgctttgttcaggaagggcttcttgatcaggcccgcttgaacaaaagagtcatggaatcatggtaccgctgcaaaaatcgaaatgtcaatccgtatttagataaaggacagtcaattttaaaaaaggatttattcgacgctcaaaaaaagaaacactcgttattcctcgatatcgccctgccttatctacacaatatcagccgtgaattaaaagagtcggaaatgatggcgctcctgatcgatgccgacgggtacgtattaagcttggccggctgccggaggacgcttgaagaggcgaaaaaaatcaattttgtcgagggcgtgcgctggacggaaacagaagtcggcacgaacgccatcggaaccgcacttgaaatcggcgaagctgtcaccattcacgggaccgagcatttttcggtcgcttcccaccattggagctgttctgctgcaccgattcgcgatgaagacggcaccgttatgggtttaatcgatatttcctgcctcacggatagaaggcatccctttatgcttgggatggctgccactgccgcacacgccatcgaacgcgagatcagcgcacatacgaaaaaaaacgaagccgagctcatcagccattgtcttgaaaaaatcgattcggatcagccgtttatcgtctgcaatgaaaaagacaaaatcgtagccgcgagcagaccggtgcgggaacgtttttccgactggaggagaatggatgtcaatgatctgtatgagcgcgggtttgccggggggcacaagcagacaattttctccgccaaagacgggaggcccctcggtaagtcgattgcactggctgaagtgtcccgcaataaaacagctccatcactcgtatcccgtttcatctatccgggtgaaacaggaacaagccgggcgtttcagcaggcgcttcaccacatgaggcttgcggctaagacggatgcgaatgtatacatatggggggaaacaggctccggaaaggaacttgccgcgagggccattcatcaggcgagcgcacggagaaacggcccttttatcgccgtcaactgcggcgccattcctgaaagcttgatggagagcgaattgttcggctatgccgaaggcgcatttacaggagcaaagcgccgcggttcaaaagggaagtttgaacaggctcaccgcggtacgatttttctcgatgaaatcggtgagatcccttatcagatgcaagtggcgctcttaaggatcatcgaagagcggaaggtcactccgatcggcggaacccgtgaagttcccctcgacatcagaatcatcacagcaacacaccgtgatctgaaagaccttctccaaaaaggaaagatacgtgaagatctgtattaccgccttcatgtttaccccgtaaaaataccgccgctcagagagcgcaaagaggacatacctgatttgttccgccactatcaacaacaacacgagtggaaggccgagtttccgccgaattttttcaagcggcttcaggaatatcattggcctggtaacatccgtgagctctttaatacatttgaaaggctcagggttttatttccggaaggcggactgatcgatccgtcccaatacagcgcggtgctggacggactcgattggaacagcggcgcaccttctgaagaagaccggctcacattcagagaacgtgttcaaaaacaaacgatgatggaagctttgcaaaaaacgaaaggaaatgtgtccgaagcggccaagctggccggaattccaagaagcacattttacaagcggcttcgaaaatataacctttagcctctcggcgcccaaagcatgacgctgacgccggctaaacagatcacagccccggcccaatcatagaggtcgggggtttttttgtcgaccagccacccccaaagcacagccagaataataaatacgcccccgtacgcggcatagacgcgcccgaacgatggaaatgcctgaaaagccgggatgacgccgtaaatgattaaagtcagccctccggccaacccgtaccacaatggtttggattccctcagccacagccatacgagatagccgcccgcgatttcagccaaacccgccagtaaaaataaaccgattgcgatcatcatcaacaacacactccaattcacgtgaattgtctctattctacacgacataaaacggccgggaaagttcccgtttttcgggaaaataaacagaacgcgagtataggaactgtctcccccgaacctgttggaacggctccttcagcatgatataagtaaattgtaaacgcttataagggggctttaaaaatggataaaacgtattcgattgtcattgcaggcggaggaagcacatttaccccggggattgtattgatgctcttggacaatctggatgatttcccgatccgacagctgaaattgtatgacaatgatggagagcggcaagacaaaatagccggcgcctgtgaagtgttggttaaagaaagagctccgcatattcaatttttagcgacgaccgatccggaagaggcgttttccgatgttgatttcgtcatggctcatatcagagtcggtaaatatgcaatgcgtgagctcgatgaaaagatccctctgaaatacggagtcgtcggccaggagacgtgcggacccggagggattgcgtacggaatgaggtcgattggcggcgtgcttgagctcattgattatatggaaacctattcgcctgacgcgtggatgctgaactattcaaacccggctgcaatcgtcgccgaagcgacaagaaggctgcggccgacatcaaaagtgctgaacatttgcgatatgccgatcggtatcgaagacaggatggctcagattctcggactgtcttcgcggaaggagatggttgtccgctattacggccttaatcattttggctggtggacgtcaatttgtgataaagacggcaacgatctgatgccggcgatcaaagagcatgtcaggaggttcggctatattccggaacaggagcatgaaaaggctgaggcgagctggaatgacacgttcaaaaaagcgcgggaagtatttgaactcgatcctgagacgcttccaaatacgtatttgcaatattatttttatcctgatgatatggtgaaaaaatcaaaccctgaatttacccgggcgaacgaagtaatggaagggcgggagaaattcattttcggcgagtgtgaaaaaatcgcaaaagcccaatccagcgccggcagcaaaatcgaaattgatgatcatgcttcatatattgtcgaccttgcgcgcgcccttgcattcaataccggtgaacggatgcttttaatcgttgaaaataacggagcgatccaaaacttcgattcatcggcgatggtagaggtgccttgcattgtcggcaagaacggtccggagccgatcacaatcggcaaaataccgcagttccaaaaagggctgatggaacagcaggtgtcggttgaaaagcttgtcgttgaagcctggattgaaaaatcgtatcaaaagctttggcaggctctgattttgtcgcggactgtgccgaatgcacgaacagccaaactgattctcgatgatctgattgaagcgaacaaaggctattggccggagctctccgcggaaaatcttcagccgtcgctttaaggatgaaagcgcctggggctcctgagccagaccgccagcccaggcatatccccccatttattctcgtattttatataatagagacagagaataaatggggtgaaaatgatgcagttggaagaattaatgaacaagcattataaaaaattgaacgaaaacgattttcatgttttgaaatatattttgaaccatcaagacacttgctacaagctgggcatcaacgaattagcaaagaagtgcaatgtatcccgcacatcgattttaagactttctcaaaaactggatttcagcgggtacagcgagttcagggtgtttctgaagtgggaggccgagaagcgggaagaagagcgggaagattgccgttcctttgaaagcctcatgagggatatggaagcgagcatgaaatatttgaaaaatacggatttgcgaaagatgtgccagctcattgacgaagcggaccggatttttgtctatggttcaggcacggctcagacgacgtgcgcttatgagctgcagcgaatgtttgtttctcagcaccgttatttgacggtgatcaaagatcaaatcgatttcgacctcatgtttcctgattttagcacggccgatctgatcatcatcatttcgctgtcaggagaaaccccgtcgctgattccgcaggcacagtctttgtcggctaaaggcattccttttatctctttgacgaatttgaaaaataatctgctcgcccagctcactccttacaatctctatgcgccgagccagacggtgacggtttatccaaaaacagagctgaccgcttttgcacccttttttctcgttggggaagcgctgtttcgcagctatgtcgactatgctgaagaaaagaaaaatcaggagtaacaggggggattcgcattgatgcaaaaagtacagcggttcggaagcgccatgtttgtgccggttttgctatttgcttttgccgggatcgtcgtgggcctcagcacattatttaagaatgagcagctgatgggatcgcttgccagtcaggataccttttggtatcaattctggtatatccttgaggaaggcggctggaccgttttcaggcaaatgccgctgttgtttgcggtcggaattccgatcgcactggcaaaaaaagcgcaagcgcgggcatgtttggaagcgcttactacttatttgaccttcaattattttgtcagcgctattttgactgtatggggcgactttttcggagttgatatgactcaggaagcaggaggaacaagcgggcttgcagaaattgccggcatcaaaacccttgatacgaacattatcggggcgattctgatttcatcgattgtcgtttatatccacaaccgctattttgataagaagctgcccgattttttagggatttttcaaggctcttcattcgtcgtcattatttcatttgcgattatgcttccggtagcactggcaaccgcgtggatttggccgatggtgcaggacggcattgcgtcgctgcaaagcttccttgtcgcctcaggtgctttcggtgtatgggtttacacatttttagaaagaattttgatccctacgggcctgcatcacttcatatacacgccatttgttttcggcccggccgtagttgaaggcgggattgtcacctattgggcgcagcatctcagcgagttttcagcaagctctgaaccgttgaaagagctctttcctcaaggcggattcgcgctccacggaaactccaaaatcttcggaattctggggatcgcactagccatctatgtaacagccaaaaaagaaaagaaaaaaatcgttgccggtctgctgattccgatcacgctgacagcggtaattgcggggatcacggagccgattgaatttacgtttttgttcatttcgccgctgctgtttttcgtacacagcctcttggccgcgacgatggcaaccttgatgtatgctgcaggggtggtcggaaatatgggcggcggtttaatcgagattttaacgctcaactggatccctctgtttcatcagcacggcagcacttatgtttttcaaattttgatcggcttgtctttcaccgccatttacttcttcgtattcaggttcttgattttaaaattggatattgccacgccggggcgtgaaaaagaccagcagcaggagacaaaattttattcgaaaaaagattacaaggcgaaaaaagaatccgaaaaagaggtttctgcggcgcaggaaattgctgagaccgatcaggcggttctttgcatcaaagcgctcggcggaaaagaaaacattgcggaggtgacaaactgcgcgacaagactgagagtcagcgtgtatgacgagtcaaaagtggagccggacagtacgtttaagtcctttggcgttcacggtgtcgtcagaaacggaaaagccttgcaaattattatcggtctttcggttccgcaagtccgtgaaagggtcgagaagctgctgaaccaatcataattgcgccggtgcaaatggcatctcctgaaatgacacatgcaagctgcagagacttgcatgtgcgattgggggatgctcttttaatgcaaagacaagctaacgcttcacaggttatccacattagctcgctctatgccgatgtttacctttttttacaattcagcacgtaaatttcattcttcagccgttcagatgttttaatgacaactttttcggtgccctgaaaatccaaaatgccgtcgtatctttcgatgacttcgtcaatatgtttgaagtggcggacgtgggcgcgtgaatcatagttaggcacagaaatcaccatgtcgctcccttgaggaagactcgataaaaacgctttgtctttctctatatgctctaacacttccagcaaaacaaaaacatgatatttttgcagcatccggacgatcgcctcgtcatatacatttccttcgatgaaagtaaacgagggattataccttttggcttcttcaagcattcctttggaaaaatcgatgcctaaatattttctgtatcctttgtcatataaaagctttgcgaatctcccagtgccgcagccgatatcgacaatcgtttcatctttggactccggcaataaacgtgcagcttcttcatacacctttctccacgggcttttttcaaacggaatcagatgtcggtcaataaattgatcataaaattcagctggcatttccgttcccatgtttttcacctcgaaatcttttaaatcatcagtaatagaaatatatgtccggaaagaaaatgcgtgcgggaagaatccagccgataagaaaaatagatctattcatcattgttcctgctgctctaaaaaatctattattgtgtctactatttcttgtgcacgcgcatgataggtatgctgtgaatgaacgagacggtagccgttgtctgtgatacgctgcctttcttttttattttgaagatagtattttgctttgtcataaaagtcttcaacttcacaagcaatgaaatgggtgccgtctttaaagccaagatcgaaaatatcttgatttggctccgccagcaacagcgttctgcaggcaggggcttcataaaattttaacaacgggtagcggagggcgcttccgcatgtgaaaaatatctttgctctgttcaattcctgggcatatttttcattcaaaaaagcctgcttgatttcttcttcgtcagttatgacattgccgggatgggggtggtgaacaaacccttcttcatgcttcatggtctgcaatacagcctccctaaaaaggtattttccttttgggggatatcttttgtttccttcatgtacaagccccatgagcaaatagtctatcgttttcttcaacttccagtccttgaatatttctggatcaactgcccatggaacccatctgaatttgtctttgtactgggggtattcatttaaaaaatgctcttttgtcactgaaaaaattaaatcaatttggttgtcttcgaaatagctgcttctgatctgtttattaaaatgagaatcgatcacaaacgcgccggtggggatgtttgtatctttgagccccctaatgtttggggacaatgagaagccgtaggcaatgtcgtagtggaaaatgaaatcaggacgaaattggattttgtccaatatatccggaagatagccgtccgtatgccagtacatgacttcggcaaactcctcaagagatttcatcattttatactttacttcatgtttgggcatggtcttccaaaacgttttaatcagaactaatattttcaagcatctccgcatttctttctcctctcaagacatcttcgtcatctttccctatttaatatatgaggattaaaaattgatgttcaggcaagcgttaaaaagacggggggctgggggcagcttgaaaatatgcggaattaatcagcaaaacaaaaaggcgatgcacctgagatgcacgccttttttaatgattttcccgttcattggcttcgtccagatcgatccattcctgcgaccatttttccattcctttaaggaccggttcgagcgcctgccctttttcagtcagggagtattcgatccgcaccggagtttctggatacacatgccggtggatgatgccctcgtgttcgagttcttttaatctttcggataacagccttccgctgatgggaagggaagattctatatggcaaaaccgctgcgggccgttaagaagctggtgaatgatgaatccgttccagcgctgacttatcattttcattcctttttcaaatttcggacataaagatgataggctcatgttcctcacctctctaggtctattataacggtatatcaatgaatgagcaaagctcataaaatgtcttgacgtaagtttgttatttatatatactaacttacacaaagtaagtaacgaacgaaaaaaggaggacactgcagacttattcaaggggatatgttgatagatggataaagttggcgttcgtcattggtctttaaaataaaaattgaacaagaggagaaaataatgagcaacaaatacgaattaggtgcattaatttttacgtttggttacaggtcttacatttttgcttcacgggctttcaaaatttcaaggcgggattgaaaatactgtaggattcttcagcagtgtcggaattccgggctttctcgcctatatcgtagcgattatcgaattggccggaggggctttgatgattctcgggctcggtacacgtgtgattggccttttatttgcgattgtcatgctgggggccattttcactgttaagctctccgccggtttcatgggaacggatggaggcgcaggctatgaatttgacgttacgcttcttgcaatgtctgtatacttggccttgagcggaagcagcatgctgtcccttggggaaatgatcctgaaatcaaggaaagaaggaaaaacagatgacgcagcaaatccacccgggcactgagctcggatatgtcaagctgaaggtgagccgtcttgaaagatcggtttctttttacagggatgtgatcggttttcaagtattaaaacaggacggcaaaacggcggagttcacagttgacggaaaaaatccgcttttgatcattgaggagattccaaatgctgttgttcttcctgaacgatcggcagcaggcctttatcattttgccattttgcttccaaaccgaaagcagctcggcatggctgtgaagcatttgatccgcgccggcattgaactcggccagggagatcaccttgtcagcgaggcgttttacttgtcagatcctgatcaaaatggaatcgaaatctaccgcgaccgtccgcgagagggatggaagcgcgatgagcaggggaactacgtgatgggtacggagccggttgatgtccaaggacttctggaagaagccgatggccacgaatggcaaggtcttcccccggaaacaaaaatcggacacgtccattttcacgtccgggatttgaagcaggcgaaagaattttaccactctgtactgggatttgatatcacaggagattatcaacacatgtcagcgctttttgtctctgccggaggctaccatcatcatatcggcttaaacatctgggccggacagcatgcgccatttgccccgcttgatgcggcaggcatggcgtattacacggttcttttaccgaatcgagcggaacttgaccgaattgcaaaaaaactgaaaagctcgggttatgccgttgagcatgaagaaaacgcatggtttgttaaagacccggcatcaggtattgatatcagattgaccgtttgaaaaggcgaaactccagtttcgcctttttttatgccattcaatcaaaggacaacaaaagcaaagaatgagaagaaacagacattaataacaaagattcaggggcagcagctatgctaacatgaatttgaaaatctggaaatgaggggtgaaggttgatggcaaaaagcctgactggcaaggcgaaacatcatccgcctgtctggaatccgaacattgacggcgggcggttttgcaatcccgttcttttcatggactactcagatccggatgtcattcggaaaggcagcgacttttttatggcggcttcaagtttttcctgttttcccggaattcccattttgcactcgacagatttggtgaactggtcattgatcagccatgtgtttgacgagctccccttcggcgaatatgaggcccctgctcatggcaaaggagcgtgggcgccgagcattcgataccataacggagaattctgggtgtatttcgcaacgcctgatgaaggaatcttcatgagcaaaacatcagatccgtttaaaggatgggagcctctcatacaggtcaaaaagacaaagggctggattgatccttgtccattttgggatgacgatggaaatgcctatctgatccatgcttacgcaaacagcagaatcgggatcaagagcaagctgaatctttgccgaatgaaaaaagacggaacggctttggaagacgatggagaaatcgtctttgacggcacgctgaaccaccctacgattgaaggaccgaaattgtataaaaaagacggctattattatatctttgctccggcgggaggggtgaagacaggctggcagacggttttgcggagcaagcagatttacggtccctatgaagacaaggttgtccttcaccaaggaaatacggtcattaacggtccgcaccagggaggctgggttgaacttgattccggagagtcatggtttatccactttcaagatcgcggagcattcggcagagttgtgcaacttcaacctgtccgctggttcgacggctggccgctgatgggtgaagacataaacggcgacgggatcggagaaccggttttgcattgggaaaagccgaagacgggcgccaaagaagtgaaactgccctttgatcatggcaatgatgatttttcttcttcagaccgccttgcgcttcattggcaatgggaagcgaatccgaagcaagaatggtactctctcagcgccagtcccggccggcttcgcttatacagccgcggcatcgctcatccgttcaaactgagccgcctgccgaaccttctgatgcagaaattttcggggccaagcttcacagcaacggtcaaattgtcgctaaacgccttgtcggaaactatgatggccggcttggctgtcatgggaagggaatacgcctatctcggcttctcgaaatcagaaaacggttatcggctttctgtatacgaaggccgtatagaaggtgatcaggaagatgtcaaaacagaagagcgcggcgtacatgcggaaatggtctatttgcgcgtgactgttgatgaacaggcggtctgccgtttcagctgcagcatggaccggcgtcatttcacacagattgggaattcgtttcaggctgttcccggactgtggacgggtgccaaagcaggtgtatattgcgccgataccggcggagaagacggacaggacggatggtgcgatatcgaatggttcagtgtcgaaccggcaggaggggaatgccatgagcggtgaacacacatatacgaacccggtgttgaccggttttcatccggacccttcaattatcagagtcggggaagattattacatggtgaactcaacgttccagtatttcccggcaatcgttatttcccactctaaagatttagtccattggaagatcatcggccacggaatcacggaaaatgaaggattggacctgtcggatatcaatgattcgcacggcatttgggcgcctgatatttcgtatcataacggaaccttctacatcttcgcgacgcacaggctgaacggaccgactgtcatcaacggccgaaagctgatccgcagacagattatgatcaagtccagccgccccgaagggccttattcaaagcccgttttcattgatgaaggcagcggcatcgatccttctcacttcgttgacggcgacgggaaacactatatgctgctcagtcctgcctgcacgctctttcctctaaatgaagaatgcacagacatctccggcgagccggttcagatatgggaagggactgggagaagggcgcctgaagggccgcatttgctgaaaaaagacggttattactacgcgatattggcagaaggaggaaccggatattcccactcgattacgacagcccgctcaacgcatttgtacggtccttatgagccctgcccgtataatccgattttaacgcagacagacccggatgctccgattcaaagagcaggacacggcaagctcgttgaaacccagaatggagaatggtgggcggtgtatctatgcggacggcccaatcaaggtagctatacaacggttgggagggagaccgctttggatcccgtcgaatggacggatgacggctggtttgtcatcaacaacttgaagggcccgagtcttgttcagcgcgctccaaacctcccccaagtcaaatgggatgaaaagaatttcgacgattttgacgaggatacgctcggtcttgactggcagtttgtcaggaatcccgatcattccagctggtctttgatcgagagaccgggatatctcaggctgtggacaggtgattgggatttacatgacatccgtgcaaaaaatacggtcgtcagaagggaaaagcaccacctatacagcgccggcgtgaaactcgacttttcaccttcggcctccggagagcaagcggggatcgtctgctactacagcacgaataattatttgaaatgctgcttgatctatgaagaaggattgaagatcaaggtcgtggaaaatcgctccggttgccaaaaaacgctggggaaaaaacatgccgaggccggcccgctgtttctgaaagctgtcatcaataagcaaaagagggatttttactacagttatgaagggaagcattggcaccacgcgggcggtacagaggacgccagttttttaagcgatgagggttcgcgtgacgcaaagggacatacgggaacgatggtcgggatattcgccaataacggcggaagcggcagaaaggctgccgctgattttgactggttccgctatattgcatattaaatgtctctgctttttttcctgtattgaagcggcgggatgccgacgatctctttaaacactttattgaaatggctgatatgcttaaaaccggtatccgcagcgatgtccaatattttctcgtctgtatcacgaagccgttttttcgcttcgcggatcctgatgtgccggatatactcctgaagatgaaagccggtcacttttttaaacactctgcttaaataggatgggctgatataaaattgtccggccaatccgtctaacgtcatcgtttcttgaaagctgcaattgatatatgaagcgatttccgagattttttcatccatcgggtgaagcggccgtgtttgattgcggccgccgcccgcaaggctccggtaaatggtgaaaagcagctgaaacagcagcgccctgacgacatcctcgtgtccttcttttttcagcttgcactcctttttcatctccatcagcatatgttcgactgcggcctgttcacgcagggaaaatgcgatgaagttttgattttccggaaacggaagaagccgataatggctgcacttcagcaatggttctatgaaatcgtgcgagaaattaatcaggatgcgttcgaactcttgaacttccgtgcttgacgttcggtggaggtcgtggggattgatgatgatcatcgtgcctttttccgcggtatagacgctttggttaataaaatacgtgcgttctccgctcagcagataatacagttcatagccttcatgaacatgcggcgcgttcatctcggtaaatccttttctctgcatatattgaatcgaaaaagaatgctcggctatgaaatatttaggatggagcatgtcgggcattcctccttgagagcgttttcttaacaaacgggagggatcgtatgaaaaagttatgttgcctgatcttggtcttggttttttccgcgggctgtactcagcaaaaggcatcaacggaagaggacggggcgcttgaaatcaattggctcgtaccgctccacacaccgcagcctccgaaagagaaggcgcttgacatcattgaagacaaaacgaatacaaagctgaagctcatctgggttccggattcaacaaaagaagagcggatcaatacaacccttgcaagcggaaacatgcctaaagtaatgacattgcctgatcttgaagattcagcggttgtcagcgcgctgcgctcgggaatgttctgggaaatcggaccgtatttcaaagactatccgaatttaagaaaacttgataaaactatattgaaaaatatttcggttgatggcaaagtttacgggatttatagagaaaggccgatggccaggcagggagtcgtgattcggaaagactggctcgacaatctcggattggaaatgccggaaaccgttgatgacctttataaaatagcgaaagcatttacagaacaggaccccgatcaaaacggaaaagacgacacgttcggtctcgccgaccgcaatgatctcaccttcggagcgtttaaaaccctggcttcgtactttggcgcgccgaacgaatggggaacggacgaagacggaaatctcttcccctattttaagcatgaggcctataaagacgcaatggcatacatgaaaaagctttatgaagaaggcctgatgaacagggactttgcggtgacaagcaaaacgcagcagcaggatttagtgattcaggggaaagcgggaatctatatcggcgcgatgagcgatgccatgaacttgcgtgatcagggactcgctttgaaccccggctttcagcttgatatcgcaaaccggatcaagggccccgacggcaaggagcgcacatgggcgctcggcgggcatggcgggatgttcgccatttcgaaatcaagcgtcaagactgaaaaagaggtcagaaaaatcctcgcattttttgacagaatcgctgaagaagacctcaacaatttgatgttgtatggaatagaaggcgtacactatgaaaagaaaggggggagcggctattttcgaaagcaggaaaactaccatctgtgggaagcggaaattcagccgttaaaccagctgattggcgtcaataaacaagctttaaaaagcgctgaagatccgctccgcgccaaaaatgaaaagcttgaggaggacaaccgggcaatcgcagtccagaatccggccgaaccgctgtattctgccgcacagatggacaggggaacagaattgaagaaaatcattgatgacgccacatttcaatttattctcggggaaatcaatgaaaaagctttgaccaggcagtcctgaaatgggagaagcatggcggcggaaagatcatgaaagaactgaatgaagatctgaaaaaagcaaactaaacagaaaaccctttccatttttttgaaaaggaaagggtttttcatcgtattcgctccaagttcattttctttaaattctgcaaaataaacaatataattccatcataggacgaaaaggaggaagcgatatgcagactgccgttatatatgcacacccaaatccaaacagtttcaacggagccattttaaatcaagtcataaaggcgcttgaggacggtaagcatttttatgacgtcattgatttgtatagagaccggtttgatcccgttctattatttgatgaaaagaaaaggcgctcagatatgaatcgcgatccggaaactgccgaatatcgaagaattgtcaaaaacgccgaccatctgattttcatttatccgctttggtggggcggaatgccagcgatcatgaaaggctttattgaccgcgtttttgccgccggagaagcctatacatatcaaggaaagctgccaaaaggcctgctgaaggcgcgcacggcatcagtttactacacggctgacgctccgtcttggtatttgcggttttggcagcgggatgccgactgggtgacggttaaagatgtgatgttgaagttttgcggcgtacggcgggtaaagcgcctgctgtttgccggcgtgaaagacagctctgaagaaaaacgcacgcaatggcttgaccgtgtctaccggtctatagctcctgcagatcgggggatcagcaaatgacaaaggagatgaagtggctggattgggcaaaggaaattcaagctatcgcccaggcggggcttgcctatacaaaagatgactttgatcgtgaacgttttgagcagcttcgcgagctgagctgcgaaatcatcgccgattatacggaaacggacttctctaaagtgaaagagctttttgccggggaatcgggctatcaaacgcctaaagtcgatgtgagagccgtaatttttaaagatcataagctcctccttgtccaggaaaaagcagacggcaaatgggcgctgccaggcggatgggcagacatcggctttacgccgaaagaaatcgcggttaaagaaacgcttgaagagacaggtttgaaagtcaaggcgcataaacttctggcggtcatggataaaaagcgccacaaccaccccccttccgccttccacatctataagctgtttatctcctgtcaaattgtcggaggcaaggcggaagcggggactgaaacacaaaaccttggttttttctcattggagaatctgcctgaattatcggcagcaaggaatacctatgaacagatcgaatatctttttgaaaagcatgatgaagtgtattgcgactaagggaggaacagacaatggatcagttgaaatatccgatcggcaccttttccaaaccgcttgaagcggacgaaagggaactggaaaaatggatcggggatctgaagcaagcgccgcatctcctgagaagcgcggcggcggaactaaatgaagaacagcttgatacgccgtaccggaccggaggctgggctgtccgccaagtcgttcaccatcttgccgacagccatatgaacggctatattcgaagcaaattggcgctgacagaagagacgcctttgatccgcacgtttgacgaacagaattgggccgggcttaccgatgccagaacgctggatccggatttgtcgctggcgcttttagacacgctgcatctgcgctgggctgctcttttttgaatctttgacagaagcggattttgaaaaagcgtacatttatcctggcacaggtgaggagatgaagctgtatcaagcgcttgctctctatgtgtggcactcacaacaccatattgcccatattaaagcgcatcgaaaaagaatgggctggaattgaaaaaaacgcgccgcgggcgcgttttttgtttgccgtttgttttcagaggggattgttaacaataacataacagcggaatcgttggttattgctttttctagccggtaaattaaggtaagatatatgagttatcacccaaaacgtgatggatttatcttgcgattagattagagagaagtggtttttcatgaaaaaaaatgcgctggcgattttaaggatcgtgattccggcggctgttcttttgtttgtcttttttcaagcgaaaaaagaactggccgggctgtcttttaaagaaacatttttgattatcgatcaaattaatcggattgacctattcatccttgtttttctcggacttgccgccattttggcgatgacattatacgattttgttctggtccgctccctcggaatgaaggtttcgaaatggaaaacgatcaaagtatcatggatcgccaactcacttaacaatgttctcgggttcggcggattgtccggtgcaggattgagaacgatcctttacaaagagcatgttgatgatgtgaagaagctgatcagggggatcgcttggcttgcgtcttcggttcttctcgggctgtctgtcctcagccttctcgtccttgccggaattctgcctgccggggatctgtttacagaaaaaacgtgggtgctgctggctgttgccggtacggcgatgatcgctcccggtgcggccgtcattttaatgatcaaaaagaagagaagcagaggagccgaaaagggcatgcggctttcggtcttcttttcttatctgggtgcatcggtgatcgagtgggttgccgcagcagcggtcatgtattattcccttgcaacgatgggcgtcgaattggacttaaaaaccgtcatcggcgtttttacgattgcttcggtggccggaatgatcagtctcgttcccggcggattcggttcgttcgacctgctttttttggtcggaatgagccagctgggggttgatcaggaaatcactctgacggcgattgtgctctaccggatcgcctattcgtttatcccttttgtgttcggtcttatttttgcagcagccgatttgactggaaatacgatgaagaggctcgaagaaaaaccgattattgccccggcaatagaaacgaccaatattctgttgattttacacagagcgctcctattcagactgctgaacggttcgctttcagtcatcgcattttgcagcggagcgattgtgatcgcatctgtggcgctgccgattgacaggattacattgataccgaatatttcgaagttcatgctggtgttttttaacggtttgtccctcagtttcggcttgattttgctgattctgccgcttgaactttatcggaggacaaagagatcttattatatgacgctgaccgctttggcgcttgcctttctgttcacgctttttaaaggctttaatattagcgccgtcttcatgattcctgtggtgtttgccctgtttgtattgctgagggggcagtttacaagggagcgggctgtctacacattcgggcaaatcgcatggggagcttttatcttcctctttactttattgaattacaatattatcgcttcacacatttgggaggcgctcggccatcttcttgtgaaagattatttcattcacagtgaacgccatgtcgacttcgcgacgttttttgcgttatttttcgttccgctgtatttcgctgttttcatctgggcgtttaacaggaaaacgaaagagatcggtgaagagcctgatccggagaaactggaggcattcttagaagaaaaaggcggcaacgctttgagccatttaggctttttaggggacaagcggtttttttattcaagcgacgggaatgcgctgattcaattcgccaaagtcggccagcgcctcgttgtgctcggcgacccgtccggccgggaagactcgtttccgctcgtgatcaaagaattccttcatgcggctgaccaaaaagggtatcttgtcattttctatcagatcgaacgcgaagacatggcgctctatcatgacttcggataccgctttttcaagcttggagaagaggcgattgtcgaccttgacacctttacaatcagcggaaaaaagcgggccggactaagggcgatctacaaccgttttgaacgggaagggtatacgttccatgtcgaacagccgccgttttcgagagaattcctcaacgagctgaggcaggtgtctgatgaatggctcggccgcaaaaaagaaaaaggcttttcgctcgggttttttcaagaagattatttgcaaaaggcgccaattgccgttttaaaaagcgaagaaggcgagatcgtcgcgtttatgaatatcatgccgatgtaccgcgaaggggaaatatccatcgatctgatgcgctattcgaaaaaggcgccgaaaggaatcatggatgcgctgttcatctatttatttcaatggggaaaagaacagggctacacggccttcaatatgggaatggcccctttatcgaatgtagggacaacgtttcagtcattctggacggagcggctggccgccgtgattttcaacaatgtcagctacatgtacagtttcagcggactgcggtcttttaaagaaaaatataagccggtttggcgggggaaatatttagcctatcggaaaaaccgatctctcccggtaacgatgatccttgtgacaaggctgatcggaaggagaacgaaatgaggccgtttattaaaacggccttttttttatattgccattgtaagaagcactcaaaaggcggtatactgcaaatgattggaagggaaggatcgaatcgacaaatgggggatcaaaatgaagccaattgaagtattaagatatgacgcattttcaaagactgcgggtcaaggaaatccggcgggcatcgtgcttgaagcagacgggttgaccgattgggagatgcagaagatcgctgaacaggcaggctataatgaaacggctttcctgctgccgagcgagtcggccgacataaggatccgctactttacgccgggccatgaaatgaatttatgcggacatgcgactgttgcttctctttatgcgcttttggaaaaaggcgcgattgaagctggcgcggacgtgaaggtcgaaacaaaagcgggcgtcctttctggtggtataccgcctcagacggcaatcggcgttttttggtgacgctggagcaggcgcccccgtgttttcagtctttcacaggaagcagaagccaattggcggaacgctggggatcagcgaaggagctttcatgaagcattgcccgttgtttatggaagcacaggtatatggacattgcttgtgccggtgagagatttggccgcaatccgcagatgtaagcccgttcaagctgaatttccgaacgttttaaccgagatgccgcgagcatctgtccacccgttttgcctggagacgatgcagcgggattgccagcttcacggcaggcatttttcatcgccttattccggaacgagcgaatatcctgtcacaggaacggcatcaggagtgatgggcgcttatatgaaaacgttcggaaaggaattctgtgaagagggccagactgattttcagatcgaacagggccaggaaatggggaaagacggaaaagtgaaaatcgaagttgcggaacaaaacggcatcatgaaagtgcgcatgacaggaaccgctgtatttgctgaaaagcaaagctttgaagtgtaaacaaacaccgccttttttagcgagtggagatcattgcaaacgccagcagttaacattataatcaacaatgataatcattttcattaagggggcggccacatgaacgacacgctagaaatccaaagtattcgcgattgcgtcagaaatagaagaacgattcgaaagtttaaacaggatccggtgccgaaggaagtggtgctggaactcttggaagatgcgatttatgctccgaaccacaagctgacagaaccgtggcgattcatttatatcgggacggaaaacgggaaaaagaagcatgccgacaatttaaaagcggcgtttaaagagctcaagccgaatatgcaggaagaacaaatcaataagttcagggagcatattctcagcgttccggcttttctcttcgttattatgaaagaagacgaaaacgaacgggtcagacgggatgattttgcagccgtcagctgtttaatccaaaatctgcagctgctcgcttgggaaaaaggcatcggcatggtatggaaaagcggggaagttctctctcatgaaacactgcacaggttaatgggactgaagcgcgatgagcaggtagcagctctcttgcagatcggatatcctgcggaaattcctgaagcgaagcacaggacgccggccgcacagctttttaccgaattaacttaaagaatgaggcccggaacgtcgaatcccgggcctcgattattattttgactgccgctttttcgcgcgcttatcagctgcctgcatgcgggcttgtgcttcgcggtcatcctgatcggcgagttctgctgaatattcctcatacactccgtcagcttctcgcttatactgatcaggaacttgagggagtttttgcttgtttttatcccggtttttgtggattgcatttctgcccatatgatcactcctcatcaataatcggccggtcaagccttattgttcgctgatcaggctcccgctatgcattacgatttttcccttgcggcgcgctctgccattttaaattcgcgcgaatatctgacttcctgcgtcttgttcagagtggatttaaaacgttcgcgttttttcttgtcagccatcttttaagcctcctaaaaacctaagttattcacaggctgtccgtttccgcggcatttatacaagttttaagcttcttttaaccggctgttttcctcctcgaatgttctcatgctgtacagcgtgtacaaatctttcgggatttcatacaggtgaaatgtatcgctgccggcccagtcaagatcagtcttgacggcatatgggagcttttccgcggctttgagggagcgcatatttgtttttctgattttcataaaaacggcttcaatttgcttttcataaaaaagctcgcaaaaaaacgcgtctttcgcccgctggttatagccttttccatggtaaggcttgccgagccatgtgccgaggaagcctttttgctcttcgatttcatacaagctgatgcagccgatcgggttttcccattcatcaagtattgttcgcgatatcagctttccctgttcttcctcttcaatcatgtttttgacatgaaacatatactcttcaatcgtctccgctttatttctgacaaaagggaagacatccggatgaatcatcagttcaaaaagtgcatagcagtcggtcagttcccgtttcttcagcatggcagcccctccttagtttgagggcggcttttacagcagaacgggacgcgtgaatccaccctcggaattttttaattagcggaagcagttgtccgcgtatcttgcacatccattaaaaaattcggggtgggaatcgaacccactaaaaccagagatctggtggcgcaccatttgccttccctgtacgtgtatgctgctaaaaagatacttacattttacgcagctgggaaaggaaaagctacaaggattttgccggaaaacgccttttatgccagaaggttgtgcagggcatcttccagatcgggatataagaaatgatagccgttctgaagcgcttttttcgggaggacgcgctgtcctttcagcacgagcatgctcatttctccaagtacgccttttatcgcaaattcgggaaccgggagccagtgtgggcgtttttctactttcgcgacggtttgcccgaatgtatccatctgaacgggattcggtgccgtgacattgacggggccggacatcagcgtctgttcaatcgcagataaaatcatgccgacggcgtcttcgatatgaatccatggcacccattgccgccccgagccgatgcgtccgcctgcaaacaattgataggggagcgccattttcgggagcgcgcctccgtcttttccaagcacaaggccaaaacgcatccagacggtgcggatgccaagcgcttcgattggttcggctgcctgttcccacaaagctgtcgttctgcttaaaaaatcctcagccgaaactggagattcctccgtgaatgtctgttcaagactggttccgtaaattccgactgcgctcgcctgaatgagggtgttcggcttcttctgaagactttgtatgatgcgggccgactcctccacagagcggaggcggcttgtcgcgatctccgccttcgttttttcattccaacggccgaaaagcgattttccggctaaattgatccaaacatcgatatcggtcagatctttttcaggacgggcgccgtttttttgccagagaacgaaagaagtgtttttttgttcggtttcggccggttttcttgttaaaatatagacgtgatgtccccgggcggttaaggcgtttgtcaaatgtctgccgataaaacctgtccccccggcaatcgcaatcttcatcatgattcctccctttcatgatcattaaccttattgtaaaagaagaaaacaaaagaagggagttatttatgccatatattacaaagatttctgcccagaaaaacaatgaagagcgggtcaatatttttctggatgaaaaatatgcgttcagcgtcgacctggacgtgctcgtcaagtttgacctgcgaaaaggcaaagagcttgatgagcttgatatcattgagattcaatacggagacgacgttaaaaaagggttcaaaaaagcgctcgattatttgtcataccggatgcgctcgacaaaggaagttcaagaccatcttaagaaaaaaggcgtcgcagactccgcgatcacagaaattctgcatatgcttaaaggttataaatatttggacgaccgcgaatttgcggctgcatatgtcagcacccacagaaaaacgagcggcaaaggccctgatgtcttattcagagagcttaaattgaaagggatcgatgatgaactgattcatgaagcgctcagttcgttttcgttttccgatcaggtcgaggccgcggtcaagcatgcggaaaaagtactgaaaaaagaaaaaaagctgtcctccaaagagacgaagcaggccatcgaacagcaccttgtcagaaagggtttctccttcgatgtcatttcggccgcgcttcaggaaaccgattacgaaaacgacgatggcgctgagagagaagcgcttgagaagcaaggagaaaaagcaatgaagaggtacggttatgacggatcatacgaaacgaaaatgaaggtcaaacagtatctgtttagaaaaggattttcaattgacttgattgaccaatttttagatgaaaagggatgagaagatggagaaaagatacagtgaaatgactgcacacgaactgcaccaggaaattgcgggtctgaccgaaaaggcaagaaaagcagaacaaatggggattgtgaatgaactggccgttcacgaacggaaaatcgcgatggcgaaagcctaccttcttgatccggccgattttaaagccggcaacgtatacgaaatcgaagatgggggcgacgatttccatatccgctatttaaacggcgtattcgcctggggataccgtctttcgtcaccggatcatgaagaggctctgccaatttctttattaaaagaaaagggctaagacaaaaagcctaaacccttttcataactgctatcttgtccggatgcgcgtgttgcgctggagaatgatgaggtcctgagtctgctgcgtttctccgttcacctgtgcgcgcgcatgctttgtgtttgcccatggctgcggatagttttgcgttttcatctggttaaaatcgtttgtatacggtttgcgatttgcacacaacagaaatcactccatcccagaaaagtttagcgtttgccggaagccctcattctttcttgaggatgagtatttgtgcttccgtcagggcgctttgaagcaaaatcatctttggcccggggctcgccttcaaatttattgttgttcatgttcggaaagcctcttgatttatttcgcatctctttttaggctcctccaatcaagtccataatatttgcgtcttcggttcggaagacgtaaggttagtatatgaaaaggacgacgttttcaaaaagaaagttttttccttagggaaagggggaaaagccaagtggaagagtactttgaaaaactgacaaatgcgcttcttgaaaaaaatcatatgctgagctacgcacaagccagaacatgggttgaactgctgtggggcgatttcgaggcgacatttgcaaaggccggccacccgtacagaggaaaagagctgacagagcgagtcgtcaaagagtggattgagcactacggcagccagttgcatttatttcaaaatgacaagccttcttaccaggatctgttctccggagcccgcgggctgcttcattaagcattgctttagaaggaaatgatgcattgtctgactgtgccgcctggcactggccttactggatgaggacggtaagggcacactaaaacaggtgcgctccgcgtcagcaaatataaagaaaatgaagcggctttcgcgccgcgaggtcaaatcgtccggttaacgaactgtgaaagaagaaagctttttcctccgcttgcagagagagccgagcaagagcagaaaagctctccttcgggcggcagaaaacatgttgccgttttgcggaatgggaaagtgaagctgtcatgcgaaaacggccggcggcggagccagatccggttttcgcccgatgacaaagacttgctcccttttgcccgaacatatcaaggaaacggatttgattgcggcggcggggtttggcccctaacaatcagtcctgatgcaagttctcttgcggctgctttggtttcggggaagattgaacttatgtgaaaaatgtcgcaaaaggaaaaattgttatgttgccctgattgaagctaaaggaatatcatttttttaccacttgttcatagatgtctgatataatgacaaaataatcttgtagaaaatagtacagcgtgcccacagttttccttttgttgtgtgggaagcggctagatgcaagtatcctgccaagcggatgccggatgcaattttattatgtccaaaagaggtgcctttaagtgaagaaaggattcgtttcaatcattattccttcatacaatgaagcaagcaatattaaattgatttatgaatcgttaaggaacgaatttcaatccattgattatgattatgaaatttattacataaatgatggaagcactgatcgaacattggaggaaattaaaaaactagccgaaaaaagcgagcatgtgaaatatatttcgttttcacggaatttcggcaaggaggcagccatccttgccggttttcagcatgcccgcggcgatgctgttgtggtgatggatgcggatttgcagcacccgacatacctcctgcacgattttattaaagggtatgaggaaggctatgatcaagtggtcgcccagcgcaacagaaagggagacaaccccgtgcgctcctatttgtcatccctttattaccgctttatcaacaatgcggtagaggttgatttaagggacggcgtcggcgattttcgtcttttaagcagaaaagccgttaatgcgatgctgaagctgagcgaaggcaacaggttctcaaaagggctgttttgctggatcggttttgaccaaaagattgtttattacgagaacgtcgaaaggaaaaacggaaaatccaagtggtcgttccgccacttgttgaactatggaatcgacgggattgtgtcgttcaacaacagaccgctgagaatgtgtttttacgccggtatttttatcctttttctatcgcttatttatatcgcggccacattcatcaggatcttaaaatacggtgtgattgttcccggctattttacgattatttccgccgtcctgtttctcggcggcgttcagcttctcagcctcggaattatcggcgaatacatcgggcgcatttattatgagacgaaaaagcggcctcattacttgatacaggaggcaaacatcgctcatggagaaactcatgaaaatcgtgaatcctgaatttattcgctttgccgttgtcggtgtagtgaatactttgaattactatgcggtttatttgctgctgcatgttttgcttcagttgaattatatggtttcgcatattgcagcttttttcgtcagccttgtgatttccttttttctgaactgctattttacttttaaaatcaagccgacgctggcaaagtttttgcaatttccgctgacacagctctttaatttgacggtatcttctttgttcgtctacacgtttgtgaattttttcaagatgaacagtgaggcagctccgcttgcctccatgtttttaaccgttcctctgacatttttagtgacagggaagattttgaaaaaagacaggggaagagtatgaagaaaacagtttttctatttgtgatcgcaagcattgcagtttccgtggccgcccattctttttttctgtatgaatgggcgcatgaccgttatatgacggggaacggcgacggacttgcacaaatgatcatttttaagtcgtttctttttgagcaatacaaacaagggaacttcttttattcgtattctttcggtctcgggggcggcatctacagccagctcggctattatttcacgacttcttttgtcttcatcgcttcattcgcggccgtttttctgatgcagcttttgcatttggccggggatgcggatcctttgttttgggcgcaggccgccgtattcatcagtgtcatcaagctcagcctgatcattttagcggcagcgtatgcgttaaacggtatggtgaaaaacaagcttgccgcctttacgggtgcggttttgtatggcacatcggtaatctatttcaggcacacggtgttctgggaatttttcagcgacgccatgctgtggctgccgctgcttgtcgccggagctgagaaagtcatcagagaaaagcggacagcactgtttattaccgcttgttctttgacgctgatcaataacttttactttgcctatatcaacttgattttcattgcgatctatatcatcttccgctggctgatcaggcttgacccggaaaaggaggcgccgaggtggaaacaattcagaatgttcgccgcttcaggcctgatttctttcggaatcagcgcgatttcctttgtgcctgcagtttacggctttttaaacaatttgcggccgccgtatgaccaggctgtcgctgtatacgatctgacggacaacattctgttttccagccgcattgtcttgctgccggctgtctttatgctgttcttgttcgcattttccttctataaaaataaaacgttcaggctgtttgcctcaatcagtgtgctgcttgtgcttctgcattacagcccgcttgcggcaagcgcattcaacggtttctccgctccgcagaaccgctttgaatacctgctcgcttttacgatcgggggagcggcggccgcaggaatgaccgaactgaaaaacatcaggcggaaagagatgatatggtctatcctgcttgtccttctggtttatatcgcggtcatttggcggaaagacttggatttatcacttatgcaaaattggagcattattgtgcttctgttcctgacaatcgccatatttacggcggcggggtttcaatataagaaatcgcagctttttttgcacgtctgcattttattatcgtccgtcctcgtggcgaacacgtatcaaaagtatgttctgtctgagtcaagcggcattaaaaacgtcacgaaaagctatttgaccagcaatgagtacaatggcgaagaacagcgccgcctcctgaacaacattcgaaaagacgataagggtgacccctatacaaggatcgactggatgaacggcgtccgcaacaatactccgctgatgcaggattttaacggcttcagcgcctactcaagcattctcaatcgcgatcttcttctgttttattgggaagaccttcaaatcgatatgggaagggaaagcgtcagccgctacgcatcgatgggcgaccgggccaacttgtacagtctgctgtacggcaagtattacatgacggaaaaagacaatgccgccaatgttccgtacgggtttattcaaacggatgaatcagagcactacacagtttataaaaacaaatacaccttgccgtttatccggacggcgcgaacgttgtttacggaaaaagctttagcagatgcgccagttttagcgcgggagcatgcgatgcttgaaggaatcgtgcttgagaatggcggtaacggaaaagagcagccgccgagcgttcctgatttgatgaagcagacgaagctgaaaaccgagggggcgagctatcataacggcttcctcgacgtcaccgctgaaaacggaggcatcgatctcattcccgaaggcggggttccaaaagaaggcgactattatgtcggattttatttaaaaagccttgcaaaagaccagttcttcaacttgcgggtcaatgattatgtaacatcaagaaagtcaaaccagtcgatttacaaaacaggtgtttacgatttaacgatcagggtgccgaaaacagataaaatttcaatcaggctgccaaaagggaaatatcaattggaccatttgaggctgcaccaggaagactatcaattgctgaaaaaagccgccgccaaaaaaacgccggccgccgacttgaactggcggaacaatcaagtgtccatcagctttgacaatcaaaacggagaccgctacatggtgctgccggttccgtacgaaaaaggctgggaagtcactgtaaacggaaaaacgcaaaccgttcaaaaggcaaattacgcgtttattggaatccccatcgaaaaagggaagaacaacatccgtctcgtttattacccgccgtacttcaaagctaccttggcggttacagtcatcagcctcatcatcggaatctggtacagcagaaggagaaaaaagcttggctcttaaacagagccaagctttaattttttttgaagtttttcctcgctgaaaatccatccggtataggaggtgattaattcgagcgtgtccctgtcgatgtgtgcgatcgccacgaaagggtagtgtcctttgctgcggtatcgcagatcgataaagcggacttcgtaatgatccttatacgtatcgatctcccatttgtaaaccggtgagaacgaaagaaacgccgaaatgttcttatcctgtttcgccgctttcatcacatccgtatccggtaaaggcaccctgttgaatgtgtcgacgatcacgacgtttccatccatgctccgtccgacgtaaaaagccgattttgctttgacggcgattcgccattgcctgaatttcatcgtaggcgaaataatgatttcttcaatatcatcgattttttcacggagctcatgcttgattttcctctgcatgaaatacctcaccagataataaccggccaagacgatgtaaagagccaaaaatgtatagccttgatgcgcgcctgccagccaaaaggcgatggctatgagatggctgacgaaaataaacggatcaaatgtattaatcaagccgagcgctacccatttccttgaaaacggtctgaccgcctgtgtcccgtatgcgttaaaaatatccacgaacacatgaagcgcgaccgcggcaagggtccaaagccacaggtgaagcagattggcttcgggataaaacagcatgagaatgcccggaatcatcagcgaccaggcgagaacagcggggatggagtgggtgaatcccctgtggtgcctaatataaacagcgttgtttttcaatttcaaaacggtatcgatatccggagcctgagatccggcgattgtcgcaatcatcacggcttgagccattgatgggtccattccgacaactggatcaagcgtcgcgatgcctccgagtgcaacgcccatgacaacatgtgtgccagtatccattggtgacctcccctaatggtgctagaaaatcatttttattttccaaaaacagaacgaacgatggaccttgcctgaaatatttaacgcttttgctttcttcacttttaatgtaacatgttatcgtatatgcatatagtttacaacaaaaagccgaagtaacaaaagatcggtatgcaaatgtgacgtgcacaggcaaggagaagtttcatgatggatctgcaaaagaaattagagcaaaaaaacatcaaacaatttcaagaagatttaatttcttggtatgagcaagaaaaacgggatctgccttggcgctcagacagcgacccttataaggtgtgggtgtcggaagtaatgcttcagcagacgagagtggacacggtgattccttacttcaacaactttatcgaaaagtttccgaccgtggaagcgctcgctgaagccgacgaagaaaaagtgcttaaagcctgggaaggactgggatactattcaagggttcggaacttgcagagcgctgtcagggaagttcacgaacgatacgggggtgtggtccctccttcaaaagaggaattcggcagcttaaaaggcgtcggcccttatacaagaggcgcggtgctgagcatcgcctacaatcagccggtccccgcggtagacggaaatgtcatgcgggtcatgtcacggattctttccgtatgggatgatattgcaaagcctaaaaccaaaaccctgtttgaaaaaattgtcgaagcgtttatttctgaggaaaaaccgtccgagtttaaccaggggctgatggagctgggcgctgtcatctgtacgccgaaatcgccatcatgccttctctgcccggtccgagagcactgttctgcttttgcagaaggctgtgaaaaagagcttccggttaaaagcaaaaagaaaaaaccttcggtaaaaacccttgcagctgtcgtcctgactgatgaagaaggatacatctatatccataaaagaccggcatcaggtcttttggcaaacctttgggaattcccaaacacagaaacgcagaaaggcctgaagtacgagcgcgagcagcttgcggcgtttttgaaagaagaggccggaatagaagctgaaatcggtccgctcgaaggagtcgtagagcatgtgtttacacaccttgtctggaacatttctgtctttttcgggaaaactctcgatcaaccggatgattcatactttaaaaaggtcacgaaagaagagcttgctgaatacgccttcccggtttcgcatcagaaaatatggaatatgtatatgaaataggcagcttgactgtgcatgctgcccgttagtcgtactggatggtggtgccgtgcgtataatcggcttcctggcggcacagtccgcctcttgcttgaatttctttcacaacctccaggtactcggcatgcccttcttcattgagaaatggcatgatttgctggaaggcgcggtgaaaatagagaagctccgcatctttccactcgtttttcggcgtgtggtcgagctcgctcatatcgcgtcctacgtacataaggcgaatgcctcctttttgatcgtgttatgagctattttttatcagattttcaatcactatactaggagatgaatgacagatggaacaaagaaaatgtgcccttattacaggaagcagccgcggcgtcggcaaagcagcagcgctgaggtttgccgaaaacggctacaatatcgtcatcaactatgctagaagcaaaaaagcggcccttgagacggctgaagaaatcgaaaagctcggtgtcaaagcattggtcgtcaaggcgaatgtcggacagccggcgaaaataaaagatatgtttcagcaaatcgaggaggcgttcggcagactggacgtgttcgtcaacaatgctgcatccggcgtattgcgccctgtcatggagcttgaggaaagccattgggactggacgatgaacatcaatgcgaaagctctgctattctgcgcgcaggaagcggcaaagctgatggagaaaacgggaggcggccacattgtcagcatcagctcgctcggttcaatccgttatttggaaaactatacgacagtaggcgtttcaaaagctgcgcttgaatcattgacgagatatcttgccgtagagcttgcgcagaaaaacatcatcgttaatgcggtttcgggaggcgcgattgatacagacgccctgaagcattttccgaaccgcgaagagcttctggaagatgcccggcaaaatacgcctgccggccgcatggtagagatcagcgacatggtcgatgcggtggaatttttaacgtcagggaaagcggacatgatccgcggacagacgatcattattgacggcggccgttcactgctcgtataaatttttcgcgttcaatgaataggatatcaccctcctgcacaatctaatggtcgtggaggtgatatacaatggctaaccaacaatccaaaacaaacgcacaaaaagtaagacaacaaaaccaagcttctgcacaaggtggtcagttcggcactgaatttgccagcgaaactgacgcgcagcaagtaagacaaaataaccaacaagctgagcaaaaaaaacagcaaaacagctaatcactgaaacaggaaaaagcacttcaccatcggatgaggtgcttttttctttttgttccgacaaaacttccgaatcttagccagaatcagtcaaaggacatccggcatgtatagagaaatgatacttaggcaataaatggagtagagcatagaatggaggatcccgaatgccggaatttgaaaatttggttcaggggcagatggagattatggataagctgttgtatctgcaagcggagattgaaagatgccagaaaattgaaaaagaactggctgcccttgaaaagaaagcccagcttttatcgatccgggaagatatatcccagaagcggaaagatcttgctcagattcaggatttgttccaaaagcagacggagcaggtgattcaggcttatcaaagaatcgaggcatgagcctctctttatcgttttttagaaaagagccattcctgttcgggagtggctcttttattttcattttttattttcaaacgttataataaataaaagaactgtcggacaggcgatgtgacacactgacttgtaaggcttttgcaaagaaagtaggggagaaaacatgggctttcccaaggaaggagaaaccattcaaattcatagctataagcacaatgggcagattcatcggatttggaacgaaacaacgattttaaaagcaacggaattgtgcatcatcggcgccaatgaccggacaatggtcacggaatctgacggccggacatgggtgacgcgagagcccgccatttgttatttccatgcaaagcagtggtttaacgtcatcggcatgcttcgtgaagacgggatttattactattgcaacatcagctcgccgtttgctttggacgatgaagccatcaaatacatcgactatgatttagatgtaaaggtcttcccggatatgacgtatcatattcttgatgaagatgagtacgcggatcataaaaaggcgatgaattatccgaaggaaatcgacggcattttaaggtaccacttaaatacgctgctgcattggatacaccaaagaaaaggcccgtttgcatctgaatttattgatatttggtatgaacggtatttgcattatacaaaataatcctaaaaaacctgttgaggccaacaggttttttgcggtgtactcacacatcaagatatagaggggggaagacgtgtgggggtaatcagaaggtacatggaatttgtgaagccgtataaatggaaaatcgttttgacggttttaatcggtattattaaattttctattccgctggtcatcccgcttctgctgaaatacgtcgtggacgacatcatccaggggagcgggactgctgaggaaaaaacatccacattattcatggtaatggcggttatgttcgccatttttttggtgcttcggccgcctgtcgaatattaccgtcagtatttcgcgcagtggacggcaagcaaggtgctttatgatatcagggacaagctttttgcgcatatacaaaagctgagcctcaggtattatgcgaacacccgcgcaggagaaattatttcaagggtcatcaatgatgtcgagcagacgaaggaattcgtcatcatcggattgatgaatgtatggcttgacgtgatgacgatttttatcgccatcgccattatgatgacgatggacgtgaagctgacgcttatttcgatcgtgctgtttccgctttacggactgtctgttaaattcttctacggcaggctcagaaagctgacgagagaacgttcccaagcgctggccgaagtgcagggccatcttcatgaaagggttcagggaatgcctgtcatcaggagttttgcgatcgaggattatgaacaaaagcaatttgatcacgagaacgggaattttctcggtaaagcaatccgccatacggcctggaatgccaaaacctttgccgtcgtcaatacggttacagacctcgctccgctgatcatcattacggttgcaggttatcatgtgattcacgggaaccttactgtaggaacgatggtggcgtttttcggatatatcgaacgcctctacaacccgctgcgccgcctgatcaattcctcgacaacattgacgcagtcgatcgcatcaatggacaggctgtttgaatttattgatgaaccgtatgatttaaaagataagcccaatgctgtaaaagcagagcgattaaaagggattgttgaatttaaaaacgtttcctttcaatacgaaaaatcggaggaaatgattttgcaggatctttctttgaaagccgaacggggcgaaacggttgcgctcgtcgggatgagcggaggcggcaaatcgacgcttgtcagcctcattccgagattctacgatgtctcagccggaagcctggagatcgacggcatcgatgtgcgcgattatgaggcgcgaagccttagaaaccaaatcggcatggttctccaggatacgtttttattcagcgaatcggtacgcgaaaacatatcgatcgggaatcccgaagcttcgatggaagacatcattgaagcggcaaaagctgcgaatgcccatgattttattatggagctgccgcaaggctatgatacaaaggtcggagaaaggggagtcaagctgtccggaggccaaaaacagcggatatcaatcgccagggtgttcctgaagaacccgccgctcttaattttggatgaagcgacgtcagcgcttgaccttgaaagcgagcactatatccaggaagcgatggaaaagctcgcgaaagaccggacgacctttatcgttgctcacagactgtcgacgattacccacgctgacaaaatcgttgtcatcgaaaacggacgtgtcgcggaaatcggcacacatgacgaactaatgagccgcgacgggcactataagcatttattcaccattcaaaaattaaactaaaaccgcaaaaagcctgactttcgtttgaagctgaacggatgtcaggctttttctttccccgcaaatttcgtacatatttcctatctcgtttaaatacaatttaaaaaatacaagctccggaggtgtataagtgacaaaagaaaaattgcttgaagtatcggatttatcgatttcgtttcaaaagaaaaagtccgaaaccccgattgtgcaaggcgtttctttcgatctccatcccggagaaatcatgggagtcgtcggagagtccggctgcggcaaaagcgtcacctctttggctttaatggggctgaacgcaaacacccggacgacgggccggatcaagtttcaaaacaaagaccttctcatgcagtctgaaaaagaatggagacagatgcgcggcaatgacatcgcgatggtttttcaagagccgatgacctccctcaatcccctttttacaattggcgatcaactaacagaagcactctccagccataccaatattcataaaaaagaagcaagaagaaaagccgttcaaatgctggataccgtcggcctgccgaggacggaccagctgatgaagcaatatccccacgaactgtcgggaggcatgaggcagcgggtcatgatcgcaatggcattaatttgcgaaccgaaactgctgattgccgatgaaccgacaacagctctcgacgtcaccatccaggctcagattctgtcccttttgaaaaaaatgaatgccgaatttaacacagccattctccttattacccatgaccttggcgtcgttcacaatacatgtgaacgcgtgatgatcatgtatgccgggcggatcgttgaagaaggcggtgtcaccgctgtttttgacagcccgaaacacccctatacaaaaggcttgttcgcctctattccggcattcacaggcaaatccgagcgtctgtcttcgattgaggggcaggtgccgaaaccggggtcgataaaaaaaggctgtatgtttgcgccgaggtgccctcataaacgcgaacgctgcgtagaggaggagcctggattgaacaggctggcggatgaccatgctgtaagctgctttctctacgaagaggaaggtgctttcacatgaatcatgaactgctgaacgtccaagagctgaaaacgtattaccgcgtgtcccgcaagaaaatcgtcaaagcggtcgatgatgttacactgtcagtcaaaaaaggcgaaatcgtagggatcgtcggggaatccggctgcggaaaatcaaccttgggaaaatcgatactgcggctgaccgaaccgacttctggaaaggtgacgtttctcgggcgggagatgaccggccttgatgcaaaacagcttcgcaacatgagaaggcatatacaaatgatttttcaagatccgtacgcttcattgaatccgcgcatgaaaataaaagatattttggaggaaccgctgatcgttcataaactcggaacgaaggcggaaaggagagaagtcgttcgctcgatgcttgaaattgtcggtcttgatgcttcatacggcgaccgatatgcacaccaattcagcggcggccagaggcaaaggatcggtattgcaaaagcgctgatcacaaagccgaaattaatcattgccgatgagcctgtttccgcgcttgatgtatccgttcaggcgcagatcttaaatctgctgtctgatctgcaggaggcattcaatttaacgtttctgtttatttcgcatgatctcggggtcgtccgctatatcagcgacagggtagccgtgatgtatttcggaaagattgtcgagatggcggacgccgactctttatttagagaaccgaaacacccctatacagaaacactgttagcggcagtacccgtcatcggcaaaggagaggcggttcatacggcgccggatattgccgcgccccgcatgagtgaaaagggctgtcctttttacagccgatgcatgaagcgggcggacgtctgccttgaagcggagccgcttcttgaagagactgcggacgggcattatgctgcatgccattttaccaataaggaggctgtacgatgaaaaagaaaagctggctgatctgtttgggaatgattctgtctgtttccgcttttttaatgggatgctccggtaacgaaagcggaaagaacgacggagggacgaacggcggaaaagatacgctgatcatcggcagaggaggtgattcgacatcgcttgatccgatcacaacgacagaaggcgaagcgtttaaagtgacgatcaatatgtttgagaccttgctgaattacggggaacaagacacaacgctgaaggaaggcctcgcggtgaaatgggacgcttcagatgacggtttgacctacacattggagctgagaaaaggcgtgaaattccatgatggaacggattttaatgcagaagccgtcaaatacaattttgagcggtggatgaacggggatgaagaaaaatttccttactacggcatgttcggaggctataagaaagatgaggggcacgtcatcaaagacataaaagttctcgacgaccataagattcagttcattttaaaacgcccgcaagcgccgtttttaaagaaccttgccatgacttctttcgggattgcaagtcctgccgccattgaaaaatacggcgaaaaattcagggagcaccccgtcggcactggcccttacaaatttgtcgaatggaagccgaacgaccggatcgtccttgagaaaaatgaagactattgggatcaaggcaaaccgaaattgcagaagatcattttcagagccattcctgaaaactcagcccgcttaaatgcattgaagacgggcgaaatcgacctaatggatggcgtcaatccgtctgatatcgaaagcatcaaagcagacgccaatctgaaaatatttgaaaggccttcaatgaacgtcgggtatctcggaatgacaacgacgagaaagccatttgacaataagctggtccgccaggcgctgaaccatgctgtcgataaacaggcgattatcgactccttctacggaggtctcgctgaatctgcaaaaaacccgcttcctccgtcgctcgaagggtacaacgaccaggttaaggaatatccgtatgatttaaaaaaggcaaaagaactcttaaaagaagccggctacccggacgggtttaaaatgaagctttgggcaatgccggtaccgcggccgtatatgccggacggtatgaaaatagccgaagtgattcaatcaagctttgaaaaaatcggagtcaaagcggaaatcgtcacttacgactgggcgacgtacttggataaggtgagcaaaggggaagctgatgcgtttttaatgggctggaccggcgacaacggagatccggacaacttcatttatacgctgcttgataaagataatatcggcggtaacaactatacgtacttcagcaatgatgagcttcatgacatcttaatcgaggcgcagtcagaccctgatcaaaagaaaagaaataaactgtatcaagatgcgcaggagctcctccatgaagaatcgccttgggttccgcttgtccattccacgccgattttggccggttcaaaagatatcgacggatatgttccgcacccgacagggagtgaagtattgtccggcgtagagtttaaataggtggtgacagccattgcttgcgtactgtttaaaacggacggccatgctgatccccgttctcatcggcatgacattggtcgttttttcgatcatccgctttattcccggcaaccccgcccaggttattctcggccagagggcgacaaaggaagcggtgcagcagctgaccgtccagctcggccttgatcagccgtggtatatgcaatatgccagatatataggggatttgctgaaaggggatctcgggacatcaatccgcacgggagcggcgattacgcaagaaataaagccatatttgttcgccactctcgaacttgcctttttcgcgatgctgatcgcagtgtttgtcggcgtgaatgccggaatcatcagcgcgtggtttaagaactcggtattcgactatatcgcgatgctggtggctttaatcggcgtgtcgatgccgattttttggctcggtttgatgggccagtggtttttttcgatcgagctcggctggctgccgacaacaggaagggagaatgtcagaaatccggtcgaagccattacgtacattcatacattggacacccttttgcacggaagatttgatcagtttgcagaagccatccgccatttaattctgccgggaacggctcttgccaccattcccgcagcgatcattgcgagaattacgagagccagcatgatagaggtgctgcagtccgattatatccgcacggcaaaagcaaaaggcgtgcatatgtttttcgtcatctataagcacggtttaaaaaatgcattcattccggtattgaccgtcatcggcctgcaaaccggactgttactgggcggcgcaattttaacagagactatttttgcctggcccggcatcggccggtacatttatgatgcgatcagctaccgcgactacccggttatccaatcgggcatcctcgtgatcgccttcatcttcgtcatgattaacttcatcgttgatctgctgtacgccgtcatcgatccgagaattaaatattaggaggcgggaaacatggttgtgcttcaaaatgaacagcagagggaggacgtgaaggtgcgttcgcctttggcggaacatattcggcggttttttgagcataaattggctgccgccggcacgattctagtcgcgctgtttatcctgctagccatcttcgcgccgctcatcgcaccatacggaataaacgaccagtcactgtcagacaggctcgccgctccgtctgcggaacacctttttggcacggatgactttggcagggatattttctctagggtgctttacggcgcaaggctgtctttatgggtcggctttttctcctgtttggcatcggccttggcggggacgctgctagggctgatcgccggtttttacggcagatgggctgatgcattgatttcacggctgtttgatatcatgctcgcgtttccgagcattctgctggcgatcgccattgtagcgattctggggccttctcttgaaaatgccctgattgccatcgccatcatcaacgttccgacgtttggcaggctcgttcgttcaaaagtgctcagcatcaggcaggaggagtatatcttatcagcgcgtgctgtcgggatgtccaatataaggctgatgtttaaacacattctccccaacagcatggccccggttatcgttcaagcgacgctgaatattggaaccgcgattatagaagcggccgcgctcggatttttagggttgggggcgcaggcgccgaaccccgagtggggaaaaatgcttgcggatgccaggccttacttggcgcaggctccatggacattgttttttccgggatttgcgatcatgctgaccgttctcggctttaatctgatgggagacggcctgcgcgacacccttgatccgaaaatgaaggaaggaaaataaaaaaccggttaacatattcgttaaccggtttattcttcctcaacttcaagctcgctgtcttttttgtggtacgtctgaaagcttgagagcaaggtttccaaatgctcaagctgttctcggtattctacagtgctcgccataatggtcagcatattgtagtccaacagttcttcttttaatttgtcctggtttttcaggaatgattcggtcaagtgctgtttgtacacgtctccttcttcgtgcaggtcgacgtgatcctgcgttttgatcctgccgacgaatctcattaaaattcgttcgtgccaatggaggagataatcgagctcttcgaccagcgtttcttgaaattcttcaggcatgtgataaaactcgttttcaagccggtgcagctttttcagggcatcaagcgcacggttggatgcaatgatcgcctgtctgaacagcacgagctttcgctgttttacatatgtggaacgttttaaatagcttctttcttctttgtagagcaagtaaaggtggtcaaccttcatcattttttctttcagtttttcaatgtcttctttcagcatggaatgttccgttgtcttccgcgtcaacaatctgatccatttaatgacttcatctgtattttcaacaatatggctgacgagcttcgtttcatatttaggcggcagaaaaatcaggttgaccaagaacgcagacaacacgcccaaaataaccgttccggttctcaccaaagcaaaccataaaaagttgtcgccggagctctccagtatggcaataacggtgacaagagcgatcgaaatcgtgttctcgatcttcagcttcaagttgatcgtaatgacgattaccgccgtcaatccgatgatgatcggactgggttcaaaaataagtccaaaaataatggctgtggctgctccgataatgttcgcctgcacttgatcgacaatcgtcaaaaatgaacgatagatcgaaggctggatcgcgaagatagccgcgattcccgcgaagacaggagtcggaaggccgagccaagacgcgaggtaaagcgcaagcgtaatggcaatgcctgttttgaaaatacgggcaccaagtttcattaggctgtacttgcatccctttctataataaaattcgttctttacagaaaatgaattgtagtgaacattccctctctgttaatttgccaaacaataaagtaatatacagcgatcttccgaaatattcaacccatttttaagaaaaaacaaatcattgacaaaaaagaaagacaagccggcggaaagtgcctgttcaccgcgctttcaaagtgctccgcatttgataaaaaagagagcggatccgctctctttttacatgcgctgtttcaattgtttaaatgagtcatccacggctttgagcgtatctttaatgtcctcttccgtgtgcgcggtggtgataaaccatgcttcatattttgaaggcgcaagattgattccgcgctcaagcatcagtttgaaaaaggccgcgaacatgtctccgtccgtattttcggcttgctcatagttttcgactttttcgttcgtgaagtatacggtgagcgcgccttttagacggttgacagtgatgtcgatgccgtgggtctcggcatgtgccaggatgccttcttcaagcatggcgccgaggcggtcaagtttttcgtatgtgcctttttctttcagcacttcaaggcaggcgatgccagagaggatggaagccggattccccgccatcgtgcccgcttgataagcaggtccgagcggtgcgacttgttccataatctcttttctgcctccgtaggcgccgatcggcaggccgccgccgatgattttgccgagcgccgtcaaatcaggtttgacgccaagaagatcctgggcgccgccgtacataaagcggaaagcggtaatgacttcatcgtagatgaccagggctcccgcgttatgcgtaagttcattgacctgctcgaggaatccgctcttcggttcgacgatcccgaagtttccgacaatcggttcaacgaggactgccgcaatatcgttcccccatttatcgagcgcttctttatagctgtcgatatcattgaaaggaacggtaatcacctcgttggcgatgctttttggaaccccggcggaatcaggcgtgccgagcgttgacggtcctgaaccggccgccaccagcacaagatcggaatggccgtggtagcagccggcgaacttgatgattttcgttctgcctgtataggcccgggcgacgcgaatcgtcgtcatcacagcttccgttcccgaattgacgaatctcactttatccaaggcaggaatcgcttccttaagcatcttggcaaatgtcacttcatgctttgtcggcgtaccgtaaagcaccccgttctcagcagctgtttgaatcgctttcgtgatatgcgggtgggcgtggcccgtaataatcggtccgtacgcggcaaggtagtctatgtatttgttgccgtccacatcccaaaaataagcgccgcttcccctttccatcgcgacgggagaacctccgccgaccgctttgtaagaccttgaggggctgttgacgcctccgactatatgttgaagagcttcttcatgaagcttttcagattgagtatgctgcataatatcctcctcatttttgcacctttatctatttctatattttctatattgtaacacgaggcggacagagcgcaaaaaagaagccgccgaacatttgaacaagagggcgctgttttttataatgggggaaagcaagcgattaaacataacaggaggcaaaacaatgactgttgaaattggacaaaaggtgcctgatattgaactgctgggcgatcacggagaaaaagtaaagctgtcggattttgaaggaaagtatgtcgtgctctatttttacccgaaagatatgacgccgggatgcacaacggaagcgtgcgatttcagagaccgtcatgaaagctttgcggaacttgatgccgtcattatcggagtcagccccgacgatcaggcaaggcatgaaaaattcaagcaaaaacacgatctgccgtttctgctgctcgtcgatgatgaacacaagctcgctgaaagctttgacgtatggaagctgaagaagaatttcggcaaggaatacatgggtgtcgaacggtcgacattcctgattgataaagaaggccgccttgtgaaagagtggcggaaagtaaaggtaaaagaccatgtcgcagaagcgcttcaagcagtaaaagaaatcgcggaagcataaagctcgctggggaggccggactgtattttagtttggtctcttttttacgctcatattcgcctgtctgatcggccatgctgatcatagcggccattttttcgccttaaaaaatagctttttcacagggattggaattgacaaagattctgatcaggagttacactaattataaacgttataatgtaagaattttttttagaagagaggtgcatgacgatggctgaacataacctgaaagaagcgttggaagcgttgaaggaaaccggggtgcgaattactcctcaacgtcatgccattctggaatttctcgtgaattctatgtctcatccaactgcagatgatatatataaagctctcgaagggaaatttccaaacatgagcgtagcaacggtctacaacaatttgcgggtttttaaggaatcagggctcgttaaggaattaacgtacggagattcctccagccggtttgacttcgtgacttccgagcattatcacgcaatttgcgaacgctgcgggaaaatcgtcgactttcattatcccggcctcgacgaagtggagcagcttgcttcacatgtgacaggatttaaagtcagtcaccatagactggagatatacggtttatgtcaggaatgcgacaaaaaagaaagccattaaaaagagctggccgcttttttaacggtcagcttatttttgttgcagcatttactgagactttcgattatacgattcgttaaactcttttctttcgaggtttttgtccaatgtcaaaggctccctgcaatgcatgcacatatcaacccggcctaaaatcttgggtcggtttttcacagtttggacagacgacttgaaccgctttcgttgaaagcatgccgatccaaaaataaaccgctgtgctcaacaagatagacaatacccccaagatcataaacaccgacatcaagaggaccgaggacctaaaaaagaccccgacatacataataatgaagcctataaatacaaggctcaacgcaaacgttctgattttgttgattttactagagtatttggccatatccatccccctgtctctaatatagcatatcaaagatgtgttattccttaattaaaacgaatcaattggaaaatttcttaatagagagttttggggaaattgattataataattcaatgtgtttccaaaataaaggagtttttattggctcgtagaaataggtagaaacaagagagaagcttttatgcaacgtatttacatcgtattggaggaatggtgatggaaaatcttctccgtccgatttaccaagaaagagcaagccgccctgacacactcgctgtcatgctgattgagaggagaaatcaaacttcatctgcaacagataattttgatgcggcattgttgattatcgttaataaggctgaagaccctgtattcgtgaagcattatgagttcgacggaaaaacggcttctcttcatattatttctgttgaacagcttcaggaatggattctgcttggaacaaacaggagaatcatagactgggttctcaatggaaaggtgcttttcgaccgaaacgaatttatcgccaagctgattgagcagctcaatacatttccgttttcagaaagaaaactaaaaatcggacttgaatacgggaaattaatcagaagatatatagaaggaaaatcgttttttgaggacggtcaatttttggatgcctacaattccatcgtacacgccctccaccatttggccagaatcgaagtgatcgataaggggtttcaccctgaagttacggtatggaaccaagtccgccacatggaacctcaggtttataaattgtataaggaattaattgaaagcaatgaaagcttgcaaaaacggctggagttattattcctcgcaagcgattttctcattcattcaaaagccgaaataggggctgcctatattctcaatgtcatggatgaaaaatcggtttggcaatttgccgaacttcttaaacatccggatctcaagtatttcacgacagacctgggagttatactggagttcttggctgaaaaggatttagtcggagtaaagccgatagagacaaagggccaaaagatttttcaccgaggatattttattaaaaaaagtgttgacactaatttataacggtgatatattattaagcgtcgctgttagcggaacggtttttgaacagaaagcagcagcgacgaaaaatcaaaaaaacatttgacacttctcgttgaaaatgttatactaataaagtcgcttcggacagaagcggaaatgatctttgaaaactaaacaagacaaaacgtacctgttaattcattaaataaatcgtacatgcgaatgtgcgtagtcaggggcctgcacgatgcaggtcatgcagatgttgtcacaggatgtgacgaacttaatctgcgctccattacttcatggagagtttgatcctggctcaggacgaacgctggcggcgtgcctaatacatgcaagtcgagcggaccgacgggagcttgctcccttaggtcagcggcggacgggtgagtaacacgtgggtaacctgcctgtaagactgggataactccgggaaaccggggctaataccggatgcttgattgaaccgcatggttccaatcataaaaggtggcttttagctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggcaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctcctttctaaggatattatacggaatataagaccttgcggtcttatagacaggtgcgtttggatcttgtttagttttgaaggatcattccttcaaagcgtgttctttgaaaactagataacgaaagtagacattcacattcaattgtaatgcaagatatcacgtagtgattctttttaacggttaagttagaaagggcgcacggtggatgccttggcactaggagccgatgaaggacgggacgaacaccgatatgcttcggggagctgtaagcaagctttgatccggagatttccgaatggggaaacccactgctcgtaatggagcagtatccatatctgaattcataggatatgagaaggcagacccggggaactgaaacatctaagtacccggaggaagagaaagcaaatgcgattccctgagtagcggcgagcgaaacgggaacagcccaaaccaagaggcttgcctcttggggttgtaggacactctgtacggagttgcaaaagaacgaggtagatgaagaggtctggaaaggcccgccataggaggtaacagccctgtagtcaaaacttcgttctctcctgagtggatcctgagtacggcggaacacgtgaaattccgtcggaatccgggaggaccatctcccaaggctaaatactccctagtgaccgatagtgaaccagtaccgtgagggaaaggtgaaaagcaccccggaaggggagtgaaagagatcctgaaaccgtgtgcctacaagtagtcagagcccgttaacgggtgatggcgtgccttttgtagaatgaaccggcgagttacgatcccgtgcaaggttaagtttgaaaagacggagccgcagcgaaagcgagtctgaatagggcgcatgagtacgtggtcgtagacccgaaaccaggtgatctacccatgtccagggtgaagttcaggtaacactgaatggaggcccgaacccacgcacgttgaaaagtgcggggatgaggtgtgggtaggggtgaaatgccaatcgaacctggagatagctggttctctccgaaatagctttagggctagcctcaaggtaagagtcttggaggtagagcactgattggactaggggcccctaccgggttaccgaattcagtcaaactccgaatgccaaagacttatccttgggagtcagactgcgagtgataagatccgtagtcgaaagggaaacagcccagaccgccagctaaggtcccaaagtatacgttaagtggaaaaggatgtggagttgcttagacaaccaggatgttggcttagaagcagccaccatttaaagagtgcgtaatagctcactggtcgagtgactctgcgccgaaaatgtaccggggctaaacgtatcaccgaagctgcggactgttcttgcgaacagtggtaggagagcgttctaagggctgtgaagcgagaccggaaggactcgtggagcgcttagaagtgagaatgccggtatgagtagcgaaagaggggtgagaatcccctccaccgaatgcctaaggtttcctgaggaaggctcgtccgctcagggttagtcgggacctaagccgaggccgaaaggcgtaggcgatggacaacaggttgatattcctgtaccacctcctcaccatttgagcaatggggggacgcaggaggatagggcaagcgcggtattggatatccgcgtccaagcagttaggctgggaaataggcaaatccgtttcccgtaaggctgagctgtgatggcgagcgaaatatagtagcgaagttcctgattccacactgccaagaaaagcctctagcgaggtgagaggtgcccgtaccgcaaaccgacacaggtaggcgaggagagaatcctaaggtgatcgagagaactctcgttaaggaactcggcaaaatgaccccgtaacttcgggagaaggggtgctctgttagggtgcaagcccgagagagccgcagtgaataggcccaggcgactgtttagcaaaaacacaggtctctgcgaagccgtaaggcgaagtataggggctgacgcctgcccggtgctggaaggttaagaggagcgcttagcgtaagcgaaggtgcgaattgaagccccagtaaacggcggccgtaactataacggtcctaaggtagcgaaattccttgtcgggtaagttccgacccgcacgaaaggcgcaacgatctgggcactgtctcaacgagagactcggtgaaattatagtacctgtgaagatgcaggttacccgcgacaggacggaaagaccccgtggagctttactgcagcctgatattgaatgttggtacagcttgtacaggataggtaggagccttggaaaccggagcgccagcttcggtggaggcatcggtgggatactaccctggctgtattgaccttctaacccgctgcccttatcgggcagggagacagtgtcaggtgggcagtttgactggggcggtcgcctcctaaaaggtaacggaggcgcccaaaggttccctcagaatggttggaaatcattcgcagagtgtaaaggcacaagggagcttgactgcgagacctacaagtcgagcagggacgaaagtcgggcttagtgatccggtggttccgcatggaagggccatcgctcaacggataaaagctaccccggggataacaggcttatctcccccaagagtccacatcgacggggaggtttggcacctcgatgtcggctcatcgcatcctggggctgtagtcggtcccaagggttgggctgttcgcccattaaagcggtacgcgagctgggttcagaacgtcgtgagacagttcggtccctatccgtcgcgggcgcaggaaatttgagaggagctgtccttagtacgagaggaccgggatggacgcaccgctggtgtaccagttgttctgccaagggcatcgctgggtagctatgtgcggacgggataagtgctgaaagcatctaagcatgaagcccccctcaagatgagatttcccattcctataaggaagtaagatccctgaaagatgatcaggttgataggtctgaggtggaagtgtggcgacacatggagctgacagatactaatcgatcgaggacttaacctaataaaataagtgaacgctggctaaatacgccacatcgtgtggcaacgcctgcatgacccacatcctgtgggcctcgtctgcccgttatctagttttgagagaataatttctcaaaaaatgcacttgcattttttcaaatacatagtataatgatctttgtcactaaattgtctggtgatgatggcgaagaggtcacacccgttcccatgccgaacacggaagttaagctcttcagcgccgatggtagttgggggcttccccctgcgagagtaggacatcgccaggcaggcattattccgcagtagctcagtggtagagctatcggctgttaaccgatcggtcgcaggttcgaatcctgcctgcggagccatttattggagagctgtccgagtggtcgaaggagcacgattggaaatcgtgtaggcggccaacgccgtctcaagggttcgaatcccttgctctccgccactttaaatacatctggcccgttggtcaagtggttaagacaccgccctttcacggcggtaacacgggttcgaatcccgtacgggtcaccattcttttttggacagcacgctgaaaagtatcaggtttacaccaaagctttttaaaggaaggcatgctaagatcgcaacgtcctgctgcaacgcatgcacttgtaggtcctgtacttcggaggattagctcagctgggagagcatctgccttacaagcagagggtcggcggttcgatcccgtcatcctccaccatttctatgaaaatcatattatcgcggggtggagcagttcggtagctcgtcgggctcataacccgaaggtcgcaggttcaaatcctgcccccgcaaccaaattactcattaatggtccggtagttcagttggttagaatgcctgcctgtcacgcaggaggtcgcgggttcgagtcccgtccggaccgccatttaaatagaggctcggtagctcagttggtagagcaacggactgaaaatccgtgtgtcggcggttcgattccgtcccgagccaccatttgccggtctagctcaattggtagagcaactgacttgtaatcagtaggttgggggttcaagtcctctggccggcactgttttggaggggtagcgaagtggctaaacgcggcggactgtaaatccgctccctcagggttcggcggttcgaatccgtccccctccaccatgtttttaggggcatagtttaacggtagaacagaggtctccaaaacctccggtgtgggttcgattcctactgcccctgccaattttaattcacaatttatggcggttgtggcgaagtggttaacgcaccagattgtggctctggcactcgtgggttcgattcccatcaatcgcccttaatattgggctatagccaagcggtaaggcaacggactttgactccgtcatgcgctggttcgaatccagctagcccagttttcatctttctttatcatcctgcatatgataagatgaatattagttaaaatgcggaagtagttcagtggtagaacaccaccttgccaaggtgggggtcgcgggttcgaatcccgtcttccgctccaattcttaaatgatggcggcatagccaagtggtaaggcagaggtctgcaaaacctttatccccggttcgaatccgggtgtcgccttatttcccgtgccggggtggtggaattggcagacacacaggacttaaaatcctgcggtaggtgactaccgtgccggttcaagtccggccctcggcaccattgatcacacacatgccggtgtggcggaattggcagacgcgcacgactcaaaatcgtgttccttcgggagtgtcggttcgaccccgaccaccggtatcactaaacatcgtattgccaaacgatgaaagagcgttcctacaaaaggagcgctctttttatttattccttatcttggaacgaagccgtaagaattttttcttaaggactgcgagctccggaagctacgggaacataccgtgagatttatcgaaatgagcttaatacggtgcagaaacttttacaaaagcaaaaatatatctgatgatttattatctatttatagggcgaaaagtaaattattgatacaaacttctttgcaaagattggtaactttctgtaaaatgttctcatagcgatagaggcagtaaagtgtgggaggtttgacaatgaaagcagcagcctctgtgaacgtagccaatctcatcaatcagtggtatgttcacataaaaaagagagatgtttcaaatgccgtagaacttagggacagaataaaaggccttttaaacgtaatggaagaagatcaggatgttttgctttactttaatctacttgattacaggttcagagtattaatggaagacgtcgcgggggagccgcagcttccgcctattgctgaagataaggcgaagacagacggtttgttacgatactattactttctctttaaaggaatgtatgaaagtgcgaggagcaactactctaaagcgcttaattgttttagagttgccgagcggcagctcgataatgtcgaagatgaaatcgaaaaggccgagtttcattataagcttggaaatctctattattttacgaaaacaactctactttcttttcatcatctttcaatcgcgaagagcatttatagggcttatgaagaatataagacacagtcgataaactgtacggtgctgctcgcactcaattatatagacgacggacgtttaacaagagctgaaaatatgcttaagagttgcgcagaaagactgatcaagatgggcgataatcatctgctggcggctgtctactatgatctcggctttttaaaaattcaagaggataaacatgaagaagcactcgagtatttcgacctctcatttaaaacggatgatatcgaaaaaaatgcgcctattatgtacatgcagtgcatatacgagtcagctaggtcaacttataagataggtgaggttgataaggcgcttaagtgggttcatcttggttttgagtttgctcagaaaacggataatatcaacttttcgctcaaattctcgattctaaatatatgctatagcgctcccatcgagggtgtaccgcaagtaaaagagtttatcgaaatgctcgaggagagagaggcttacgtagacattgaggcgcttgctgaggatgtggccaacgtctacagctcattaaataattacaaatattccacataattcttggaaaaagcaataaaattaagtaaactaacaggaaaggaggttctttaaatgaaaaaacttattgtaactgctttccttactgcatcgcttggactcgttttaaccagcgcagcagacttcctcgcagaaagtatccaaacagcagactcagtaacattacttgcctcaagaggagcgggctcataaaacaaaaatacaacagtaagagggcggctattacagccgtcttttttatgatttcagttttcttggtaacttgaatgctatactatagttatatctaaaatgcgaagttaacgctatgctagaccgtaatggcttattatatcgaatataccgcgggctagggctttccgatagaatcggcacgactcaaattcgtgttccttcgagagtgtcggttgaccccgaccaccggaatccttagctctttttaaagaattggatagaaaacgttatgatttgaaatggttttgcacattctttacacatacacatcctcaacttcttcaggcttttcaacttcctcaacagcctatcttcaaaaatgtttactgtctcagtttcatctctttcccgaagctctttaattaagtgagcatatgtatttgacgtggtttctatatcagcatgtcctaatttcacttacataataaattgacacctttctataaagctgcacgcttgtgagtgtgccttaatccatgaattgtagtcggttgaaatactcaatttcgctagtacgccattctatattcgggattcaaacggtgaaattggtatcgcgcgccggcaatgtacaagtgaatataaaatacagcctgtaaacagggaaattcgcttgttgcttggctacaagctaaggcagctcataaaagaagtagtacatctttgtaaagggatcagcactgacgagactcaaagagttaagccgagtcgggaatgctggcagatagctgagcatccactggttgatgtggctttcatagatcgatcgcgctacatcacttatgttgaacgcgaggggtttataacacatgcaaaatctaattgtatcggctgtcctttccatgttttcaatacatggcaaaatatgaatataaaagatccagtttcatggaatgacgcggtggaaatagattgactcatcaggcggctcccgcactttaaaaataatgcttttcttcataagtccgggaagacggtggaggaagttgatttcaacgagaattagctcaacattgatcactttttgaatgaatttgaggggatgttggtgttgatcgaatacagctgacgtgagtaaaaaggcctgctgttccaactatgggtgcagcaaggggcattgaggaggatatcatatcttgataaaattagtaggataaagaaaaagaaggtgttaataagtgaatcttttggaaatctttaatgaattattgagttcttttggagttccgaccgttgttatttttttattttatttataataacagcttttagagtattccagccgatactttgttttcttcagttgtttttgaacaaaagcttttttcaaaggaaagaatgttcattgtcagagcatgtatgtatgtggtttatacgtttgcttggatggtcatttttgtatctttaggtgagacattaaaaaaaagtttaatttggattataacgaaaatttgtctgtacggctgaaatattaattgcagtaaacgtctttgttcttttaactttgaatctagtaaaaaaaccagagcatactttatttaaaataaagtctaatagatacttcaaatttttcatgacttgttcatatttgatttttttattcattttttatactgagatatatttgttgctttctttttctcagtttaatgatgttaaatctttaactgttgggatagtaatgtattttattgcttgtgctcagttcctatcttttcaacaattgtattaaatacggttgactagtcaactaagaaaaatgtattcatagaggatgaaaataatcaagtttggtatatattgcatccaatcaataaggaagtcattttattgggaaacgaatctgagcctacgctgtgtaatgaaattagaggaactatataaagtacccattaagattgagaaaattaataattaagtccaagatggaatgcctgcggacactgaacttacagcttttacgctgtttgtttggtgtccgttttttatttgtcatgcatgtggttttagtgaaaggagaagaagacatgaaacccaataaaagaaaaccaccttgaaaaaacgcaggagcactctgagcgcttttggcgagagattacggacaaaaacaagcaaattcttaaaagaggcaaaggcggcgcttaattacagagtggttcttctgcaagtaccagatgatcttctgccgaaagtcacggcgggctttaaccatttcctcgcgctgcaagctcgtgattcctaaaaaggatgacgacaagccgaaatcaaaagaggaagagcggttcgggggccggatgtaatgcaagaggtcacctctgaaattctgattgagcgttatgggcttagcgaaaaaatactttccggtgagataaaggcttgtcaaaagcataaatgggctgtgcagcgattttttaaagatgtcgaggtgttagcggacccggattgcccctattattttgatgctgaagcggtgctggatttttacgaatgggcgcggcaggttcagacatgttgaggggatgcatcgggtatttattgccggatgctcacgggagcagacagacgaattttaccaggcaatttttgaacaggtattgcgaaatatctcggcctttgtggtggatcaagcaaccggcaacatcggccccgaaaaagaaagcacgaaaaagcaggagcaaaaaagtacccattccgcccggaatttacaaaagcctaattatgaagggaacggccgtccgacagattcaggaggctttagctgccctctatttctatccggacaaaggcgctaaaaataacggcattgatgtctattacggaacgaagacaaaggcgcagctcgagtcgctattggtttaatacaaaaaggccctctttcaagagggcctagattttataaattccaacgtgtcaattgttattcatcactgtctaattcccatattgtgttaccgtctactaagatcttattcggtgtatcttcataaagagaaatttcaactagggagtttttctcttccaatagccaattatatagactatcttcttcattattaacgggaggagataaaaccttatttacttgaaaagccgttgcgtaatattctttataattgatatcatcatcctccagaccgttgtctgtttcgaaaaatgtatcagttttaccaattactcttaatccattttcccattctaatataagttctctatctttgtattttaataatgttttgaataaagaatcaggttccatgtatatcctcttttcctatatttatttaagacggttgtgaaggtactatatgagcgccgttttttccataatgtatcatgcctcttgtagtctcttcatatttacgggtctctgtattatagtattttcctattacttgaccaaaatccactctttctttgtttcctttttttaacatatctcctgtgccagcatatttatcaagcaactcttgcgcttttttattatccccgtagaagatactcttggttctgccatttgcaacttcttgtttataatttggtgttcctggaatatgtttttcttgagctcctggtttaacttttgcagggaaaccatttacttcacggtacggaccttttggtacggattgtttgccataggaaggtgttttatctaccttcgcaactttctttcccgcctcttcacctttaaataacttaaatccttttttcccgtactttagcaaccgaccaacaggtgttaaagaagttccggacgcagcacgctcgacattagagactttttcacctgtgtccggatctctgcctgttatgacccgaaccgcatcattaccgcccgctatttcttttgcaacaaaatcccctatatcatttactggttctaaaggagttccttcaaaatctcgcttaagattcccttggcttcgactttttggaatacgtttaacagcttccatctctactttaccgtttacaatgtactctcttacgatttgaccattttcatatacatggtaacgcccaccgatatatttaatgtctgccggattttgaaccacttcatcggcgacatcaactgttttgacccttttccatcctttatgattatatagtttaccatcaatgacccgaatatctccataaaccttcggatatttttctgcttcgttttgcaacgcattcaaatcaaaatcgttcgcataaacgtcttgattgatattttctttattgtcttccctaatcaccgtatccacattagatcgtttatttttgttgagcttttcaagcatcatctccatcggagacggttcgacattctccagttggccctgaagtccgccaggtagtccgtttattgtagagttatcatccgactttaaaatcgcgcctttttgataactggtgatttctattttgggaccggtatacattttttcgagccttgcgatgtatctctgcatcgtctcaaggtcgttttcagccgtcttcagggcgttggtttgcccgcggtcaaacgcatggagcttttcaagagtcgtgctgatttcctttaacgctttctgattttgttcatgaaaaccgctgtcattcaaatccggtaaatcgacaatatggctgacttttgcgatcgtggcgttggttttagaaaccaaatgtttcgttgtgcgatcagcggcattcaagccattctccaactcatgcccgagaaaggactgtgaaataaatccgttatggtttggttccagggaattcagcgcgcttttcattttcttcagcgcggaactgtattcctctataaaagtatcatagaactgtagaaaaggggtgtggcattcctcgtaaaaggcgcggatcgcgtcgccgccttttccctttaaagcatcatcaagtgatgtgatgccctcaacagcctttttgactttggcgatttcgtctgattgttgttttaattgttccagcgtttgatctattgcattgtgcagcgcctgaacatcaagagtcttcatggcattctcctctaatccttttggttacaatcagtatagagtttaccactatacggaaaccaattggggaataaatcctgttcatccatgaaaatgaatcttattgatcaggtctataaacctaaatactattgtttttgagaataaaccgatcttgattttttagaagctttaatagcttaaaagatcttaattggttttcgaggatggaaaaccatgatataattaccagtaaagcatttttcaagatccaggaggtccgcccttgtttaatatatattgtgatgagagttgccatttagaaaaggataatagtgatgtaatggtattaggagaaatgaaagttgatgctcgttttcttcctgatatctataatcgcattcgtcaaattaaagttaatcatggtttaagctcttggtttgaagtaaagtggacaaaagtttcaatgagtaaaatagacttttatttagatttaattgattatttttttgatactgcagctttaagttttagaagtgttgtagctacaggaaaaaaagaagttagaccacaatacatataatgaaagtgattatgataattggtactataaaatgtattttcaattgttaaacccattcacgacgttaaccgtgtggcgaataaagtcaaacgattccagctgatgaacgatgttttctgatgggatttacggactaaaaatgaaggctaaattgaaccgttactgaagtaatgaaaaaggccctcttttcacagagagcctactttttaaacgaattcatactgacatatttaatcttgttgctgggggttatactgttttaaccattcttttgcatttccacatgcacttagtatatcgtgatggttaaaacttaataaataatcattgtttttattagtgacatagaattcgacattaaacatttcagataatatctttactacattattccccccatcaattttataggaagatttttcatctgaagggttaaacattagaattgcttcagaatctgcaatataatcggctatccattgccaagcatcttggttttgtacagaaaaatctttctctacaaactcccacaacggaaaatgctttttcccattcgcgtatttattagccaaattatgaaatatgatttctgtatcatttgttgataattcatttaccttaatgtcaactgacttagcggcagttaaaatttgttctttaagatcccacatactaactcctccaaaattatctgtttatagggactgagtctactaaaatatgacctctaattgctcctccgccacctcttttcccagcggtttgatatccagtgtgaggaacatccgggccgtttttggtatggccaacatctatattaacttccgccccatttttagatctccattcaacagggaatgattttccattttcgtcttttccccattttgtaactttaaattcttttttaggtactccagttcttttaaaggcttcatctaatgcatctttatatgtcttacctgttcctctaaaatccaagtctataccttttttaaacttgtatcctgttatacttcccagcttagtgtttttttctttggttgcaacgggagcggtcttcttaccaacatctccagctgttttagcccctttatccaccttcgaaacttttgctagcttatctcccttgcgaatccatttgacaatcctcaatggaggcgttaaattaacagcggcctcgaaccgttcaaagagagaaagctttttgtatgtatcaggatcatatcccaatgcagctcgttcaaagtcactttcacctaagagctccaagccaattcttgaatatttctctaaatcacttacttctttatcctctgcaggaggatcgtcaaccaactgtatgccgacgacatatttaccatctaaataataacagtatttatgaccattcacatatttataaaccttttttagtttttctaattctttttcactcaggttttctaattcttcgtcagtatacacttttttggacacttgtgtcgccaatttttttaatcgatctggatcggcgagagtgttaatgtccgcatcttctttgtctccgacttttttcaacatgacacccatcgctgtttcttgatttccactcaaggtatccatctcatccggctttaaaatcgaacctttttgatagccggttatttcaatttttggtccggtatacatcttttcgagccgcgccatgtatctctgcatcgtctcaagatcgttttcagccgttttgagggcgttggtttgcccgcggtcaaacgcatggagcttttcaagagtcgtgctgatttcctttaacgctttctgattttgttcatgaaaaccgctgtcattcaaatccggtaaatcgacaatatggctgacttttgcgatcgtggcgttggttttagaaaccaaatgtttcgttgtgcgatcagcggcattcaagccattctccaactcatgcccgagaaaggactgtgaaataaatccgttatggtttggttccagggaattcagcgcgcttttcattttcttcagcgcggaactgtattcctctataaaagtatcatagaactgtagaaaaggggtgtggcattcctcgtaaaaggcgcggatcgcgtcgccgccttttccctttaaagcatcatcaagtgatgtgatgccctcaacagcctttttgactttggcgatttcgtctgattgttgttttaattgttccagcgtttgatctattgcattgtgcagcgcctgaacatcaagagtcttcatggcattctcctctaatccttttcattacaatcagtatatagtttaccactttatagaaagtacttggtgaatatatcctgttcaaccatgaaaatgaatcattgggcttaggtcattatttctattgattcatttcgattaccgtaaacaagtttgttgtagcattctttaggctctgtgactaaaccaaaaagccatttgttttaaattggtctttcggtatcacgaaaatttcgttttttgggctgatagaagttttgcaattatgaattgtatgttaatctttaacataaaaaggatgttagctggaagggaatgatggcagttggagactatcccgtcttcagaagttggaatcaaaataaaccgctggtacaacgaaattcaaaaattaaacgtaatagaagcagaacgattaaaggcggaagttcacttagctatagaaagaatggaagaagatcaggacttgctttcctattatcagcttatgaattttagacatgagttaatgttggaatatcttttcccggcagaaaaaaagctgagcaaatctgattatcttagggaaattgagggacagggaagaaaattgtcaggcttgctcgaatactatttttcctttttcaccggaatgtatcatttttctcgcggaaaatacataaaggcaatcaaggcatatagagcagcagaaaaaaagttgacgaaagtttcagataaaatagaaaaggctgaattctattataagatggcggaagtgttttatcatatgaaacagactcatatgtcaatgtattatgtgtctctcgcttatgatatttataaatcctatgatgcatatgtgattcgaagaattaattgtctattcgttgttgctgggaattacattgatttatcaacccatgatcaagctttaccgcatcttttaagcgctaaggaatccgcggaagacattcaaaacaaggcgatcgttgcaaaggctcttttaaatgtagcatattgttataatgcaatggagagaccaacaaaagctattgaatactttcataaggcgattgatgtagcaaaggaaataaaggcaaaagaactgactcaggcttattatgatttggcattaattcactttcgaaataacgaaaatattgaaggacgaaaattttatgaaaaggcgcttgaaagtgcgcgggtatttgaagatgaattattcctgtgtctgttggatgttttagaggcactgtttataaaatcagctaataagtcagaggtactagaaacaatgaaaccattacgggatagtcgtggttacccctatcttgaggaactggcattagaagcagctctattctatactaggaatgagcggccaaatgattccatatttttttatgatcagatggtgcaggctcagaaacaaatcaaaaggggcgactttctgtatgaaatctaagctgtttctttcgctgacccttgctttgggcttgttggtcgtgtcgagcgcttccattcacacatctgttgaacaacaacatgcagaattttctgtagcatctaggctcgcaacataattgtgtttgggcaggtcatgtgatggcctgcctttttggtgaaagaattattttagtttgaaaaccagaacgattgtgttaatactcatctttcttcgtcccttgtgttggaattttcatcatatcaatatttgaatatgcggctgtccgcattattaacaattttaaattttttgcacaaattttatacaaaggcagacaaaaaccttgatatatcaatggttctatgggtatattcaaccacgaccaccgatatcgctaaaaaccgtattgccaaacgacgaaagagcgttccttacacaaggaatgctctttttgtttattcctcatcaaagcggagagccgccaacataaacgcaatgaccaactgttgtccgcattctcactcttcattcagcgcaccgtgaaatgatgcataccgttcaaacagttgtcccttcattgaagtccattcaatcaagatcacactcagtaagtcagtaagaatgaagcaccttgtcatcgacaaggtgcttttctttataccaatgatgtgttccgatcctccgaccgcctttttacgttttgtttacaagttgatcaaactttagcgacatctgcccgctatattgaatacagcatggcttcacctaaatataggaaaaggattaatttttttttgaggaggaatacagttgtcaattcgcattaaactgcctgacgggtccgtcagagaatttgaggaggaagcaagtattgaagatgttgctgcttccattagctgcggtctggaacatgcggttgcaggtaaattaaacggaaagcttgtagatttatcaactccgcttcaggacggtgcactcgttgaaattgtcacccgggactcagcagaaggacagaagatcgtgcgtgaaaaatcgcgggggaaagggcgtattgtggcacttgacgcagcacggggactggcggtcatcgggatgtatttgcagcacttcgccttgaacgaaacgaacggttcgatcgtttccgggaatacgacgcttctatttgtgctttgcggcggaatctcctattcgatcatggccgggcgcatgatggacagaggaatggagccggccgcatttcggacgcggatgcttgcccgcgcggtatttatcgatatgataggatatctgctcatcatgctgaatactccgttcggggtgattttgccggcttatgctgcactttttgtgctggcattggtgctgattcgccgttcgacgcgtgtgctcgttacaacagcagctgttttgcttgcggtgagcccgccgctgatgattctcggagggagcgtcctgtcgggagcaaacttgcttggcgatattgcaggcggcccgatgtcggcgctcgcacttgcacccgctttcgtcgccggtatggcaatcgggcgctttgatctgaccaggatgcgtacggcactttcgctagtaagcagcggcgcagtcatgcttatcgtctctaagttattgggcgttttcgttcttccttggctgagccgttccttcgaagaatggctcgtaagtgttcaaggcaccgccggcgccgagccggatcagtatgcaatctggccgcacaacgtggcaccgccgctttggcacaatcttctttcgatagctccgcacagtgcgtcaactttccagacgatgctggggcttggggctgcctttctggttctaggaatggtatgtctcgtgccgcagaagatttctgcagtgctaaagccgttcgcgggagtcggacgtgtagcgttgacgatgtatgcagctcagtttgttgtcatatgggctcttgaaatctcgggggccaagtatgatatcggggcaattccattcggtgatctgttcgtcgcggccgtggcgacggtgacagggtggctgattgcacggcttcctaccggtccgctcgagacagcgatgcgacgctttgaccgggcattcagcaatttgggacccgtcacgggaccggcgagactgagataggcggtcttcaacatgttgcctgaaggaaccgagaggcagctccttcaggattttagcctgtcgagaggaatatgcagtggatgagttcatgctgaaccagagtccgaggaaacttgtataaccaaaagttctacaggcctttgtttatctataaatgaaatccagctaagacccctcacccttgtatcgtcttttctcttattacaatttgaaaatattaagaaatggggatgtgtttaagaaatcgtgcacaaagtgttatctgatgtcggttttatcgcttatgatgctgccaaagggaagattatggccttcacgtataaagatcacaacaagaacttaactgttttcgctaacgatttaaccaatgacgatcatccgcagcatcaatatcggttgctggctaattcgattttcaatgccgctcccggaaaaactgacaatgctccatcatcaaaacggtgagaggttggaaagctaaagttcaaacggctcgcaggaggcgtctcgtccaaggcgtcggaagcagaactgaagcatgttatcgttagtaaagaaatgttcagtcgcatcacgcattaaatagcaaggctctaaaaactgcccttgatccgaagggcagttttttcttggtctatggcagcatcgtcctttcttccagttagaaagcttccgattggcgggcctctatgttatagctattgaaggtcagcatacttgtgcaataaaatgaagagcggagaatatgcagtggttcgcataaaaaattttacttgcacgaacagttgacattcagtagtcacagtgatttgataaaggaaattcgaatacagaaagacgggagctgaaacattgaagaaactggtgaaggtcagaggaattacattgggtgaaggccggccaaaaatctgtgtgccgcttgtcggaaaaaaccttgcccaattaaaagaagaagcggcttattttcaaacgcttgatgccgatattgcggagtggcgtgctgatttttatgaagatgtagatgacgttgatcaagtctgcgcggcattggcggaaatccgcggccttttaaaggacactccgctcattttcactttccgcagcgccgccgaaggcggagaaaaagagatcagcacagcgcgatatttttctttaaatgaagcggttgttaaaacagggcttgccgatgtgattgatatcgagctgttcaatgacgaagagcaagtgaaagcgctggtggaaacagcacatggtcatgaagtgtccgtgattatatctaatcatgattttgaaaagacaccagctgcagaagaaattgtttcccgtttgcgaaaagcacaggaattaggggctgatctgcctaaaatcgcggtgatgccggaaaccacggctgatgtcttgcgtctgcttgaagccacttgtacgatgaatgagaagtatgcagatcggccgattattacgatgtcaatggccggcaaaggtatcatcagccgcctggcgggcgaggtattcggttcagcaatgacgttcggtgccgcaaagaaagcttcagcaccggggcagattgcagctggtgagctcaaggaaatccttcatatattgcatcgcaatttataacttgatgattgagaggagcctggctgacagccggctcctttgtcagttttttcgtagtcctaacgactcatttatctttcttttcggaatcgttttaactttcccttttcattcataatgggttgtgatacgataatcacgaaatttaatagcattactaggggtgcccgaatgcgggctgagagagagacatgcgtttcttaaccctttggacctgatctggttcgtaccagcgtggggaagtaaaaaggattcgagagaagatggggaatgggtatggtccgtctgtcttctagcgattttactgactgtaaaaccaggttcatcatatgagcctggttttttgtgctggtgctgttccggagtttcgtcctgatcaattttttagaggggaaggatttttacatgaaacaggaatcagtacagcaaaaaaacatctcgataatgtcaagtttttcagggagccgcaaagtgtatgtcgaagggtcgcgtcctgacattcaagtgccgatgagagaaatttcgttaagtccgacgacgggttcgtttggcgacgaagaaaaccagcctgtccgcgtctacgacacgagcggcccctatacggacgccaatgcggacgttgatattcttaaggggctgaaacctttgcgggcgacctggatcagggagcgcggcgataccgaagaatatgaaggcagagaaataagaccggaggataacggctataaaggcaaagagaaagcgagccacagctatacagggttgaaacgaaaaccgctgcgcgcgaaaaaaggacaaaatgtcactcagctgcattacgcaagaaaggggatcattacgcccgagatggaatttattgcgatcagagagcacgtatctcccgaatttgttcgtgatgaagtggcaagcggacgggcgattattccgtcaaacatcaaccatccggaaagcgaaccgatgattatcggccgcaacttccacgtcaaaatcaatgccaacatcggcaattccgctgtcacctcttcgattgaagaagaagtggaaaaaatgacatgggccatccgctggggcgctgatacgatgatggacttgtccacaggtaaagatattcatacaacgagagaatggatcatccgcaactgtccggtgcctgtgggaacagtcccgatttatcaggcgcttgaaaaagtaaacggcgtcgcggaagatcttacttgggacatttaccgcgatacattgatcgaacaggctgagcaaggcgttgattatttcacgattcacgccggcgtccttctccggtatgtgccgttaacagcaaagcgcgtcaccggaatcgtatcccgcggcggggcgatcatggcgcaatggtgtttggctcatcatgaggaaagctttctgtacacccattttgaagagatatgcgagattatgaaaacatacgatatcgcattttcgctcggagacggtcttcgtcccggctcgattgccgatgcgaatgatgaggcccaatttgccgaattggagacgctcggcgagctgacggaaatcgcctggaagcatgatgttcaagtaatgatcgaaggcccgggacacgtgccgatgcataaaatcaaagagaatgtcgacaagcagatggagatttgcaaagaggcaccgttttacacgctcggtccgctgacgaccgatattgcaccgggctacgaccatattacatcggcgatcggagcggcgatgatcggctggtacggaacggccatgctttgctatgtgacgccgaaggagcatttgggactgccgaacaaagatgatgtccgcgaaggcgtcataacatacaaaatcgcggcccatgcggctgaccttgcaaaagggcaccccggcgcgcaaatccgcgatgacgcgctttcaaaggcgcgctttgaattccgctggcgggatcagttcaacttgtcgctcgatccggaaagagcgctcgaataccatgatgaaacccttccggcggaaggcgccaaaacggcacacttttgttcaatgtgcgggcctaaattttgcagcatgaggatttcccaggatattcgcgactacgccaaggaaaacaaccttgatgaagaaaaggctatccaaaaaggattgaagagaaggcgaaggaatttaaaaaagcaggcggcagcatttacagttaaaagcgggcaatacagcagatgaaaggggaacctttcatctgtttttttataatatagggttgacaggtcggaataatatgaattagtatgttatttaatatttcggaaaattccatcagcgctgatcggtcaaccgaaggctcttatctcaattgggataagagctttttattttcagttttagaaaagaaaggagaacaagatgtctttatcaattcgtgtgaatgaaaaagcatttggaaaaggcagctttaaaacaagcgtgctccaagacgtgaatcttacggtcgaaaacggcgaatttttgactgtcatcggtccgagcgggtgcggaaaaagtacgctcttaaaaatcgctgccggtcttgacggggattatgaaggacgaatcagcatgaacggaagagaaatcaagggcccggggattcagcaaggcttcatctttcaggagcatcggctttttccatggatgacggttgagcaaaatatcgccgcagatttaagcctgaaagaaccagcagtgcgaaaaaaagtcgatgaattgattgaaacggtacggctgaaaggtgcggagaaacagtacccgcgcgagctgtccggcggaatgtcgcagcgggtcgcgattgccagggctttgctcagggagcctgagattttgctgcttgatgaacccttcggtgccttggacgcctttacgagaaagcatctgcaggatgtactgacagacatttggagagaaaagaagatgacgatgatcctcgtgacgcacgatattgacgaatcggtgtatttagccaaccggatcgcaattcttacggcaaagccggggagaatccacaagctgattccggtcgatctgccttttccgcgcagcagaacatcgcccgtttttcaaacaattagacaaaaggtgctgaaagagttcgagacaacggaaacattcagctttcaggaaggttcaggaatttgagcagaaaggagcggaaaaacgtgaaaaaatggccgttgtatgtgctgggctgcctgttgcttcttgcgggctgttcagcagccaaatcaagtgaagggggcggagatttaaaagagatcaacatcggagtgcagcaaagcttaagcccgttgctccttgcgaaagaaaaaggctggtttgaaaaagagttcgcaaaagaaggaattaaagtgaaatggacagagtttcaaagcggtccgccgcagtttgaaggtcttgccgcggataaactcgatttttcccaagtcggaaattcaccggtgatcgcagggcaggcggctggcattgattttaaagaaatcggcctttctcaagacggtttaaaggcgaacggcattcttgtgaaaaaagggagcggaatcgatgacataaaagatttgaaaggaaagaaggtggcggtggcaaaaggcagcagcgggttcgatttcctgtataaagtgatcgataaagcgggtctgaagccaacagacgtcaacatcattcagcttcagcctgacgaagccatgccggcatttgacagcggagcgattgacgcctggtcgatttgggagccgtttttgtctcttaaaacgatcaaaagtgacgcggacatattggttgacggggaacaaatcgacaagtattccccgggttttacgcttgtacgaagcaaattcgccgaacagcatccggatgaggtgattcgttttctgaaggtgtatgacaaggccgtgaaatggcagaaaacccataagaaagaagcggttgaagcgtacgcaaaaattaaaaacctcgacaaagaggtcgttgaaaacgtgctgaataacaccgaaccgttaaatgagccgatcacagaccgcatcattcaaacacagcaggagaccgccgattttcaatacaaattaaaagcgattaacaaagagattgatgtaaaagaagtggtcgacaattcatttataaaaaaagcgctgaaagaaggagatgacaaatgagagctgtttcatcaagcaccccctcgatccagccgaaaacaggcgcaaaactgagaccggccgcttttcggctggcatgggggaagggatttgtattacccgtcatgttgattttattatggcagcttgtcgggtcattggagctcatatcaaaaaccgtgcttccggctcctttagatatattgcttacatttcgggatcttatcgtatcaggagagcttttcactcatttaggcatcagcattcagcgcgccgcgctcggctttttcctgggggccgggctcgggctcctgctggggcttgtaatcgggttttcgaaaattgccgaggattacctcgatccttctctgcaaatgctgagaaccgttccgcatctcgccgtcacgccgctgtttatcttatggttcggtttcgatgagctgtcaaaggtgctcttgatcgctcttggggctttcttcccggtatatatcaacacattttcagggatcaggggcgtcgattcgaaactgttcgatgtggcgagggtattggagttccattggctgaagcaggtgacaaagctcattcttcctgcatcgctcccgaacattctcttaggcatccgcctgtcgctcggcgtatcgtggctgggccttgttgttgccgagctgatgggatcaagcgctggagtcggctatatgattatggatgccagacagttttcgcaaaccgataaggtgtttgtcgggattttgatttttgccgccgtcggcaagctgacggattcattcgtcagaattctggaaaaaaagtgccttggctggagaaacagctatcaaggaaacaaaaagtaaaggggagatctttttggacattttatggtttattccgactcatggcgacggacgttatcttggtacaaacacgggaggaagagccgcagatcacacctactttcagcaggtggcgcaggcggctgacaggcttgggtatacaggggttcttcttccgacgggaagatcgtgcgaagacccgtggattaccgcagccgctctggcgtcagtcacgaaaaatctgaagtttttggtcgctgtaagacccggtttgatgcagccgtcggttgcggcgcggatggcttcgacattcgatcgtcttgcagagggcaggcttctcatcaatgtggtcgccggcggtgatccgtatgaattagccggcgacggcctgtttatcagccatgatgaacggtatgaagcgacaaatgagtttctcgacatatggcggtcgcttttaaaggcgagaccgtcagctactcagggaaacacctgaagactgaaaacgggcgcttgcttttcccgcccgcccaacagcctcatccgccaatctattttggcggctcgtcaaaggccgggcaggagactgccgccaaacacgcggacgtctatttgacatggggagagccgcctcatctcgtcaaagaaaaaatccaatctgtcaaaaagaaggctgaaaaagaagggagaaccgtccgttttggaatcaggctgcacgtgatcgtcagggaaacggaaaaagaggcctggcaggcggcggatagactgatcagccgcttggaggatgaaacgattgccgcagcccaaaacgcgatgaaacggatggattcatcaggacaaaagaggatggttcagcttcaccagggaaacagaagcaatcttgagatcagcccgaatctttgggcggggatcggactggtcagaggcggagcgggaacagcgctcgtcggtgatccggaaacggtagccagccgaataaaagaatacgccgacatcggcattgagtcctttatcttctcaggttatccacatcttgaagaagcgtaccattttgcagaaaaggtttttccgctccttccgtttcgaacgaaacttcaaagtaaagcatcaggcgaagtcatcggaaatgaccattttccgtcgaggcaaaaagaaaaaaccgtttaaataaaaaaactccagacattctggagttttttatctgtttttataaaatgaaaacatatatgaaagatgctgaataatgatcagcataaagatgacgataatcggaaaagacggaatcctgacttggaaaaacggataaaagatcaataaaagcgctgcgaccggcatcgccacatacagcacgatatatgatgttctgcatgcttttgcggtaatcatctgctctctttcatcctgctctttaaattcgtcggggacgagcataaagcgctgcttgcgtgaaccgctttttttctccaagtatgtgtaaatcgaaaggacgagcccaaagagaaggatgggaatcagattaaacacaaaatgaagctctgaatcgtttgttttcaggcttttggcaatttgttccgatgtgtggaaaaaggttataaacgtccagcatgcgagtccgaacagaaggatgtgaaagaaagtccgtgttatcatattcattcgtttttgtccccctctagccaaaatacgtcttccatttttaattgaaattccttgcaaattttcaaagccaaaagaagcgacggtatgtaattgcctttttcaatggccgcaaccgtctgccttgtaaccccgatcgcctttgcaagggcttcctgtgaatacccgtatcttgctctcaattctcttaccctgttgttcatcctaccacctgcaattcttcgtttatatagtatatttgacatattgttaaatagatttgacataatgttaacttgtttttacaatgtaatcaatatcttttgatctaggatcggcaggtttgtaacggcaacatttaaatttatacataaaaataacagaaatggaatagataaaatagaatcatctcgtttttttaaaaaaaggactttgagggtattttggcttctggattccgggagaagaaagggcttattatccagttcttttttctcgaactccttgtatggcgcgagatttataaagagaaaaaataagagaaaaagaaggcgggaaaataagacaaatagattatacaggcttcgtaaaatggaaacggggcttaaattttctcattcaagccgaaaagggtgggacattagattgaaaaaccaagagatccttaaataaatagttggaacgtagtgtttatgaaataggaaatttcatagatttcagtatgattttggatatgttactctttggttacttgatagaaaggagggggaaaaatgacatacgcagcacctcaggttgactattctgtcaatccgtcgatcgaagatcaggcttggttcttggtgtttgttgcagtgcttttggcacttggagcaactgttgttcttggcgccgctgtatggtgtgtggctaacggaaacggcagcttcacgggatccgtcaaatgggtcagcggtttgcaggtcagcatcgaatgtaggaaatagccatacttaagtatctgttcacaacaacaagacatatttgatgaggcttaaccgtctgtggggggcggttaagcttttcctgacattaatcataccctggaggcattatgtttataatagatcatctgtctaaaacatataaaaacaatgtgactgccgttagcgggtttcatataaaaatcgaaaaaaaccagatcgtcgcgatagcgggtccgaacggttcagggaagacgacgatcattaactccattttaggaatcatcacgcctaccgaaggaaccattctgttggatgacctgccgaacacgacggcggaattcaagcagaaattcgcctacgttcccgatgaactccttttgccggacgccctttcagccgcagaatatttggattttgtatcttctatgtatcattgtacatcaaatgaaaaacggaaacaattaatcgagcttttcgatatgaaagaggctttgcaggagccgattgaaacgtactcgcacggaatgaaaaaaaagacgcagctgatcgccgcttttatgctggagagcgaatttgtcattatggatgagccgtttcgcgggctcgatatagaagcggtcatcaatacgaaaaagctgatgaagcgctatgcggccacgcaagggtcgatactgctggccacccatgacatgctttctgcggaagaactgtgcgataagatagcaattctatcaaaaggcgtcaaaatggatgaaggaaaagtgaaagaattgaaggctaaatataacagcgattcacttgaagaagtattcttaaaagcttcgatgctgagtgataggggtgctcattttgatcaaatcattcgaaatttctaaaatgatgctgaaaatgtggcagaaggaaatgggcaagctctttaataccggtacaaaaaaagcgatcgccgtgctttttttgcttttggcggtaacgatgggaagcatcatcggctacagttttacaggcatgtttttaagcgcgtttctgaacggcgaagttcgttctctcggattgttcgtgatttccatgtttatgaacgcgtcgatttttacatttgttttcttcattttatttaaagtaaggacgccagagcagcacagcttttccatgcagctcagctggtttccgctgacggccttccagagaagcctcggatatttcatcccgtttgccggagcggtttcatttcttgtcctgtttatgattttcattctgctgattccgaactttgtcgccagcggtgttgggttttggtttgcttttgcgttttttgcacttctttttgtacagatcatctttttcttttcgcttctcaatcttgtctataacttggtgtatatgttgattttaaaattcggctttccgctgcaaaagtttttttcaatgtttgtccttgtcgtgttagccgtgttttacggaatcacatcattcgatcttggaaacattcagaacgcttattcgtcttttgattatcatttgacatattttgcagcgccgctgtttctcatgctgaacggtcaggcgtcggatgccggcgtcattccgattgtgctgatcttgacagcagcagtcacggcctcttttatgtcgctgaatgttgtgccgatcctcactgaaaaaaaatcatctaaactgttttcatttattaaaatcccgtcatcaaagccgctgtctttggcggtgaaagaaataaagtctcaagcccgaaatgaagaaaatattttaaacttcatttttttgcttttggctctatgctttttgaaatacaagtttcagtttggatttaccggtgagagctatttggttctgggaggcgtgacaggtatcatcgccttcaattcatttggcaacgatctgcggatgatgcagatgtataaggcgcttcatttaaaaacggcaacggtactgtggtcaaaatatctcgggctctgtatgctcggcctcattcagctctttttgttttccgtgctgacgtggactttcccggagagctttccggtctttttaaagacggttgctgtgatcttaaactcgattgcgatgttctatttagcgggcattatttttccgcttgaccgaaacaacccttatatggggatcttctctttcggaatgctcctgctctttttgattccgctgtttttcatcgtgaattatgcggttgataacgtcacgggcgaagcgctgctgtttttcataccgtgccttgaattactgctgatcctgcttttatacggagggtttaaatggaggtaccattatgatcattaatatgttgaaatcgctggccggaatcaaaaaaattccctatttcccagagcatgtgacactgaatcggaagcatatttcagatcatgatcttgatgctgattttcccattaatccgactgcttatcaaatgctgaaggaagtcgacgggaaaaaagacgagctggagattgccgaagctctcaaaggtgtgtttaatgtcagggaagaggtgctgcagaaagatttgcacgaattgctgacagggctcaaccgccgttatttgatcaattggaggtacggagagggcccgtcttttgcgggagtgctttatcaattcttcagccagtatcatatccgctacaaggagaggttttcaagccattctgattcgtttctgctgttgtacataaagtttctgcaagtgatttctaagaaaatcatcgtgttctggctcgtctttttgatgttgtcgcttgcagcgtacaccgttgttccggatggatcgatcgtcggcatcgcggcttatttttccgtcgtctatttcgggttgatcaccggaacggcgcttcatgaagtggtgcacggcatcgcgcaccggaaagctgccggcaggaacggcccgcaggggtttttagcggctgatatgatgtcagtcaaatttgtccgccctgtcatgtcgctgcatgataaaaggtcgatttggattacggcgttgggaccgcttgttcccaggtgtgctcggaatagccggcgtgctgtttacggtcttttttcttaaggaaaacgcggtttccgtcggagtgctgctgttcttttccacctatgctttgcatatgatgtatctgcttccgtttatgggtgacggaaagtcgattatgaaacagctgatgatcagaggaattggaggtaaatcatcatgaatacaaactctttaaagcagggactaatctttgccagtttctcaagctttctcgcatttccgatgcttgcggctgcgcttttgttttatcaccttttttcaaatcaaacgagcaatgatatcttgtttaacagtttgtcgtttgtcatggagagcgaatcggctttttcattccaggtgaagccaaactttttcttcattatgatcgggctgtttatcggcatttttattataacggctgcgatttcatcaatttatcagaaaaaaaagggtgaatcttaaaagagcttgcttccctgaggcaggctttttttatttgcatcggcagtcaggttgtggtaaatttaaatcgtaatcattacgctttggaataaaggaggatactcagagtggccaagaaatcaaaaattgctaaagaaaaaaagcgccaaaagcttgttgaacaatatgcagaactcagaaaagaactaaaagaaaaaggcgattacagagctttgagcaagcttccgcgcgactcggcgccagcaaggctgcataaccgctgcgaagtgaccggaaggccgagaggatatatgagaaagtttaaaatgtcgcggatcgcgttcagagaattagcatataaaggccagattccaggtgtgaagaaatccagctggtaatctgtcaatgtccggaaaaaagctgccgatgttaaatcggcgtttttttttcgacaaatttttaatatacccttgacgaaattttaataaacgtgtaacataataaaagtcaaaacgatgatgttgtttttagtgatcatatgcgggtgtagtttagtggtaaaacctcagccttccaagctgatgtcgtgggttcgattcccatcacccgctccatacatactgtttataacgcagtgtttcgtttctcagattaaacgaagcattgcgttttttcatgtatgaaatcatcataaaaaacctgctcttttcaagaacaggtttttacggaaagacggctgaaatgtgcctgccgccgtgaatttgttcaaacatttttgtcaaagaatcgagcagccggctggcttcttctttagataatgacggcctgaaaaagacgagctgcaaggcatcttttgtgtccgctcctgcatgatgaagactgaggttttcggtgatcgtgccgaatgctcccgcatcatcggagaacgtgatgatctcgtccgggccgccgggttcgattttgatcggacccttcaaattccgggcgtcatatatatgaaccggaatcaaatatttgagagagaaaaaacggctcagatcaaccgccgaatttttcggctcgacaaagcgctgctctttgatgtcttccagcatccgttcgagtccgctttcccggcctgaaaaagacggattcagctccctgaaggcatcatgccattcttttacggccgattcatcttcgatactgcggtcggcatagtcaaaaaacagcgattcctgaaaaaggcggagccggcctttaagcatttgcggggagccgttgatctcaataccttgatataacacagcgccaaccttaaatgaaggaatacggtttaaaatagcaggcgcaatttgcaaacgaagttccaattttaattcaactcccgtgtcatggtacactctattatacagagagcgaaaacgaaaacaaagaaaggaggctctgcgcgatggatgtgaaaaaactgaaacaggatgtcatcgaattcgcacagcaaatcggcattgataaaatccggttcgccagtgcagatacatttgaaacattaaaagaacgattgattgagaaccgggcccttggctatgaatcaggctttgaagaacccgatcttgaaaaacggacgaacccggatctgcttttgccgaaggcgaagtcgattatcgccatcgcccttgcatacccctcaaaaatgaaagacgcgccgagaagcaagaaaggcgaacgaaggggcatcttttgcagagcttcctggggaaaggattatcatcatgtcctgcgcgaaaagcttgatcagcttgaagaatttttgaaagcacagcgaagcgatgtcagaacgaagtcgatggtggacaccggtgagctttcagacagagctgtcgcagagcgtgcgggcatcggctggagcggaaagaactgcatgatcattacgcctgaattcggatcttacgtttacttggcggaaatgattacgaatattccctttgagcctgatgagaggatcgaagaccaatgcggctcatgcaacaagtgcatcgaggcatgcccgaccggcgcgctcgtcaagcctgggcagctcaactcccagcgctgcatcgcttttcagacgcagacaaagggttttctgcctgacgagttccgtacgaaaatcggaaacaggatctacggctgtgatacgtgccagatggtatgcccgaaaaataaaggggtcgattttcatctgcatcctgaaatggagccggaccctgagattgccaagccgcttttaaagccgcttctgacgatgtcgaatcgcgaattcaaagaaaagttcggccacgtggccggctcatggagaggcaaaaagccgattcagagaaatgcgattatcgcacttgcccattttaaagaaacggacgctctccctgaactgattgagctgatgcacaaagatccgcggccggtcatcaggggaaccgccgcatgggctgtcggaaagatcggcggagcggatgtgatgagtgaattggagcgcgcgctcgcgcacgagcaggatgaagacgcaaaagctgaaattcaaaaaggcatcggcctgttaaaagaaacgagtgcgactaattgagggctgtcctgacatatgtttaatgatgagaaacgaattaacaaacatatggtggtgtagcccttgaaacagatcatcgagcagctcctgaaagccagacttcaatacttaattaacggcaatgatgaaacaaactggcgggatgccggaggttttgaagtcattgaacggaagcggaggctttttcaaaaacgcggcgtgcatatcgtgaaggccaatatagaagcggctgtaaaagagcattggcttgatgaagacggcgcgtcacatgtgaactatcaaacccataccgcatatttgtgcaaagacggggatgatatgtatatggaagaacatatggaagacagaaacgcccttttgtatgatcagatggtcattaaagactccgaggccctgcgtccggccgcacagtctcatcctgagcctgaaaacggcgatgaagatatgcgcgaattgctgggaagggcgttccgctatgaccggcttgccgcggtgcgctatgctgaaacgtattggaataaacgaaatcctgcttataaaaactttgaagacaattgcacaaactttatttcccagtgcataagggccggagatgcgccgatgcgcggctatccgaacagaggcaagggctggtggatgcaaaaccattcctggagctacagctggactgtcgctcattcgctcagaacctttttgaagcattcaaaagccggtctccgagcggttcaaaagccggctgcgaaagagctgatcgaaggcgatgtcatctgctatgattttaacggagacggcagatttgaccacgtggcccttgtgacagcgaaggataaaagcaatatgccgctggtgaacgcgcaaacgcacgactgccggatgaggtactggtcttacgaagattcgcctgcttatacttcatcgattcgatatgcgttttttcatatatcagatgatacgacaaaatcgaaatgagtggtataataaacagcggattagaaaaacagaggtgaatactttggcattgcatgtcgtactatatcaaccagaaattcctgcaaacacaggaaatatcgcacggacttgtgcagcaacagatacaacacttcatttaatcagaccgctcggcttttcaaccgacgataaaatgctcaagcgggcaggtcttgattattgggaattcgtcaatgtcgtctaccacgactcattggatgaattgtttgatgcccatcctgaaggccgttttttcttcattacaaagttcggtcaaaaaccgcacacttcatttgattattcagatcaaaacgaagattacttctttgtcttcggcagagagacgaacggcttgccgaaagagctgatcgaacaaaacatggatcgctgtctgcgcctgccgatgacagagcacgtcagatcactgaacttatcaaacactgcggcaatcctcgtgtatgaggcgcttcgccagcagaattacagagatttgacttaataggtaaagagccctttttcaaaaggggctctttttttgttttccaatgtaacagtgttatgttacaatgtgtgtgaaggagctgaaacagatggttcaggatgatttaatttcaaaaaaagagctgctggatttgacttcgatctcgtacggacagctctatagatggaaacggaaaaatttaatacctgaagagtggtttatccggaagtctacgttcaccggacaagaaacgttttttccgagggaagacattttaaaaagaattgaaaccattcaaagcatgaaagaaaacctttcccttgatgagatggcggaaatgttttcgcccgatttgaccgaactaaacgcgagccgcggggagctgctaaaaaaaggcatcgtttcagaagcggtcatggcgttttttgaagaatgcaccggaaaacgcgatcatccatttaatttgacagaagcacttgcggcttatgtgctggaaggcttgcttcaatccggcgacatcagcctggatgaagggaaaatggtgctggatgtcatcatgtcgaacgaggcggaaaacaagggaaggctgcttgtgctccggaagctcggcgttgcaacatgtctgattgccgagggcagcattgtgttggaaaagggagtcaaggtagccgctgacatcaatctggcggcgagcagtgaagaattgaaaacaaaattcatgtaattggaggatcaaagatggagaatttattgataaacggattcggcagttcaggcggaggcgcgtatcaaacggttgagttaaacggcaaaggtacgattaacggcgatattgactgcgaaaggttcagctgcagcggcaccgggactgtaaacggagacgtaaaagcggatgagctgagaatcagcggccatgcaaaactaaacggcgccatcgaggcttcaaaggttagaattgatggttctgcaaaagtggatggcgatgtcgaagcagaaaagcttaaaatcttaggctacgccggcattagcggacatgtgaaaggcgacgaagcgatcgttcgcggaaaaacgtcgatcggcaaagactgccaagtggaacatttttctgcagaaggctattttacaatcgacgggctgttaaacgcggagcaaatcgaaattaaggttcacggcggcgaaagtaaagtgaaagaaatcggctgccggaggatcgtctgcactgcacatcaatcgaagctgttctcgtttttatcggagcttatttctcctccaaggctgtctgccgagctgattgaaggggatcatatcgaacttgccaatacgaccgcaaaagttgtccgcggcaattcggttatcatcggcgaaaattgcgacatcggcctgattgagtataaggaagatatccgggtggccgaaacggcaaaagtcggagagaaaaggaaattatagcggagggataggacatgaagaaacacgacttgaaaatacacggatccggaagcgcggggggcggatcattccatcgtgttctcattagaggtgaaggaatgatcacgggaaacattgattgcgaaaaattcagtacacacggtacaagcgaactgtcaggcgacgcgaaaattaaaagctttagtgtacacggggaaacagagatccgggggaggctgaaagctgacaaagccagagtatacggcacggcggatgtttctgagaacgccgagatcagcgatgcagccgtgaaaggcatcatcaatatcgggggaaatatgacggctgacacttgcgatgtcaaaggcgccctgaacgtaagaggcgattgcgaggcagaggattttaaactgacgggcagcctggatgtaaagggcctcctgaacgcaggtgtgattgacatcggcttaaagtacggaaacagttcgattggcgatatcggcggtacggatattaagatcgtcaataaacgcgggctgttgtttaatagaaacggaggtactctctcggcagggacgattgaaggagacgatatttacctggaaaacacggcggcccgaatggtcagaggaaaccgcgtgcatataggaccgggatgcaagattgagaaagttgaatacaagagcagctaccgggtatctccgaagtctgaggtaaatgaggatcaacagcaataaaacagtgttatgttgtgaaaaaagggatggctttaaaagtgagccatccttttttcttttttaattttactttccgggtttgctttcgtatccggcagtaaatatggatacgagaaacgcgaggatgacccccatcatgatcagcgttctcattaaaatccccctctcatccttgatcccttgttgtcatctgcaccgatgcggcgagccgttccgcaggagcacatgcggacggaacttttctgctcttattatgaatggtttgctccagccttgtcaattcgaggaaagtacatttcatttttcatatgaaaagcatctaaagggacatcttcgcatagagtgaatgtaacagtgattcacttggcaccttgcatttatcatcatataggaggttcttatggatatattaaaaaagattgaacagtatagagaggaagagcagcgtctgaaatgggaaggaaccttcgctgaatatctggaaatcgtaagagaaaatccgactgtcgcgcaatctgctcattcccgcgtttacaatatgattaaagacagcggcattgaagagaaagacggcaaaaaagtatacagcttctttgacaaagagctgtttggtcttgaagagcctttggaacgccttgttgaagaatactttcatccggccgcgaaacgccttgatgtcagaaaaagaatcctgcttttgatggggcctgtcagcggggggaaatcgactttggtcaccatgctgaaaagggggcttgaagcatactctcttacagatgaaggggctgtctatgcgattaagggctgcccaatgcatgaagatccgcttcatttaatccctcagcatctgcgggacgatttttacaatgaatacggcatccgcattcaaggaaacctgtccccgttgaacatgatgaggcttgaacaggaatacggcggaagaatagaagacgtgaaggttgaaagaatctttttttcagaggataaacggacggggatcggcacgttcagtccgtcagaccctaaatcgcaggatatcgccgatctgacgggaagcattgatttctcgacgattgccgaatacggatcggaatccgatccgcgcgcataccggttcgacggagaattaaacaaagcgaacagaggaatgatggaatttcaggaaatgctgaaatgcgatgaaaaattcctctggcaccttttatcgcttacacaggaagggaatttcaaagcgggccggttcgcgctcatctcagcggatgaattgatcgtagcccacacgaatgaaaccgaataccgttcatttatatccaataagaaaaacgaggcgctccattcgcggattatcgtcatgccgattccatataatttaaaagtatcggaagaggaaagaatttatgagaaaatgatcgctgaaagcgatgtgtctgatgttcatattgcgccgcacacgctaaaagtggccgcgatgttttcaattttgacaaggctgaaggagccgaagaggtcagacattgatctcgtcaaaaaaatgaggctgtatgacggagagagcgttgaaggatacaattcagtcgatgtcgaggatttgaaaaaagaatacactgatgaaggaatgagcggaatcgatccgcgttatgtcatcaaccggatctcgtcgacgatcatccgcaaaaatatggagtcgatcaatgcgctcgatgtcctccgttctttaaaagaaggactcggccagcatccgtcgatttcggcagaagaccgcgagcgctatttgaactttatttccgccgccagaaaagagtacgacgaaatggcgaagaaagaagtccaaaaagcgtttgtatactcttatgaggagtcggcgaaaacgctgatggacaattatcttgataatgtcgaagcgtactgcaataaaattaagctccgcgatccgctgacaggagaagagatgaatccggatgaaaagctgatgaggtcaatagaagaacaaatcggcatttccgaaaatgcgaaaaaggcattccgagaagaaattctcatccgcatttctgcctatgcaagaaaagggaagcgatttgattataattcccatgagcggctcagggaagcgattcagaaaaagctgtttgcagacttgaaagatgtcgtcaaaatcacgacgtcgacaaaaacgccggacgaacagcagctcaagaaaatcaacgaggtcgtcgcccgtctcattgatgagcacggctacaactcgacaagcgcaaacgacctcttaaaatatgtaggaagcttattaaaccggtagcttgaagacccgtccggagaagggcgggtccttttgtcccattttcaaaattgtttgtcaaaagttatttgcacctgcataagataacaataaacacttttagacttgcatccgcaggactttgacctataaaccgaagccatttaaggggattatcaataaggaggggaattcatgtcccataaagacaatggccattttattatttctcaggaagactggtccctccaccgaaaagggtatgatgaccaacagcgtcaccagaaaaaggtgcaggacgcgatcaaaaacaatctgcctgacctgattacagaagaaagcatcattatgtccaacggcaaagatattgtcaaaattccgattcgctcgttggatgagtataaaatccgctataactatgataaaaataaacatgccggccagggagacggcgacagccaagtaggagatatcgtcgcaagggacggctctgataagcggggcgccggcaaaggccagggagcgggcgatcaggccggtgaagattattatgaagcggaagtttcgttaatcgatttggaagaggcgctcttcagcgaaatggagctgccgaatttagaacagaaagagcgcgatgatatcgttgtcgaagatattgaattcaacgatatccgcaaaacgggtttgacgggcaacatcgataagaaaagaacgatgctcagcgcatttaagcgaaacgcaatgactggaaaaccgtcgttttatccgatctatcccgaagacttaaaatttaaaacgtggaatgactctgtaaagcctgaatcaaaagccgttgtgctcgccatgatggatacgagcggatcgatgggcgtttgggaaaaatatatggcgcgaagttttttcttttggatgacacgttttttacggacaaagtatgaaacggtcgatatcgagtttatcgcccatcatacagaggccaaagtggtatcagaagaagatttcttttcgaaaggggaaagcgggggaacaatttgttcatctgtataccgcaaatccctcgagctgatcgaagacaaataccatccgacacgctataacatttatccgtttcatttttcggacggcgataatctgacatccgacaacgcgcggtgcgtcaagcttgtcggagagattatggagaaagcgaatatattttgctacggcgaagtcaaccagtacaacagacattcaactttaatgtcagcctacaaaaatattaaaaatgaaaaattcaagtattatgtgctgaaacagaaagccgatgtttttcaggctctgaagagcttcttcaacaatgaagaacggcaccaatatacatgaaaaaacctgaattaaacctccgctgccggaggttttttgtttggaaaatatttaaatcaaaattttaagtgcaaggttattgacattctttattactttaactaatatttaatcttgttaactatttattttgttgtgcagaggtaaaaacaaatttaccgtttccgatctttcttgctcagttttgaacaacttattcagtacacgtcccgcaagctgctgagcaggaaataggaaaagcaaaaccgagggagccgttcaaaccggcttcacccaaaatataaggatatgaaaggagaaataaaacatgagcaaaggacgtttaattgcgacgaacattatcggactcatcatcgtgcttgccatcttagcaggaggtgcgtatttctattatgacagcatcagctatgtgaaaaccgatgaagcgcacgtggcaggcgagatggccgatattacggcgcctgcatcagggaagctcgcagattgggatttgaaagaaggatcaaaagtttcgaaggacgaaaaaacagcgaaaatcaaaggggaacaaacggttgacgtgaagtcgatcatggacggaacgattgtcaaaaacgaagcgaaggaaggccagatcgtacaagccggtcaaacgcttgcgaaaacaatcgacatggatcatctgtacattactgctaacattgaagaaaacgacctgaaagacatcgaaaaaggggacaaagtcgatatcgtcgttgacggtgattcaggcactacatttgaagggaatgtcgaagaaatcggctatgcgacaaactcaacatttgacttgctttctcaaagcaattcaagcggaaactacacgaaagtaacgcagaaagtacctgtgaaaatttcaatcaaaaacccgtctgacaaagtgctgccgggaatgaacgcatccgtgaaaatttcaaaataaccgggggaaataaaaacgagcgaaaggaggatgtcataagtggcttctcagaaaaaaggaaatatgtcactgcttatcatattaatggccggcttgtttctggccattttaaaccaaacgctgctgaatgtggcgatgcctcatctcatgacagagttcaatgtgagcgccacaacgattcaatggctgacaaccggatatatgcttgtcaacggcgttttgattcctttatcagcctttctgattatgcggttcggcggacggagcctgtttttaacggccatgctgctgtttacggccggaacgctgatatgcggaatttcgcctaatttctcgacgatgttaaccggacgcctcattcaggcagtcggcggaggcatacttcagcctttggtcatgacgacgattctctttatctttcctccggaaagccgcgggaaaggaatggggatctttggccttgcgatgatgtttgctcctgctgtcggtccgactctatccggctgggtcattgaaaactacagctggcggatcatgttttacagccttgtgccggttggtgtcatcgtcatcattttcggttttttcctatttaaaaatatgacggaacctaaaaaaatcaaattggatacagcaggcgcgattctttcagtcgtcggatttgcggcgttgctgtatggcgtgagcgaagccggctcagacggctgggatgatccgatcgtactttctacagttgtgatcggtgtaatcggcattgccgcttttatcatccagcagttgaaatcgaaagaaccgatgcttgacttcagagtgttcaaatacgatatgttttcactgtcaagcgtgatcaacgccatcattacggttgctttgtatgccggaatgttcctgattccgatttatttgcaaaacctggtcggttttacagcgcttcagtcggggcttcttatgctgccgggcgcactcgtcatgcttgtgatgtcgccgatctcaggaattttatttgataaagtcggcccaaggccgctggcgattgtcggtttattgatcaccgttgtgacgacctacgaatttacgacgcttacgatcgatacgccgtatatgtacatcgtgctgatctatgcgattcgggcgtttgggatgtctatgctgatgatgccgattatgactgccggcatgaaccagcttccgcagcatctaaacagccacggaacggcgatgtcgaatacgcttcgccaaatcagcggttcgatcggaacgagcttgatcacgacgatttatacgaatcgtacgacattccactatgcatcaatggccgatcagacaaatacggctgatccgtcatttatgagcacattgcagtcaacgattcagtcaaccgcgcaatcgatgcatatatctctcgaacaagcacaacaatatgtcgtgaaatatttgaccggacaggcgcagctcaactcgaacgtcatgggtattaatgacgcgtttatgtgggcggccgggttctgtgtcatcggtctcgttctcagcctgtttttgagggatgtcagaaaagacaagctgcgcaggaagaacaaagcgcaggagctgacattgcttccggctcctaaagaagcgaaagaatcttaaaatgaggaggttctgacatgaaaatttatgttgtttacgacagtgaaggcgagcatacgaaaaagctggctgaagccattgcagaaggcgcgggggaacatgatgctgcagacgtgcggatcgatcatgtcagccaggcggatattagaaagctcgaagaaatggacgctatcatctggggatgcccgggccatttcggtacaatcagctccggattaaaaacttggatcgacaggctgggctacctttgggcggaaggaaagctgatcaataagatcggcgcagtcttctgcacaacggcgacgacccacggcggtcttgaggcgacaatgctcaacttaataacaccgatgcttcatcaaggcatgatggtcgtcggcttgcctggaaatgtacctgaaaatgctttatacgggtcttattacggtgcaggcatcacgtgtcctgtcgacagtgacgaattgatcggcgaggaaggcctggagctgggccgggctttaggcagacgcgtcgcccaggtggcagaccgctttacagcaggacagtgaggagcgatttgacatgaccattatactgaccatcatcgctgctgtcctcgtcattatcggtctggtggtatttaatgtgcggtcggcgtcttctcaggataaacccgaacatgaggataaagctgcatctgcggctggcattcctcaggttcaggaagaagaagagcctgagcaggttaaagccgatcagcaagatccgttcgaaatgaatgatcaaacctatcgggcgatcctgcaaaaacttcaacaaccaaaagaggaaaaaaaatatcccgagaagacggaaatggacgatatggattaccgaaacgcattaaaatccatgaaaaaacgggaacaggattaaaggcaaattcgctgggcaccagcgggtttgcttttttatttgcgctttttttgcaatattacttccgattccccccgcactactgatgcagtactctgatacagctcggtctggaagggaagacgcagctttagttataaattcgaacaacaatgcgttattgctgttgtataccaattgatatttcgcgccgtttattcattttcgagctgattgtcagaaacgttctgatccgaagcagcaacagcctgttttccgcgtcatttgcttctcgtcaatatcgctgtctgtttaggctgcgtgtttttttccacatgagtgatgttctttcgaacgatagatgagcgctcagaaaatattcggctatcaaaaaatcatccgggacatttccttgttgatctacgatgcttatggattattcgaggcgctgttcatcaagagcggcttattccagaaagtgcagagattctggagcatttctttaaatgctgatttcaaatttcatgatgaacagccagaaaggagacgaagaacgtctctatttaacagagcttgatatgttctgcgtccatttcgggtcaaggatatattcactattatgaaaccaatttttccgatttccgtataaacaaagcgtggaacctgttaaaggacaagaaaaatcgacagggatataaaaatcggcaagctttccaaagggaaccggggcaggctgaagctagcgctcacattggcgagcgatgcagcggtcgtgctgtttgatgaaccatccggtctccgatggtgagggagtcgacagtcaaaagccttcttacatatttggagcttgacaagcagacaatcgccatcgccacctatgaaattgaacaaatattggatgtcgtcttaaatggccgaattgaagcaaaaaaggatgtcgaacagctgcgcgaggaatccggaatgtcgcttttggaatggctgaaacggtttattaaagaaaaaaattgaaaaagcgggaggagaaacattggaaacacttttggaattaaaaaatgtatcaaaaacgatcagggggaaaaagatcatcgagggcttgagttttgacgtgcgggcaggcgagatattcggcttcctggggccgaacggcgccggaaaaacgacgacgatccggatgattgtcggacatatgagcattaccgccggtgaaatcgccgtgtgcggcgtcagcgtaaaagaaaactttgaaaaggctgcacggcatatcggagcgatcgttgaaaacccggagctttataaatttttaacgggctaccaaaaccttcagcaatacgcgcgcatgacgaaaggcgtgacgaaaaagaaaattgacgaaatcgtcgagctcgtcggattgaaaaacaggatcaacgacaaggtcaaaacgtattcgttaggaatgagacaaaggcttggccttgcccaaagccttttgcacgatccaaagctgttgattctcgatgagccgacgaacgggcttgatccggcaggtatccgggaaatccgtgactatttaagaaagctgacgagagaaaagggaatggcggtcatcgtttcaagccacctgctttcagaaatggagctgatgtgcgacaggatcgccattattcaaaacggaaagctccgggatattcagcatgtgcacggacccgctcgggatgagaagaagcgctattatattcaagcggacgacacccaggctctcacacgggaagcggctgctttcagaaaggtgaaggttgacgaagcggaaggcgggatagagctcagcattcaaaaggatgaagtgcctgatttgattaaacacttgacagacagcggtgttcgcttatatgaagtgaaggctgtgaacaaatcgctggaagaccgattcctggaaatcaccgcagataaggaggaagctcagcatgtttaatctcatcgtaaatgaatggatcaaaatttttaatcgaaaaggcacatacgtcatgatcggaattttgctgttagctgtcatcgggctgggcgttctcacaaagacgatcggagagacagaccaaaacacggactggaaaaaggaattggcgcaggaaaataaggacatgaaggaacagcttaaagggaacagcaatccaacacttgaaaaaaattatgaacagtcgatcgcaattaatgagtatcgaatcaagcacgatttaccggcagatggggattattcagctctgtctttcatcagcgatacgagcgggctcatctcgctcgccggtttgtttgtaatcacggtggcggcgggaatcgttgcgaatgaattcagctggggaacggtgaagctgcttgtcatcaggccgatcagccgctttaaaatcctgctggcaaaatattttacggtcctgcttttcgcattggctttgcttttcattctgttcgcaagcgcagggatcacaggccttgctttattcggggcaggcgacagcagccaggttcacttggtgtatgtcggtggaacggttgaagaaaaaagcctgctattgcatttggccggcagctatttgctgaattcgatttcgcttttgatgatggcgacaatggcctttatgatttcagcggttttcagaaacagctcgctcgccgtaggtatttcgattttccttttggttatgggcggaacggtgacaggcctgctcgcgacgaaatttgcttgggcgaaatacatcctgtttgccaacacggacctcactcaatactttgacggatctccggttgtttcagacatgacgctgggattctcgattgtgatgctggctgtctattttatcgtttttcatgtgctcgcctttgttgtattcacaaagagagacatcgcttcataagcggtatacgtttaaaaaaagcctgacaccggtttccgggcgtcaggctttttttaaatataaaaagactgctgacattcggtcagcagtcctgtatgaagatcagcggttcacagcttacgcttttgttacgttagcagcttgtggtccgcggtttccttcaacgatttcgaaagatacagattggccttcttccaaagttttgaagccttcgccttgaatagcagagaaatgaacgaatacatcgtcttgtccttcaacttcgatgaatccgaaacctttttcagagttaaaccattttactttaccttctagcatgaaatttcctcctaaagcgataacgcttaaattcactattcttgctctaaaacaaacttccaagacgaaaactcttacaaaactttcttcttaaagatagttcgaacaaaaataattacctttactttaccagtgtttaaacgaaattacaactgctaaacacaatttttttaaaaaaagtgaaatttaatgctcagggtgaaaaacaatgagtaaaaagggagtttttgaaattttcacgaatctgattgacaacatttcgaagaagctgtaaagttaggtaaaacttcatgcaactatacttcttattcagagaggcggagggaattggccctgtgaaacctcggcagcgggttctgcatacagcagaatactgtgccacatccaacaagccgtacgggcttggaagataagaagagagcggactcactctatttactttgtgtcgtcaaaggcttcttcttattttttaagaggaagccttttttgttagccctaaaagaggaggagatcatcatgattacatttgaaggcgttgaaaaggtctatgaaagcggcggacagaaggtccatgcgctcaatggaatcgaccttcatgtggataaaggggaaatatacggcgtcatcggcttcagcggcgcaggaaaaagcacgctgatccgctgtgtgaacttccttgaaaaaccgacggccggaaaggttttcgtcggcggaagagacttaatgtccctgtcgaaagctgagatacgaactgtgaaaaggaagatcggcatggtttttcagcattttaacctgttaaattcaaagacgattttcgctaatgtcgctgagccgcttgcgcttgttaaaacaccgaaagccgacataaagaaaaaagtgacggagctgctccgttttgtcggacttgaggataaagcccgcgattatccggatcagctttcgggcggacaaaagcagcgcgtcgggattgcccgggcgctggcgacaaatccggaggttctgctctgtgatgaagcgacatcagcgcttgacccgcagacgaccggcgatattttgaagctgctgaagcgcgtcaatgaacaatataacatcacgattctgttaatcactcatgaaatgaatgtggcaaaagaaatctgcgacaaagttgcggtaattgaaaaaggaagaatcattgaatccggcagtgtgtttgacgtattttccgcgccggaaaccgaaacggccaaaagctttgtcaaatcagccatcgaccacgagatacctgaatcgattcaaaaattaaatctgaagcacctctaccagcttcaatttgtcggcgaatcttctgggaagccttttctttctcaagtgtcaaagcggtatgacgtagaagtcaacattctgcacggaacgattacagagcttcagggaattccgtttggcagcatgacggtcgagctgcagggggaagatggtgaaatcgggcgggcgctcgaatatatacgcagggaaaacattcgcatcagggaggtataagcatgctagttacatatgaccaaatcattgacgcactggttcagacgattcaaatgacggttttttcgcttttattttcaagcgtgatcggcattccgctcggcattttgctggtagtcacaagaaaggggcatctgcttgagaatccggcagtttttacgtttgtcaatatgatcattaacattttccggtccgtcccgtttatcattttaatggttgctttaattccagtgacaaggctgattgtagggacgtcgatcggcacatcggcagcgattgttcccttgactttttatgcggggccttacatcgctagactcgtcgagaactctctgcttgaagtggatccgggagtcattgaagccgctgaagcaatgggagcgactccgagacagatcatcttcaggtttctgattccagaagcgctcggttcgcttgtgctgagttttacggtggcaacggtcggattggtcggggcgtcggcgatggctggtgcgattggtgcaggcggtcttggggatttggcgatcacatacggctatcaaagatttgacacgctgacgatgatcatcacggttgcaattctcgtcatcgtagtgcaaggattgcagacatccggaaacgttctgtcaaaaaaattgagaagaagatagacagagagggagacggctattatgaaaaaatttgcatgtgttgtgatcttcctgctgcttgcggcagtgatcgcggggtgcgcggcagactctgatgcgaaaaccattaaaatcggcatcagcggaacggatacgagaatttgggactttgtgaagaaaaaagccgaaaaagaaggcttaaagcttgaaatcgtcaaatactccgactatgttcagccaaaccaggctttggcgagcggcgacattgacgccaacgcttttcagacgatatcctactttaatgcattcaaaaaggaacgcaaccttgaattatcgccggtcggcacaacgatcatcgctccgatgggcatttattccgagaaatatgattcgcctggcgatataccaaacggcgcggaaattgccgttccaagcgaagcgacgaacatgggcagagccttgcttctgctggagtccgccggcctgcttcaattaaaggacggatttgacggaaatggaacgcttgatgcaattaaagaaaatcctaaaaaactcaaaatcacaacggtggccgcagagcaaacgccgcgcgtgcttgccgatgtcgctgcatccgtcatcaacaacggcatagcggttgacgccggcttccatcctgtcaaagattcgatcaaactggaagatgaaacagcgacaccgtacatcaacattattgcggccagaacagaagaccgggatcgcgaagatttgaaaaagatcgtcgagctgtatcaagcagacgacactgctgaattgattaaaaaagaatttgacggagcacagctgccgactttcgttcctctaaaagacatcggcgaataaaatgtcagtcgcgcaattgcttcccgggtcatatattgaaatacatcgataattcctacttgaccaatcaggtttgttgtactatagtttttaaatgtaaaaaattctgggggtgcttttgttatcatgacattatttgttgttattaatattatcgtcatgctcggcctgatggcgctcctttatatgatgcaaaaaaagcatgtttctttttctaagcgggtatttaccgctctgggaatcggaattgtttttggattcgctttgcattttatatatggttcgtcttcagaaacgattacgcagacttctgattggtttaatatcgcaggcggcggctatgtcaagcttttgcagatgatcgttatgccgcttgtattcatctcgattttgggtgcttttacaaagcttaagctgacgcacaatatcggaaaaatcagcggattgatcatcgggctcttaatcgcgacgacagccgtcgctgctgcggtgggtatcgcgtccgcgcttgctttcgacctgcaggccgtccatgtggaccaaggccaggcggagacaatgagaggggcggaactcgaacagaaatcgcaggacatggaagccaaaacgcttccgcagcaaattgtcgagcttcttcctggaaatccgtttttagactttactggagcaagaccgacatcaacgatcgcagttgttatttttgcggctttccttgggatcgcttatctcggggtcaaccgaaaacagcctgaacaagctgaacttttcaaaaaaatggttgatgccgtgtatgcgatcattatgcgtgtggtcaccttaattctgaggttgacgccttacggtgtattggcgatcatgacaaaaacgattgcaacgagcgacctcgacagcattgccaaactcggcaaatttgtcatcgcttcatatgcggcgctgatcgtcatgttcatcattcacctgctgctcattacattcagcggtttaaatcctgtcacatacttgaaaaaggcgtttccagttcttgtattcgcgtttacatcaagatcaagcgcaggcgctttgccgctgaacattaaaacgcagcgaagccttggtgttccagaaggcattgcgaactttgccggatccttcggactgtccatcggtcaaaacggatgtgccggcatttaccctgcaatgctcgcgattatgatcgcgccgactgtcggccaaaatccgcttgatccgtcattcttgttcacggttatcgcagttgttgcgatcagctctttcggagtggcaggcgtcggcggaggtgcgacctttgcagcgcttctcgtcctttcggcattaaacatgcctgtagcgcttgccggacttctgatttctgttgagccgctgatcgacatggggcgtacggctctcaatgtcagcggcagcatgacgtcaggacttgtcacgagcaaagtgacaaatgagcttgaaaaagacacgtaccaagaccgtacaaatatcattgaagcagaagtgtaaaagaaaaacggcccgcacagcttgagagctcgtgcgggccgttttttatgaatagctttgatcgtcatcgaacatcgtctgagctgcagcctgatcgttcatgacattcaccggagcagtcatatggcttgattgatgctggtcatttgccgtatggcctgactggcggtgttcatgtgattgtcctcccggattaaaagcctgcttgatcatgtcagccggattcatcatcgtctgattgcggccgcttccttgctgccgtcctctcatgccattcgcgaacatgccggtcaatcttttgcggatttcgggagaaaaagccgcggttaatgcagctgatcctaaaactaatacagcgggatggatgccagatcttcttctaaacaaagggtcaacctcctttttacgtataccatccccagtcatgatcggttttattcttcaaccttggccgcgtgatataagcggtgcttttcaaaaaattcgaaaatggcgcggtagactttcattttattttcttttttggaaaaaccgtgcccttcattttccaaaacgagatactcgatattccgctccatgttcctcaactgatcgacgacctgatcggactcttcctttacgacgcgcggatcgtttgcgccttggatgatcagcatcggctgagtcatattctccagatatgtaacaggagaatcggctttcattttttcataatcccgctccggattgccgacccatttttccatcatcggctgccagaaatcaggtacggttttgacgaacgaaaacaggttgctgactccgcatatatcgacgacggcgcggaaatactcaggatgcctcccgtggagcaaaagcgacatatatcctccatagctgccgcccattaaaaagagtttttcgcggtctgcaagcttttgatcgataagccagtcgatgcccgcggtcatatcgaggcgcggcccgtctccccaatcttgttcaaccattttaaagaatgaataaccgtaattcgctgatcccctgaaattaggagcgaataactggtaacccatttttgcagcgagttgaaagagatcgtagaacataaaggtttctgcatcttgcggtccgccgtgcggccaaataatcgtccagccgttcgcttctaccggggagggcttaaacagcagtccttctattggcaggccatcaaaagaaggatatgtcacaacttcaggataagacagctcctgttcggagaaacccggaaccgaatgtttcgttaattgccgccattttgactgtcctttcgttaatacgtagagattagtcggcctggtcggcgttgagccgagaatgtacagcgtaccagaataggcgcagtgtattttcgaaatggatgtgcaagggcaatcgatctgccggctttgccccgttgctgtgttgtactcatacatcacctctttgacacctttttttccaatgagataaaggaaagttccattcgggtcagcgtggatggatgttaaatcagttttatcaatcgaaagcaccggcgtaaaaataccggatgaaacagtgtacaaggcaagatatgagaactcggcttcgtagtttgtcgtgacgaataaccgatcatcagatgcaaaatgggaagaataaaccatgtgaggcagcgtctcatccgggaagattcctgtcgtcacgccttcagctgtatggaccatacagacagaatggctgttgacatagtagacatgtatgctgacggctttctcgcccgggcttacatcagacagcattgaagttccgtcttttccttcaaaaataagctcttctttttcagtgagacaatcatatctgtatgtatttaaaaatgtcggattgtcctttgtagaggagtagtaaactgcgttttgcacagggatgggggcgaagtggcggtctgtttgatttccgtttaatgattggaacgtcccgttttttaaagaaagcttgtacagtccgctttgttcgtttccgtcattgtcaaaaccagcataaaggattgagccgtcgggattgtaggcaattccttttgagtcctgattcaagaatgacagctggtacgggtatgtatcgggaagatccatcgcccacaggttcgatgttccgttgaggtttgtatcaaaaataagctgagtctcatcgggatgtaccgcaaagtctttaatgcgcagcgcatgcaaaatgctatccgctttttccatttcatatacacctccggatttatttggatattttttcgtccgttatgatcataacaaaataagcgtataaaaaatatattttagacaaataaataacacgaaaaagaaaaaaactatacgtaaatcattaaaggaggcaattttaatgttcaatatgaaaaaaggcgcgattgctgctttgctccttccgctgctgttcacagccggatgcggcatggcaaaccaaggggcagataacaaccggcgcaatcaggacaatgcgcttcaaaatgtaacaaacagagataacgacgctacgaatgtcaatgacggcagaaatgtcaatgaccgaatgaatgtgacagacaaccgcgatgccaatcgtgaagacaataatatggaagtggcggataaagccgcagataaagtggcggaacttaaagaagtcagtagtgcaaacgtgattacgacaaaccgcaacgcttatgtcgcggtcgttttgaaaggcaatccgaaaggcaacttgacgaatgagctgaaagggaaaatctcgaaaaaggttaaagaaacagacaataacatcaacaatgtgttcgtttcggcaaaccctgactttgttgaccggatgagaaactatggcgacagaattcaaaatggcgaaccgatcgaaggactttttgaagaatttggtgaaacgatcaacagaatttttccgaatcaaagataatgaaaagccgcaatccgcggctttttttattggctgctttcagacagggcacttcctgaatcatcccgcatagagtgtagtacagaaaagtatgatgcggatggagggataataagtgacgggggagatgaaagcagcctttgttttaatcatggcgggcgctctatccgctctgttattggccatttttgtcgtgttcagccaagagagccctgaggcggctgtgctttcgggaaaaaaagaaaaactgaaagaatcgctggaaatggtcaaatatgaaagtgtcagcatttattacgctgaaaaagataggccgattctggagctgacaaaggagacgcttcgggatgccgctgatatgaatcgggaactgtttgtcagtcctcttcaagacagcgttgatttgatctttttttcaaaccgcgatgatatggagtcattttcaaaattaaaggatataaccggattttattcaaacgatatgaggatgatcgggcttttgcccgaggagaggaagcatctgaataacggcgagggattcgccgtcttcctgtacaaacgggtgctggtgcatgagtatacccattatgcttttcacgtcaagctgagagaactgaatgccgacccgggaacttatccgctctggtttcacgaaggagtagctgaatgggcttctgctcatgccgcgatagaaatccggactttgccttcagtcgtccccttgagcaagctgaagaccgaccggcaatggcaaaaagcccggactggatatgaaaccgatatttatttgcaaagttattatttgatcgaagagcttgcggagaaaaaaggaaggggcgtcatcctcgacattatcgaggaaacggctgagcggggaagttttgcagacggatttaaggccgccgtcggccagtcgttgacaggttttgagaaagaatttaaacgaaaatacgaagcgaaaaaaacggcgttgaagtttcatcttcaatgccgttttcatgatcaatgaataggtctctgctgcccgcttggaggcatttgcggctgaccttgcaccggagcgaatgctgaagtcatcttctgcatgtcttgcggcgcaagctgaggaacttgatagtacccgtgtttgttttgataaaggaaaatttcataagccatttcgatatagtgaggaatctggtctgccagaacccttctgcagacagggtttgtcacttcgggagccgccatggccagcgacgaacaacaagttttcatcaagccgagcataaagctgctgatgcaggcgtcatcaatagcctgcacagattgcttcggttgtttcggctgggcatcttttaaaccgtagacgaatttgcggtcctctttcatcatatacgttgccgtttcctgactcggcttttgccccgttctgaaacattctgtcgtaatgttgtactgagacgaaataaaccgatgctgcctgtccaaaatgtcgagcagctccggatctttgacatgctccctgaacatcatatactgctcaaggacgccgatcattccggacagcacttcatgcatgtcgaacacttcgtgccccccgtgattcatatgctgcataccttcattgccttgattgatctgcatttgcggctggttttgctgttccactctaacgtatcctccttaaatgtaattcaactattatatttcgtttttgccgctatgtttattcaaaaaaggaataatcgataatctggatttaaagggattttattctaaccgtcgaatagtttagttcagaagaaaatattatgggggtcttgtattcaagacagcacatcatatcattggtcgaaaatggggataacggtcatcttggcgccaaactgagcattaggagaggaaattcaggccgattttgaaatccctcgcacctttgtaaacggagcacaatctgccgggcgatgatgaaaagttcacgcgtgtttccggcagtttagaggaattcggtgagtatatggatatctgatatccgaaaaacaatagggccggaacatggccggattcaaataaaggctgccggaagaataaaagacaatgtcggtctgtgtgctcatgcaccttttgttcagaaacgaccgaaaaacaattgaatagcaatgcccggctcgatatcggcatgaaagcatctggcttctaatgcctgcaactttttattgcccctgcgtgatctgtaaaggattctccctccgtaaacgatttcagctgccaatcatcatgaaatgcaaaaaaggtgttttcctttttgattttgcacttagaaaaggaggagttttataatgctgggctcaagtgagacggttggaaaaaagtcaggtttatttggtaatgattctgtgtatccaaaggtgcaaacagaagtatataaaaaaatcaatgaactgagtggttttcataggctggatgatatttatctttccttgatcgacaagtatatgtttccttgtctgatcctgaatgaccggggagaaattgtcgcgtcctcggaaagtgctgatcaatatttgaaaagctcaaaaggcagcattcatcaggtttttcccgcgagcttatccgtacaggtcaatgccgcgttacagcgggcgaagaaagagaaaaaagaagtatcgtttaaaaacgtcccgatttatttaagcggagaactatcctttgttcatttgagattaaaatgtttcttccgccagtatcacaagctttatgtgctgtttatcgaaaaagcacaagaaggggcagccaacgcgccggtatccggcggagaggacggccagcttcatctgcaacatctgtaccggacggtaaaagagctcgaagcgtccaacgatgctttagtgtccgcaaatcaaaagctgcaggaggaaaacagaaaattgacggcgctcaacagggcgtttgaaaagaaagtgaacgagctgaacacccttaaaaatgatatgaacaatctgctgaccagcacgaacatcgccgcagtttttttggatcaggaattgaaattgaaattatttactccagaagccgccaatatgttcgacctgaaaaacgaggacctttcaagacctgccgataagctgacagagaggtttaagtatgaagggtatgccgatgacttaaggcgcacgctatatgaaaacaagacggtcgtaaaagagtttgaaatgccagacggcggctggtatgccgtaaaaatgatcccttattatacatcgggaaacatggttgaaggcattgttgtcacattcacgaatgtcactgagctgaaaatgacaaacgaggcgctgcatatcagctcacaagctatagatcaaagtccggccaacatattgatcacttcggtcgacggttcggtcacttatgcaaacaaacgcttttgccggatgttcggaaaacatcaggatgacatcatcggcggcaatgtgtttgatatttaccgcaagcattttcactgtgaggatctcactcgcttctggaaacgcgtccttgaaaagaaaccatggtcaggagaacttaattaccaggatgaggagcagcaggacaggtgggagcaaatctcccttgttcctgttgaggacagcgcggggaacgttcagcaggttatgctgatatccgaggacattacaaaccaaaagcgatctgaaaaaatgctcatgaaatcggaaatgctgtcggcggtcggccagctagctgccggaatcgctcatgaaatacggaacccgctcacttctctgaaagggtttctccagctgatgatccaatccaaaaaatatcaaaaagactatgcggaagtgatgatgtccgaattcatcaggcttgaagcaatcatcaacgaatttctcgtattggccaaaacgaaatcgaatacatttgatccggttcaggtcaactcgattgttgaagatgtctgcatggtattggagtcgcaggccgtgctgaacaacgtaaggatcgagaaacagctgagcggagatctacctgagattctcgctgtttcaaatgagctgaaacaggttttcatcaacatattaaaaaatgcaatcgaggcgatggaggatgctgaaggctttattacgatacgttcctattttgaaaaagacagcgtattcatcacctttgaagatcagggaaagggcatctcaaaagaagtgctagaaaagcttggggagccattttatacaacgaaggaaaaaggaaccggtctcggattaatggttacatttaaaattattgaaaatcacggcggaagcattcatttcgaaagcgaagaaggaaaaggaacgatcgtaaaattgaagcttccgattaaagaatgagaatgcggtcatccctattctcattcttttttgaaatttttacaaaaaaatcatatagcctttataatcatcagataaatttgacaggaagcaaaaaacgggaggcgaatatatggtcaatgttgtaaagagccgttttatggctggtttgacaatcacgtttatgatgattgcgtcttttttgacgccgtttgcggacgtaacgcacgcttcagaaacgatttcagtagaagaagccattaagcataacgaagggcatgcagccgttgaaggctatgtcgtcgggcacacaatatcgagcggccattatcgtttcagcggaaatttcgctaacgattataacgtcgcaatcgctgataaaaaggaggaaacatcacctgagaacatactccccgtgcagatacccgcacctttcagagaccagttcggtttaaagacaaaccctcatctcatcggaaaaaaactcatcatcgaaggcgaacgcactacatattttaattccccgggtttgaaatctgttcaatccatcacattttccggagacgatgcaccgtctgcccagccggagaccaaaacgatagccgaagcgcgcaagcttttaaatgaaacggtcaaaatcaaaggaatcgtcactgccgatcaggcggctgtcggaggaggaaagctgtccacatttatccaggacgatacggcgggaatcaatatctattccgctgcgcaaggcgattttccggaactaaaagagggtatgtctgtttcggtcacggggaaaatcacgacatacaaaggcttgacagaaatcgtacccgcaccgtcaggcattgaagtaaccggagaaggggcggcactgcccgaccctgttccgctgactattaaagatgtgctcgatcagggaaccgcagctgaatacgaaggccggcttgtgaggatgaaaggctttattgaaacaaagccggatgcgccggcaggcggcggctataatatcacaatgatcgatgaaaactatcatccgctcacactaagggtgatggaacaaacgaatgccgccgcttcgatagaacaaggacaatggtacgagattaccggcatattaagccgctatgattcggtgcagcttctgccgagaaaacaggaggatcttcggaaattagacggcgccgcgcatcctccccccgctgctgaaggggaatacgaaagcgttgtggaacgagtcgtcgacggggatacgatccacttaaaagagcctgttctcggatctacaaaagtccgctatgtcaacatagatacagccgaaacttatcataagccgaaaaatgaattagatgaaaaccagctgcagcacggaaacaaggcgaaggaatatttgcagtcgatattggccccgggagacaaagtcaccgtgaaagtgggcaaggaagcaaaagacagctacggccgcctgcttgcccaagtcatcactgaagacggcgtcaatacgaatttgcagcttgtccaaaaggggatggctgtaacctacttcatttggccggttggaagtgatgaagactatcaattgtttcaaaacgccgtcaaaaaggcgaaaggcgataaaatcggcatttggaatcccgctgatccgctcctcgaaatgccgtttgaatttcgcgacagggagcaaggcaaagggctgacgcggcatgtcggagactctgcggaaaatacgtatgtcgcgcctgaaaagtggcgggagattccggtggaaagacgaattttctttgcgtcggctgaagaagcggaagctgcgggctattcgaaaaaagagcaaagcggcaatattccgctgcgcctgttaagcatgaatgatctgcacggaaagatcgatcagcaatatcagctcgatctaaacggcgatggccggacggatggaacattcggcaggatggattatgcagcatcattgatcaaagagaaaaaagccgagcaggaaaacacgctgatcgtccacgcaggcgatatgatcggaggaagctcgccggtttcttccctgcttcaggacgagccgacagttgaagtcatggaggaaatcggatttgatgtaggaaccgtcgggaaccatgagtttgatgaagggaccgaagagctgctgcgcatgttgaacggaggcgaacaccctgaaggcaaagggacaaaaggttacgacggacaggatttcccgcttgtctgcgccaattgcaagttgaaggcaagcggggacagctttcttcctccatatgaaattattgaagttgaaggagtgcctgtcgcttttatcggcgttgtgacacaggcggccgccaatatggtcatgccagaaggaattcgctcaattgaatttacagatgaagcaaaggccgtcaaccaggctgcaaaagaactgagagcgaaaggtatccgggcaatagcggtgctcgcccatatgacagcttcacaggacggcggggttgtgaccggcgaatcagccgaacttgctaaaaaagcagatcccgagatcgatgtcatctttgccggccacaatcatgaagtggtcaacggccaagtcaatgatattttaatcgttcaagcatacgaatacgggaaggcaatcggtgtcgtcgatcttgaaatcgaccgggaaacgaaagacatcgttcacaagaaagcggaaatcgaatatgtgaatcaggaaaatctcaagcccgatccggcggtcggtcagatactggataaatatgagcggatggttgcgccgatcatcagcgagaaagtcggtgaggctgcgcacgatatggccggcggctattcaaatgacggagacacccctctcgggaatctgattgctgacggtatgcggcaagcgatgaattcagatttcgcattaatgaacgggggcggcatccgccaagatttaaaaaaaggaacgattacatggggagacttgttcaatatccagcctttcggcaatgtactcgtccggcttgaaattaaaggcagggatttatacgatattatagacgcgcaaatatccccatcttacggcccggattactcgatcagcggcttcgcttatacatgggacccgaaaacaaataaaaccgcggctatttttcttgaagacggaacaccgattgatttagaccaaacatatacgctgaccgtaaacaactttatggcatctgcttcaggaagcaagtatttgccgatttccaggcttggaaaaaatccggtcacaggtccggaagatatcgaagccacagtcaaatttgtcaaaagctttaaagaaccgatcgcttatactgccgaagggcgaatcaaaaaattagcagaagatgattcgcgtccgggagaacagcccggacgcggggctgatccagatgacaaagaaaaacccggaagcggaggcgctgatccgaatgacgaagaaaaaccgtctggtgataagggcgatggggggaaacccggcaatgacaccggagaaagtccggttcatgacggtaccggcaatgcttcaaggagcggcgctattcctgttgcgggcatgacgaccggtgaaggatcagatgcgcctgcggagaagatggacggtctgtcaaatgatgcgtttctgccagacgagcgtgaagagcgcaagctacccgatacggcggcagcttacggcggtttccttttatacggcttcctgacgtttatgttcggagcgattctttatatgcggaaaaggggtattgcgagactatgaaagtcaagatgttatcgtttctgctgatgatagcggggcttgccacttttgcatacggcggctggaaaatattcgatatgaacagacagacggatctttctttaactgaagcaaaagaagccattgcatcgagtcaatccgcccgttcggctaagcacccatcggcgcccgcttcatttaagcccgccgccggcgaagcggcaggcatactccatattcccaaactgggcgcagagcttcccatcgttgaagggaccagtcccgatgatttggaaaaaggcgtcggtcattataaaggcagctattatccaaaacaaaacgggcaaattgttctttcaggccacagggatacggtttttcgcagaacaggggagctggaaatcggagataagctgaaaatcgagcttccatacggaagcttcgaatatgaaatcacacacacgaaaattgttgaccaaagtgacacgtccatcatcacgctgcagcgtgaaaaagaagagctgctgttaacgacatgctatccgttttcttatatcggaaatgcgcctgagcgctatattatttatgcaaagccgctgaaaggatgacaaaatcccaaaacaaaaagccgttttgggattttgtcaacaatctgtaaggctgtcccatcgaggacagcttttttaccgtttaatcaaccgtgccgaacagtcgtccgatttcgtcttttaaatcatccggaagcggtgccgcgacagtgacacgttcttttgtgatcggatgggtgacattgatctcgattgcgtgaagagcctgtctctgaaaaagcccctttgaaccgccgtataaggtgtcgcctgacaaaggatgaccgatgcttgcaaggtgaacgcgtatttggtgggttcggcctgtctccagctgaagtctgcacagtgtaacatcgtgacggctgtcatatcctttcgattcaaaatgggtgacagcgggctgtccggaatgggacacccttcttctgacggggtggtgcttgtctctgccgattggcgccgaaatggttcccgttttttttctgaatttcccttccgctacggctacatatgtccgcgccagttcttttctttgcagctgttcgtctaaaagcgcgtgggcgaggcggtgctttgcaaaaacgacagcgccgctcgtatccttgtccagacggtggacgtgccggacttttcgctcctccccgttcatttgaaaataaaacgccacaaggttgctcagcgtgccggtctggccggcttcattcggatgagtcgccattcccgccggcttattgacaataagcatgtgatcatcttcaaacaggacgggaagttccccgtattcagggacgattccgctttcttcctcctctctgagatcgatcatcacgctgtctccgctctccagccgaacgttatgattcaccgatttatgattcactttaactttctcgtttgcgatccagtattgaatgacaggcttcgatgctttcgcctctctttttaaatatgcatataaaagttcgccgtgatgccgtatgtctgcactgaagaataagccgtgatttttttggttcatttttactgctcctttctgtaaaaagcgttcaggaattaggaaacacttacctccacagcccattgtttatgtatgctattctgtttgaagagatttgaacaagggatgaagggtgatcgatttgcgaattgtaaaggcagcaactgaagaacaagaaatttatatcgaagagcttgtatcagagctgtatcaaatatttccattgtacttgaataaacaaaaaataaaagaactcaaaaagcagggcgcgcttcaattgaaagaggatgaatacaaaggaacgctcgatgaagcgtttcagattatgacaagcctgcaattgatccatgcattattaactaaggcgaagcgcaagtgggtgctcaaagaccgtgatctgttcgataaaaatagccgcaagctgaatgactgcggtctgtacttccctctaacatctgccgactttcatatcgtgaataccgagaataaaatgctgatgtaaaaagccggctaactgaagtgaaagagcttgttccaaatcggaaaaagctcttctttttatgaaaagatgatataagaaaaaagcggaaaacacaatgaaatggtgccaacttcctttttagcatgtgcatgacctgtacatactaacaaccgaaaggggtgcagtctattgacgacaatcagcaatgcgatgtctagacaagtggcgacaatttcttccaatcaaacggttcaagaagcggctgagttgatgagccgccataatgtaggtgcgattccggtcgtagatcaaggcgtattaaaaggcatgatcacagaccgtgatatcacgctcagaacgacagcggaaggccaggacggacagacacctgtttcaaacgtcatgacaacaaatgttgtttcaggaaatccgaacatgagccttgaagaagcatcacagctgatggctcaaagccaaatccgccgtctcccgatcgtcgaaaacaaccatttagtcggcattttggcgctcggggatctggcggtaaacgaattgtccaatgaatctgccggacaggcgcttgcgaacatttccactccggcacggactcagtaagaacggaagagcttgcctcttacagcaggctcttcttcatttatacataccggtttttagtgtcttctcttttcaaggagcggcaagaaggatacaatgaatggtgcaaacagtcaaaaggagttgggctaaagcgcaatgattaaagcagtgatttttgattttgacggtcttattttagatacagaaacgcacgaatatgaagtgctccaggaaatttttgaagagcacggctcagagctgccaatgtcggtttggggaaatgtcatcggcacggccgccggattccagccgttttcttatctggaggaacagctgcaaaaaaaactggaccatgaacaactaacgaaattgagacaagagcgttttacgaaaagaatggaaaatgaaaaagcgcgcccaggtgtggaagcttatttgtccgcggcgaaagagctcggtttaaaaatcgggctggcgtcaagctcagattataaatgggtgtcccagcatttaaaacaaatcggtctgtacgatgatttcgaatgcatcagaacggccgatgatgttgaggaagtcaaaccgaacccggaactctatttgaaagcggcggaatgcctcggtgtgaagcctgaggagtgcattgcattcgaagactctgtcaacggatcaatcgccgcgaaaagagccggaatgaaatgtgtcattgtaccgaataaagtaacgaaaagcctgctgttcgagcattatgaccaccgcctggaatcaatggcggaaatggagctggaacagctgatcgaaaaaatctccgatccatcataaaagccagaggaggaatgggacgtgtccgaaaaactggatctttcccgctttgaaaaaaagatcgtcatccgcaatattgaagaaaaagatatcgacagcatcatcgggcttcaagagctttgttttccgggaatgatcccatggaaacgggagcatctggaaagccatttggaacacttcccggaaggccagttttgcgcagagcttgacggagaagtgatcggttcctgttcaagcctgttgatcaactttgatgaatatgacgacagacatacatggcaggatattacagacgacgggtatattacgaatcacaatcccgacggcttaaacatgtacggcatcgaggtcatggttcatcccgaatacagacggatgaagatcggccaccgtctctatgaagcgcgaaaagatctggcaaggcgcttgaatttaaagagcattatcatcggcggcagaattccgaactatcataagtacgcttccgagatgacgccgagggagtatgtcgaacaggtcatccaccaccagatatatgatccggtcctttcgttccagctgctgaacggattcaccatgatgcggatcaacccgaactatctcccggatgacagagcatcaagcaaatatgcgacattgatggagtggaataatgtcgactacttgccgcagacgaagcgctattacaaatcagcttttccggtgagaatatgcgtgattcaatatgaaatgaagcagatccattccttcgaggagttcgccaaccaagtcgaatactatgcagatgtggcttcagacgcaggagcggattttgccgtctatccggaaatctttacgacgcagctgatgtcgtttctggaagagcgctcaccgagcctggccgttcagcggattaccgaatatacagaagactatatcagcctgttcacagaccttgccgttaaatacaatgtcaacattatcggcggttcccacttcgttgaagaagaaggaaagatctacaatatcgcttacttgttcagaagggacggaaccatcgaaaagcaatataagctccatattaccccgaatgaacgaaaatggtggggcatcagcaggggggacgaagtgcgcgtctttgacacagactgcggcaaaatcgcgatccagatctgctatgacatcgagtttccggagctaggcagaatcgcaaccgaaaaaggggccaagattatttttacccctttctgcacggaagaccgccaaggctatttgcgagtcaggtactgcgctcaagcaagagcggttgaaaaccaggtgtacacggttatttccggaacggtcggcaatctgccgcaaaccgaaaatatggatattcaatacgcgcaatccgcgattttcgctccttcagattttgaatttgcaagggatggaatcgtcggcgaatgcaatccgaacattgagatggtggtcatcggcgatgtcgacctggaaattctcagaagacagcggcaggacggaacggtccggcagctcaaggacagacgccatgacatctacaggattcattataaaaaatagcagattcgggtgccggccgcttgaggccggctttttcctgttgactttcagctttatttttcatatattgtaactattaaaaggaggtggaaaagatgaatcaaactggtaagcgcatgacggatatgcaagcccatctgtatatttgtcgcgcgattttttccggggaatgcgtattacgggatcagtctgcccttttttacacattcaattggaaaaaataccagtgagagacatctgcccacaatcggattttctgatgctgacggcggggtgtaagctctgccgtctttttaatgctcggtgtctcttcacgggatgcggaggaaagatggatgattatatgcagtttgcaacatgtcggtcaaacttacggaggacatacgattttcaacgggctgtcatgggacctgcaccaaggggagcgcgtcggtctgatcggacgaaatggggaagggaaaacgacgttgttgaagctgatcagcggccaaatgaaacctgatgaaggtcttgtgacatggaaaaaaggattatcaacagggctcttggagcagaatcccgcatgggacggcagcaaaacggtaaaagagctgctgtatgatgttttttcatcattatggaacacacagcagaagctttcccggatcgaacgtcaattggcggttgaaaaggacgcggaaaaactcagattccttttggaaaagtacggggctttgcaggatgaatttcagcgaaaaggcggctacggcatcagcgcgcaaatcgaacgggtggcgcacggcttgaatatcgagcggctattcgatgccgagtggcgggagttaagcggaggcgaacggacgaaagcgggtcttgcaaggcttctcctgtcagctccggatctgcttttgctggatgagccgacaaaccatttggatttaacatcgatcgaatggctgacgtcttttttaaagcagtacaaaggtactgcggtcattgtgtcgcatgatcgctatttcctggatgaatcggttacttcgattctcgaaatcgaccaaggagagcttcacttttcaaaaggcggctatacacactatgctgatgaacgggaagagcgccttatgagagaatttcatgactatcaggatcagcagaagaaaatcaaaaaaatgaaggaaacaatcaagcggctgaaggaatgggcgaatcgcgccaatcctccgaatgacggcctgcaccgaagagcgaaaagtatggaaaaagctttggagcgcatggagaaggtgaaaaaacccgttctggaacgcaaaaagatcgacttagttttcagcatggatgaacgaagcggaaaagatgttgtcaggcttgaggatgtctgcaaaagcttcggtgagcggcagctttttgacaatctcagtatgcatgtccgttttcaggagcgcgccgccatcgtcggagagaacggcagcggcaaaacgacgctgctcaacatcatcagcggaaaggaaacgccggacagcggtgacgtgcagcttggcagcaatttatcggccgcatatctgactcagcatgtcggtgaaatggaggaagagcgcaccgttttagccgaattccgtgaacatgtttctgcatcagaaggcgaagccagaatgatgcttgcaaagtttttgtttttcggccaatccgtcttccgaaaagtgaaagatttaagcggaggcgaacggatgcggcttcgcttggcacagctcgttcaccaaaatcataatgtgctgatcctcgatgagccgacaaaccatttggacatcgaatctaaggagatgcttgaagaagcattaagccaatttcaagggacgattattgcggtttcgcatgacaggtactttcttgaccggcttttcaatgtcatctggtggcttgacggcagaaaactcgtcaagtatgaaggaaactatacattcgcaagggagaagcggcagcagggttgacacatttttatcacatttgataagatgttgctacagttatagaagacaaaagcaatggaatgtatgcacgaactgtatatattctctttcaatattttaattctgcttgattttgttgtatgggtatgcatacaagttaggcagcattcgaacgcctgttgacacaggttatttgagtgctgcctttttttattgtctttctgccataactgtgagaaaagaagggataatggaggggtttagttagtatggcttttcgaaaaccggatgaaatagcgaatgcagcaattgaagcagggatgaaaaaagtacagctcccgctgccgtctctgcttgtattggggtttttaggcggcgcatttatcgcgcttggttatttgcttgatatcagggtaatcggcgacctgccgaaagaatggggaagcctgtccagcctgatcggagctgccgtatttcctgtcggtctgatactggtggtgctcgctggcgctgaattgatcacagggaatatgatgtccgttgcgatggctttattttcaagaaaaatatcactaaaacaattggcggttaactggggaatcgtcacgattatgaacttaatcggcgcactgtttgttgcttactttttcggacatttggttggattgactgaaacaggcccttatttagaaaaaacgatcgccgttgcacaaggaaaactagatatgagcttcggcaaggttctcatttccggcatcggctgtaactggcttgtatgtcttgcggtatggctttctttcggcgcacaagacggagcagggaaaatccttggcatctggttcccaattatggcgtttgtggccatcggatttcagcacgttgtcgccaacatgtttgtgattcccgcagccatttttgcaggctcattcacctgggggcagtttatcggaaacatcattcctgcttttatcggcaatgtcatcggcggagcggtgtttgtcggtctcatttattttattgcatatcctaagaaagaccgctccagaaaagaaatgaagcaggtatcatgaacaaagggcaaatccgctcgataaaacataaaaacgccatttttataaaaagatgattaaaaatagaaattggcggtatgtcccgcaggcagtagaggcattggtgtcttcttttgtctgcggtttttatttgcctgcggcagcttcggttgaagcggatttgagaggggctgagcgatatgatgattaacaaacggtttaaaaatccgtaagaattcgaaccgagatcagctacagtacgactgatccggaaagtggaggggtttttacttagaccaccgaacaacggatatggacattcgccgatgcctatgtcccgcctggaaatgcccatgatttctgtgccctgtcttgaccggttggatcaccaaattgctcctcacagccgcatgccagaacatgaagtagattgcatttacctagccaagcggagttaggtatgtgggagctcttactgtatttaaaatccgatgaatacctagagaaacaccgttgaaaacaaacgggtttttctatatgattgatagtattaatgagaacggttatacataaaaagaaggtgcatcatggagtttctgtttgttttactgccggttttcgggatatttgcgatcgggttcatcggacaaaagctgcttcattttgatattcagaacctatcgaaaatgtccctgtatttaatgtctccgtttttagcgtttgatacgttttatgagaacaagctgacgatggattatatttatatgtctgtctattgtctcggcctctgtttaactttgattctatttgtctacctcatttcatatgttcacggatattccaatcaggagcggtgcgctctcgttttatcatccgctttcatgaataacggaaactacggaactcccgtcgtcctgcttgtctacggcacggccgggcttgatatcgccgttgtgctgatggttcttcagcagcttgtcatgagcacgattggcatgtattacgcagcgaaaggaagcccagaagcgggcggatttaaaatcgtgatgacgagggttatccggatgccggtcgcatacggtgcgctgctcggcatatgctttcagctggggcatatttcgattcccgaacagttaatgacaggaattaaattggtgggagatgccgcgattccgacgattatgattattctcggcatgcagcttgcggtgatttcctttcaacatatcgaataccggaaaatttcttactcgcttttgctgaaattattcgtgtctccgctcattgccctggggtttgcgctgattcttccggtcgacgggctggtcaaacagatcatggtgttggcggcggccatgccgacggcggcgaacacgactttgatggccgtacagtttgaaacaaagccggaaatcgtttcaagcgcgacttttatcagtacaatgctcagcatcgccacccttccggtggtgctgtggctgctttcattatggggctgacctgaatttttctttcggcggccttttttctggcgataacaaagggaagcttgcaccgcttaaaaaacggcggctgatgacaagggaagccgccgtttcctgagtttacccgtctatttgcaatgcgatatttccaaactgctccccgtctttcatccgtttaaaggccggaaccgcttctgataaaggaaatacttgatcgatcaccggcttaagggaatggcgttcgataaaatcaatcatttgccgaaattcttcgaggctgcccatcgaagtgccgatgatgctgatctgcgggaaaaagagcgagcgcagcggaagctggatactttctccagagctggcaccgaaaatgacgatccttccgttcggtttaatgacatcgaaataatttgcaaaagtggcgggaccgatgctgtcgagaattaaatcgacccgttccccatccaagctttccttccacaggccgcggctgtcaattgcgaagtccgccccatagcggagcgcttcttttcttttttcttcgcttcgggaggttacaatcacccgcgcgcccgcggcctttgccatgagcagcgcatttgtggcgacgcctccgccggctcccggtatgagaatgtgttcgcctttttctaaatgtcctttcgtaaataaagccctgtaagcggtcagagcggataaaggcaggacgcctgcttcctcccaggaaaggtgcgccggctttttcaacacgtgcttcgccgggacgatgacatgctctgcgaaagtcccgtcagaggggccgccgagaatgtccggcacttgcggaacggaatccgtatattcccagccgatgctcggattgatgatcacctctgtatgaacggcgaggtcccgaacgccttcacctgtctcttcgatcatacctgctccgtcggatccgggaataaacggggcatcgcctgcctttctggactgaaaaaggaacaagtcgcggtggttcagcccggctgctttcagcctgattttgacttcaccggggccgggcgttttgtcggaaacgtctgtatatttcagccctgaaaggcccttgattccttcatggatgatcgctttcataaaaaaattccccccattcgagttggttgtgttaaattatggacatgaatgaaggtaaatgtaaaatgatttgcccggggccgcttagaggccttctgttttataaaggattgcaatgaggcggaaattccattagtgtaatacagaagcaagctagcaagtgaaggagatggaacatgagttttcacgatcaaaatattttacctgcggtacgcaatatgaagcagttcgatacattcctggacagccctttttcatacggggtgctgcttgacatccatcttggacagctgggaggcgtgatcagcgcggcaagatcccatgggaaaaaaatgtttgttcacgtcgatctgatccaaggaattaagcatgatgaatacggtgcggaattcatttgccaggaaatgaaaccggcgggcattctttctacgagatcaagcgttatcgccaaagcaaagcagaagaaagtgtatgcgatccagcgcatgtttttaatagacacaagcgccatgaagaagagcattgaattggtgaaaaagcacagacccgactatatagaagtgcttcccggagtagtgccggaattgatcagggaagtcaaagaaataaccggcattccgatctttgcgggcgggtttatccgtaccgaaaaagacgtcgagcaggcgcttgcagcaggggcgtccgcagtcaccacctcagacactgatttatggaaaaaatactggaactaaaaatttaaaatgtgaaaaattattgacaacgctttcactatacgatacgatcttactaagttaatacattgtgacggagacccggagaccacagcagttctttactcagtatgatgtaaagaaagtttgctgtgtttttttatggtcttttagacacagtggagaaggtgaacttatggcgttcatctattagaataatacttcataatagattttaggagggatagccttgacagcattttggggggaagttatcggaacgatgctgctcatcgtctttggagctggagtttgtgcaggagttaatttgaaaaaatcgctgtcccatcaatccggatggattgtgatcgtcttcggctgggggcttggcgtggccatggcggtatatgccgtcggcggcatcagcggagcgcatttaaatccggccgttacattggggctggcatttgtcggagattttccttgggaagaagtgccttcatatattttgggacagatgatcggcgcatttttaggagcggtgctcgtttttcttcactacttgccgcactggaaagaaaccgaggatcaaggcgcgaagcttggagtattttcgacaggtccggcgattccaaatacatttgcaaacctgttcagtgaaacattggggacttttattctcgttctcggacttttaacgatcggtgcaaacaagtttactgacggactgaatcctcttgttgtcggatttctgatcgtggcgatcggtatctcgctcggcggaacaacaggctatgcgattaaccctgcccgcgatctggggccgagaattgcccattttgtccttccgattgcaggcaaagggagttcaaactggaagtacgcgtggatccctgttttaggaccggcgcttggcggttcatttgcaggcgttttttacaacgccgtattcaaagggcatatcacaaacacattttggattgtaagcgttatactagttgtgatattgttaggtttctatattcatatgaaaaaacaagcagttgatcaatcggtcaacatttaaaaaaaacgcaatcttaacagacatataagggggagtttcaaaatggaaaagtacattttgtctcttgatcaaggcaccacaagcacaagggcgattgttttcaacaaagcaggcgaaatcgtccatattgcgcaaaaggaattccggcaatattttccaaaccctggctgggttgaacacaatgcaaacgaaatctggggctctgttctgtcggtgatcgcttcagcgctttcagaatcggggatcgaagccggacaaattgccggaatcgggatcacaaaccagcgggaaacgaccgtggtttgggataaacataccggcaaaccggtctacaacgcgattgtgtggcagtcccgccaatcggctgagatatgccaggaattaaaagagaaaggctatgaagagacgatcagagaaaaaacagggcttttaatcgatccttatttttcaggcacgaaagtgaaatggatcctggatcatgtggaaggggcaagggagaaagccgaaaacggcgaccttctcttcggtacgatcgattcttggctgatctggaaaatgtccggcggaaaagcgcatgtgacagattattcaaacgcctcaagaacattgatgttcaacatctatgacctaaaatgggatgatgaacttctcgatattctcggcgtgccgaaatcgatgcttccggaagtcaagccttcatcgcatgtatacgctgaaacggtcgattatcatttcttcggcaaaaacattccgattgcaggtgcagccggcgaccagcaggcagcattgttcgggcaggcttgctttgaagaaggaatggttaagaacacgtatggaacaggctgctttatgctgatgaacaccggcgagaaagcgattaaatcagagcacggcctgctgacgacaatcgcttggggcatcgacggaaaggtggaatatgcgctggaaggcagcgtcttcgtcgcgggttccgctattcaatggctgcgtgatgggctgagaatgtttaaagacgccaaagaaagtgaaaaatacgctgtaagagcagaatctgccgatggtgtttatgtggtccctgcatttgtaggtttaggcacgccttattgggacagcgatgtccgcggcgctgtattcggactgacccggggtacgacgaaagagcattttatcagagcaacgcttgaagcgcttgcctatcaaacgaaagacgtgctggacgcaatgaaggaagactccgggatcccggttaaaacgctgagagtcgacggcggagctgtcaaaaacaacttcctgatggattttcagggcgacattttagatgtccctgtagaacgtcctgaaatcaatgaaacaacagcgcttggttcagcctatttagcgggccttgctgtcggcttctggagcgatcgttccgagatcaaagaccagtggcagcttgacaaacgttttgaaccgaaaatggaagaaaaagagcgtgagagcctgtacaacgggtggaagaaagctgtaaatgcagctagggcttttaaataagctgcatgtatgttacaatctaattaagttaatagaaacggttggagaagaggagagaccgcagacaccaaagcagtatcagcgctttggatgtttgtggtctctttttctattttttaccgtgacaacaagggaggacatgaaacatggaatcattattttcaagccgtaaacgggacgacattttacagaatatgacaaagcagaagtatgacgtgtttattatcggcggaggtattactggggcagggacggcattggatgccgcatcgcgcggaatgaaaacggcgctttgcgaaatgcaggactttgcagccggaacgtcaagccgttccacgaaacttgtacacggcgggcttcgctatttaaagcaatttgaagtgaaaatggtagccgaggtcggcaaagagcgggcgatcgtctatgaaaacgggccgcacgttacaacgcccgaatggatgctgcttccgatgcataagggagggactttcggcaaattcagcacttcaatcggactgagggtgtacgactttttggcaggcgtcaaaaaagctgagcggaggagcatgctgactgccgaagaaacgcttcaaaaagagccgctcgtgaaaaagaacggcctgaagggcggcggctattatgtcgaataccggacggatgatgccagattgacgatcgaagtcatgaaagaagccgttaaattcggagccgaggccgtcaattatgcaaaagtaagcgattttatatatgaaaacggcaaggtcaccggcgtggtcattgaagacgtcttcacgaaaaaaacgtaccgcgtctacgcgaaaaaaattgtcaatgccgcggggccgtgggtcgaccgtctgcgggaaaaagaccattcaaaagaaggcaaacaccttcagcatacaaaaggcgtgcatcttgtttttgatcaatcggtctttcctttaaaacaagccgtttattttgatacgcctgacggccgcatggtgttcgccattccgagagacggaaaggcatatgtcggcacaacagacaccgtctacaacgagaatttggaacaccctcgaatgacgacagcagacagggattatgtcatcaatgcaatcaactatatgttccctgaacttggaatcaaagccgaagatgtcgaatcaagctgggctggcctcagaccgctgattcatgaagaaggaaaagacccgtccgagatttcccgaaaagatgagatctggacttctgaatccggactgatcacgatcgccggcggaaagctgacaggctacagaaaaatggctgagcatatcgtcgatcttgtcagagaccgattaaaagaagagggcgacagagacttcgggccttgcagaacaaaaacgatgccgatttcaggcggccatatcggcggctccaaaaatctggaggcttttattcaagcgaaagcagccgaagggattgaggccggactgtccgaagagacggccaaacaaatcgccgcacgatacggttcgaacgcagaccgcctgtttgatcgtattccatcgctgaaagatgaagcagcaaaacgccgcatccctgtccatgtactagcagaaatggattacgggatcgaggaagaaatggcagccgtcccggcagacttcttcgtccgcagaaccggtgcgctgttctttgacatcaattgggtccgcacttacaaagagagccttacggactacatgagcgagaagctgaactgggatggcgaaacgaaggcccggcatgtcaaggcattggaaggactactacacgatgctgttgtcccgctggaaagcaaatgatttattaggtcaaataaccttggtgaattttcgttaataatcaatcgaatggcccggcgtgaggctgtcttgaacaggcagcctcatttttttcatttggcatgctaaatttggacaaagcggcggtttgtcgatatgataaaagaaaagctgcaattacttagctagaacattggaggtaatcatgagctggagaacgagctatgaacgctggagaaacaaagaaaacttagattccgaattaaaagcgcttcttttggaagcggaaggaaatgaaaaagaactagaggattgcttttataaaaaacttgagtttggtacagccggtatgcgcggtgagatcggaccgggcccgaaccgcatgaacgtttatacggttcgcaaagcatcggcgggccttgccgcatacataggagcgaacggcggcgaagcaaaaaagcgcggcgttgtgatcgcgtacgattcccgccacaaatcgcctgaatttgcaatggaagctgctaagacgctcgcagaaaacggcgttcaaacgtacgtgtttgacgaactgcgcccgacacctgaactttcctttgcggtaagagaactgaatgcgtttgcaggtattgtcatcacggcgagccataacccgcctgaatacaacggctataaagtgtacggagaggacggcgcgcagcttccgcctgctgatgccgacaaactcaccggctatgtcaatgcgatagaaaacgaactggaaatcgaagccggagatgaagctgctttaaccgaaaaagggctgattaaaataatcggcgaggaaatcgatcaagcgtatctcgataaactgacatcgatttctgtcaaccctgatctggcaaaggagaccgaagtcaaagtcatcttcaccccgcttcacggcacggcaaacaagtctgtcagacggggcctgaaagctctcgggtatgaacatgtcacagtcgtccccgaacaggagctccctgaccctgacttttcgaccgtatcttctccgaatccggaagagcacgccgcttttgaatatgcgatcagactaggagaagaaaatggagccgacattctgatcggaaccgatccagacgcagaccggctcggcgtcgctgtaaaggatcaagaaggccgctacgtagtgctgacaggaaatcaaaccggcgcgctgctcctgcattatctgctgtcgcaaaaacagcagaaaggcatgctgcctgataacggcgtcgttctgaaaacgattgtgacgagcgaaatggggcgcgacatcgccgcttctttcggactggacacgatcgacacgctgaccggctttaaattcatcggagaaaaaatcaaacaatttgaagcatcgggcgaatatgctttccaattcggttatgaggaaagctacggctacttgatcggcgacttcgcaagggacaaggatgccgtccaggccgcactgcttgccgttgaagtatgcgccttctataaaaagcagggaaaatcgctttatgacgggctcctcgaattgtataaatcgttcggcttctatagagaaggcttgaagtccctgaccttaaaaggaaaagagggagcggagcaaatcgcagccatcctcagcacattcagagaacagccgcctctttccatcgccggaaaagatgtcgtatccgccgaagactatttgacagggaagcggacgctgctaaaggaaaacaaaagggaaacgatcgaccttccgaaatccaatgttttgaaatatttccttgaagacggctcatggttctgcctccgtccatcaggaacagagcctaaagtgaaattttatttcgcggtcaaaggccgaaccaatgaagaaagcgaagcgcttctcaatcaattgacagacgaagtgatgaaaaaaatcgacgatattgtaaaagcgacctcaaattcgtaatcgctgaaaacccgcctttaaatggcgggtttttttattgtgaagagacgatgaatgatgtaatatatatttaacattaggtcatatataaattgcatattgaaaggagagaatgactgatatgaaatggatcaaaatcggggatgaatacatagaaaagaaaatgacgcaatttttcagcgaagccggtacgattgtcgctgccattttatgtttggatatgatcatccgcggctttattttaggaaaacctgcatccgaatacatcatcagtgccatcggttttgcggtctatgcaggctggattttgctccgctatcttttgtcgggatttgaatatccggagatcgcaggccaatcggcgtatcggaaaaaaagaaaagaaatcgcagccctcagcctcgcttccggcctcatatttgctattttaacgcttctctttaccggcataccagagcatcccggcagttgggttgactttattggtatggtgatgttgtttgcattccttcattttctgatcaactttatctcgttgcgcaattcctttcggaaaaatcaagatctattagatgattaaatcaaaacggcaggtgagcatatggttaaccgggtcaaactcgcccggatcgaaaagtctttgacacaagcccagctcgccgagcgggtcaatgtgacaaggcagacgatcgggctgatcgaaaaaaataaatacaatccgacattgcagctctgcatcgcgatcgcaaaggcattagacaaaacgcttgacgatttgttttgggaagaaaaagcctaaggatgagctttgccctttctcggtcaaaagtcttagaaaagatcatctcatgagggcgggcttttttttatcaactatcggtataatgaaagaaactccggtttaaggggatgaaacttttgcgggaagacacacagtttgaaaaactgaaaacgctcaaagaaatagcggaaactttaaacgaagggaacgatctaaaggaaacgctccatgccgttttaaagaagctgctccgcctaacgggactcaaaacggcatggctttttctgatcgatgaaaaggggagctttgaactggctgcttcggcccgcctgcctcaagccctttcttaccggcaaaaccgtttactatgcgaaggaagctgctactgtcttgaacaatacagggacgaaaagctggacagggcgaaaaatatcatccactgccggcggattacgacggccatgaaacagaagacaggagatccggaaggcatcacccatcatgcaaccgtcccgctcagtgaccaaaagaagcggttcggtttgctgaacgttgcggcaccgggcaaaattcatttcagccgcggggaactggcgctcctcgaagctgttgctctgcaaatcgggatggcgatcaaacggatgaggcttgctgaacaacagcaaaaacacctgctgctgaccgaaagaaacagattggctcaggacttgcatgattccgttaatcaaatgcttttttcgctcagcttgaccgctaaagcggcgggggaaatgacagaccagccggaaatcagggaaatgctcgagtttatgcaaaatctttctcatgaagcgcttcttgagatgcgggcgttaatttggcagctcaggccccaggggctggaagaagggttagcggcggctcttgaaaaatatgcggaagtgctcggccttcaagtaatcttcaagctcagcgatgtgctccgtctgcccccttctgttgaggaattgatgtggcggctgagccaggaagccctcaacaattgcaaaaagcatgccggtgcaagccgcatacaagtgaaaatcaatgtattccagtcgtctgccgtcttggaaatcgaagatgacggcaaagggtttcagtacgatcctaatgtggacattccgacgcttgggctgaaaggaatgaaggagcggacggaaaaagcgggcggcacgcttttgatcacctccgcaatcggtaaggggacaaaaatccgggcggttttgcctatgaaggagaagggggaggcaggatggagaaggtgaaaatcatcattgccgatgatcatcatattgtcagaaaagggctcttgtttttcttcaaaacaaaaagcgattttgatgttatcggagaggcttcgacaggtatcgaggcgctcgatgtcttgcgaaaacgtgaggcagacatcgtattaatggatttatcaatgcctgatatggacggcattgaggcgacaaagcgaataaaaaaggaatatccgtctgtcaaagtcatagcgctgacaagctatgcggacgagagctatgtgattcccgccatccaggcgggagcctgtgcctatcagctgaaagacgccgagcctgatgaacttgtcgagacgatccgcgcagtttatggcgggagatactcattggatccgaacatcatgtcccacgtctttcaccatgtgtcacaggcggatgagaaagaaaaaatacatcaattgacaaatagagaaaaagatgttttattggaaattacgaaagggaaaagcaataaagaaattgcagcatctttatttatcagcgaaaaaacggtaaaaacccatgtatccaatctgctttcaaagcttggcttatccgatcgcacgcaagccgcgctttttgcagtaaaacacggactacaacaaaatgacgggagaggatgaccaaatgaaaataaccgtaattagcggaactgcgagaaaacagggcagaacgcggatcgccgcttcctatatcgcccgcgcttatcaggctgagcttatcgatctaagcgagttcatccttccgattttcaacggagacgaagagcaaagctcgctggagaatgttcaaaaattgaaagcttcggtcaaagaagcagacgctgtcgttttattatctcccgaataccacagcggtatgagcggcgctttgaaaaatgcactcgattttttaagcaatgagcagttctcgggcaaaccggtggcgctttttgcttgtgcagggggcggcaaaggcgggatgaacgcgctcgccaatatgcgcattgtcgcacgcggagtttatgcgaacgtcatcacaaagcagcttgtgctcgatccgattcatattgatgaggagcaccaaacggttactgaagcagccaaagccaatattaaaaatgtaatggaagagcttctgctctttgccgaatttcaaaaagcctgacgccgacagagcgccaggcttattttattttacgtaaagacaagcacgccgttttcgtgttcatgtccggaaaatgaggcgtgatcaatatactgcagcagatcataaagccttttttcgacaatggcgtcatctctttcaaaattgtaggcgtgcaaaaaatgttcgatccgctttgataataaatcgtcttctgtccgcaccatcaggatcagcaggttgtcccactgcgaccggtgcgtatagtacaaagctttgtcataatcagcgtaattcaatttcgccactctccattctttctgaggagtcatgcttattttatgtggcggggtgtttttttctccgggcaaaacttggtctcccttgtttggcggcctagaaatatgaggatggtatatgcagaccgcgaaaaatgtctgcatgacattcgccgtttacggtcaagctaacgtatgtacaatacatgcggagcgaatagaaatgaaaaaacgatattgcacgtactttttttgcatattaacacttttatcattcccggcgaaaggccactttcaaacagatgttttcgatgcacctgaacggtgggaaagaatcgcctggagcgcgcttgaagaaaaatacaaaggcgcaaagctcgaggattatgaatatttagggcgcacacaagtaaatgatgaagagacaaaggatgtcttcagggtaaccgtcaatcaagaaggcaaatcattttcggcgcacgccgaggtgtattttcatccggtgaccaatgcgatcatcaatgtcaatatttttcccttatagcaaaaaaaacgaaggaaaccgtttccttcgtcaactcaataatttacgtatatggtcctgattcatgataatatcttgcagagtgtattggtccaatacgtccaaataggcggaaagggctttgtttaaaacatgctttaatccgcagatcggagaaagtatacaatggtttttttctccgttaaaacactcgacaaggttaaaatcatcttctgtatgtcttatgacttcaccgatattaatcagttcaggcgcttttccgagacgaatcccgccgttgcggccgcggatcgtttcaacgtagccaagcttgccaagctcgtaaatcaccttcataaggtggttttttgaaatggaataagaatcggcgatgtctttaatattgacaagctcgtttgagtttttggttgctagaaaaatcagtaccctcaatgagtaatccgtataatttgttaatttcatcgcatgacctcaatcaaacaagtttccattatcttatcacatttgccttcgattatgagggtcgagcggaaattgttacaaaaatataaaacattcattgataatattgctttaattccattaaaagtctagtataaagatgtatctaaaatacatctttaatcaaaagtaacagtcctatttaaaaaagatcttattgcacctttaaagatgtatttcaaatacatttttaaagtgactggagaggagcaggcgttatgctatctgaaaaaaccatgcaaattgtcaaatcgaccgcccctgttttaaaagaaaagggaacagagatcaccacttgtttttacaagcggatgtttgatgcccaccctgaattgaaaaacattttcaacatgtcccgacagcaaaccggcggacagccgaaagctttggcttttactgtgctgcaggcggctgaaaacatcgaccggctcgaagacctgctgccggttgtcaagcagatcggacataaacacaaaagtttgcatgtgaaaccagagcactatcctattgtcggtcagcaccttttggaagcaattgaaatcgtgctcggcgaagctgcgacagaggacattctccaggcatgggcagaagcctatgaagagatcgcccgtgtatttattgaagtcgaaaaacaaatgtatgaggaagacaaaaagcaggatggaaattgggaagggtttaaaccgtttgtcatcatggataaacgagtcgaatccgatacgataacctccttttatttgaagcccgccgatggaacggctttgcccgctttcagccccggacagtacgtatctgtctgcattaaaattccgggcgaaccatatttcttaacaaggcagtacagcttgtcagatgcttggaataaagactactaccgcatttcagtcaaattggaagcggaggaaggccaaccggtgggaaaggtatcaagctatctgcatgagaacatggaaatcggcggcagcttggaagtgagcgctcccgccggagatttcacactttccgaaggaacggatcgtccggtttatttcattagcgccggatcaggcatcacgcctgtcatgagcatggtgcaaacgttggctcaaaaagaaagccgccgcgagatcacattcgtgcatgccgcgaaaactgaacggcatcacgctttcaaggaagaaacggagaagctgctcggcgccaatccggcgaaccgtctcctgttcgtctacagcagaggtgctgaagcgacggaagagcatactgtaaaaggccgggtgaatgaagagcttttgaaatcggtcgtgatagatccaaatggcgaattttatgtatgcggtccgctttcatttatgaaaagcgtgattgaaggattgcaaaaccttggcgtttcgatggaaaacatccgctatgagagctttgcttcatctcttgatatgcaaatagcgaactaacctcaagaaggcagctgtcaaaccgacagctgcctcagcgtgtcgacaaaccctcgcatgcgttgtcagtcctgcgcgtcggtgctcacgaattccaacattcgctccgctccgatgctcggccttcctagactgcaagggttttcaatcacgctgaaagaaggatgacaaaatcccaaaactaagagctgttttgggattttgtcagcaatctaaggcagctgtcaatccgacagctgcctttcatcttttcaaaacccggctcatacaataaagagaagtccaaccgggggggatttgagtattgagcatacgggagcaaaaagagctgcagcgggcgattgaagaaattacggaaatcgcggaaggattcggccttgatttttacccgatgagatatgagatttgtcctgctgaaattatttatacattcggtgcatacgggatgccgacaagatacagccattggagtttcggaaagcaatttcacaaaatgaagcttcactatgactttggcttgagcaaaatatatgagcttgtcattaattcagatccgtgttatgcgtttttgctggacagcaattcattgattcaaaataagctgattgtcgcacacgtccttgctcattgtgatttctttaaaaataactgccgttttcaaaatacgaagcgcgatatggttgaaagcatgtcggcgacagcagagcggattaaacattatgaaacggtacacggttcaaaagaagtcgaagcatttctcgatgcggtgctggcgattgaagaacacattgacccttcgctcgtgaggccgaagctgtcgtggagcgtagatgatgaagaggaagaagaaaccggcgcgccggccactccttatgacgacctctgggaactggatcataaaggatcgaaagagaagaagaaaaggacgaaaaaaaagtttccgccgaaaccggaaaaagacattctgctgttcatagaagagcattcgcgggagctggagccttggcagcgcgatattttaacgatgatgagagaggaaatgctgtatttctggccgcagcttgaaacgaaaatcatgaatgaaggctgggcgtcctattggcatcagcgaatcatccgtgagcttgatctgacatcaagtgaagcgatcgaattcgccaagctgaacgcgggagtggttcagccgtccaaaacgggaatcaatccttattatctcggattgaaaatatttgaggacatagaggagcgctacaacaacccgacagaagacatgaaaaagatgggggtagagccgaactctgggagagaaaaaatatttgaagtcagggagatcgaatcagacatttcatttatcaggaactatttaacgaaggatcttgtgatgcgggaagacctctacttgtttcaaaaacagggaagggattataaaatcgtcgacaaggattgggaggctgtgcgcgatcagcttgtcagcatgagagtcaacggaggatttccttatttgacagttgaggacggagattacttaaagaacaatgaattatacatcaagcattggtatgaagggatcgaactcgatttgaagtatcttgaaaaagttctgccttacctccaccagctatggggaagaagcgtgcatgtcgagaccgtgctcgaagataaacccgtcatgttttcctatgatggaaaggctgtccaccgcagatatttataaaggctgcattttggcagccttttttcttttaaagcgcaacgatttcaactcgtccgtcctttcaaaagaaatgccaaattaatgcacgtttgcccagttttacgacttcattataaaaatgtaaaataaagtatttaatgatatttctaaaattgtaattttagctgccggaaagcgtaaaaatgtagtatttaagttacctttgaaatgtaaatgaaatattatctacccttaaaaactttttttgaaaacgaataattaaggaatttgacatagtaagtcaagactatacctgatggaattccctccttataatagaagcagaggaagggctgaagcagccgttctcaaaaaaatgaaactgctaattttcgcctttgaaaatataaaatattctgctattgggaggacaacatgaaaaaacaagtaataacagcagcatcagcggttgttttaggatcgactttgtttgcgggagccgcttccgcgcaaaccataacggtgaaaaaaggagacacgttatggggtttttcgaagaagtatggcacaactgtcagcaagattaaacaggaaaacaagctgaaatccgatatcatttacataggacagaggctgtcgatcaatggaagcagttcttcgtctgcaaaagcgtcgaaagtttcatcagctacgcataaagtggtcaaaggagacagcctttggaaaatttcgcggacatacggcatgactgttaacgaactgaaaactctgaacggtttaaaaacagatttaatccggattggacaagtattaaaagtcaaagggacgaaaagcgtaaaagcagcatcaacaaccaagccttccgcatcaagcgggacaagcaaaacaagcgcacctgcgcagaaatcttcaacgctgaatacgtcaaaacttgtttctgatgcaaaagcccttatcggaacgccttataaatggggcggaacatctacatcaggatttgactgcagcgggtttgtctggtacatcctcaacaaacagacaaatgtagcgagaacgaatacagtcggatactggaattcaatgaagagcgtatcaagcccggcagtaggcgatttcgtattcttcacgacatatcagccgggaccttcgcatatgggggtttacatcggaaacaatcaattcgttcatgccggttctgacggcgtaacgatcagcgatatgacaaacagctattggaagccccgctatcttggagcaaaacgcttctaatgttgcagggacaagcccgttcatcatgatgaacgggttttttccgtttagaaacggaactcggctaaaaacgccaaaaagtgctcgaccttctcattatctttcagactaatcgcatatccccctgcaacgggaagcttcatgaaatcgcacggcacctctattaatcttccttccatcagctcgcggcgcacagtcgacagcggcaaaaatgatataccgagtccttctgaaataaatcgtttcgtaatatgcgcctggcttacgagcatcgttctgacaaacggaaacttgatcctcagctgcctgacgaggtcgtcccagtattcagggtgattgtgggtcaacagcaaatattcttcaagcaaatcctcgacatcgagcggcggcgcttgttctgcagcgcggccgtcatgaggggcaaccaaaatcacgggatcgctgtacatggaatagcagttcaggtttgacgattgcacgtttaagcagcttagtccgatatctgcatggccagctgaaatcaggggagcgatttcagctgattcggcgaaaggaaagctgatctacagagggtacaatgctgatgaactggcgctttcgtccacatttgaagaagtcgcttacctgattctcaacggggcatttccgacggaagctgaactcagcagattcaatgagctgctcgcttcatttcgtgtgcttccagaagcatgcgagcgattgatccgcagtcttccggccgaattagacgatatggcggttctgcgcacggccgtctcttcattcggggacatatcgtttgcgttcaagccgacaatggagcaggccctcaggctgattgcggccgtcccgtcaattatcgcgttcagaaagaggctggctgatggagaagagcctgttcagccgctggatgagctaggttttgtggaaaattatttttacatgctgaaaggaaagcgtccgacagaagctcagaaaaaagcgcttgaaacgtacatgattcttgcgatggaacatggcatgaacgcttcaaccttttcggcaagggttacggtgtctacggaatccgatcttgtttctgccgtcacatctgcacttggcacgatgaaaggacctttgcacggcggagtgccgtctgcggtgacggatatgctggaaggcatcggggaaaaacagcacgctgaaagctatataagagaaaagcttgaaaaaggcgagagactgatgggatttggacaccgcgtctataaaacgcatgatccgagagcgaaggctttaagggtgaaagccgaggaaattgccgggggcgacagggatatcgaccttgctctccatgttgaaaatacggcgatccgccttttggaagaatacaagccgggccgcaagctttatacgaatgtcgaattttacgcagccgctgtgatgaaggcgatcgattttgatgccgcattgttcacccctactttttcggcagcgagaatggtcggctggtgcgcccatgtgcttgagcaggctgacaacaacatgattttcaggccatcggctaaatatgtcggagaattggtctcacagtaatgcggacacacgccttctcatcgaagcgcgtgttttttaataggattttttgaatgtttagtagggaatcatgccggtgctcttgaatgtattcatcaagaaagtcctttaagggggagacgatgaaaaaaggattcctgatgttgatcatgctgttttttctaggtgcatgcacggaaggccgggattttgatgctgaatatgaagcgacaagcgcgaaagaaggcggaagcggcgccgaagtcatcgcagatcgcctggatgtgccttggacgatcgctcatactggcgagaccttttacattacggaaagaaacgggggaattgtgtccattgctgacggcaaaaaggagcgcatgcagcttcagctgaaaaagcccgttcatcaagaaggggagggcgggctgctcggatttgtactccatccggattttagaaacagtcaggaggcgtacgtttatcatacatacaaagacgggagccatctgaaaaaccggatcgtaaaattgacgcttgaccgcctcacttggacagaaacggatgaactgcttgccgatttgcctggaggcgcgattcataacggcggccggatggcgatcgggcccgatcaaaagctgtacatcacgacaggcgatgcaggggaaagggaatgggcccagcagcctgaaaagatggcgggtgtgattctaaggatggagcttgatggtacgataccggctgatcagccctttagctcgtcttatgtatacagtttcgggcaccggaatccgcaaggcctcgcatggatcggccgacagctttacagctccgaacacgggcagtctggacatgatgaagtaaataaaatagaacccggagccaattatggctggccggtgattgaagaaagcgatgagaagcagggaatgaaggcgccgctcatacattcgggagaaaaaacgcgggcgccatccggtttagcacagaaaggggacgtcctctatatggccgggctgcggggagagggtgttttccaggtcgatccggcggaagccaaagtagtcaagtggcttggcggatacggcagaatcagagatgtgaaagtgatcggcgatgatctgtatttcattacgaacaatggcgacggaagaggcgaaaaaaaacagacagacgatcggctcatccgcgtacctctgcctgacaagtaacctgtctcgcccgtttgcgtttaaggatgccggaatcgtggtaactgagcactaaacaatggtgaagaggtgagacaaatgaatccggcaaacagacagacagatggacagaaagcgcaaaaacaagaaaaacaacccggtgctgagcacaagatggtgccccttccgctctcggaagaccgcgactacaaaggaagcggcaaattaaaaggaaaaacagcgattattaccggaggagacagcggaatcggcagagcggccgccattgcatacgccaaagaaggtgccgacattgccgtcatgtacttggatgaacacaaggatgccgaggaaacgaaagagcgaatcgaacaggaaggagcagaatgcctcttgattcccggagatgtcggtgatgaggcgcattgcaaatcatctgtcgaaaaaacggtgaatcactttggcgggcttgacattctcgtgaacaatgctgcagaacagcatccgcaaaaagggatagaagatatttcgaccgaacagcttgaaagaacgtttagaacgaatattttctccatgttccatatgacaaaagccgcgctcccgcatttaggggaaggcagcgcgatcatcaataccgcatcgatcacggcgtatgaaggcagtccggcgctgattgactattcgagcacaaagggcgcgattgtcgcgtttacccgttcgatggctgcatcccttgtcaaaaaaggaatacgcgtcaacgctgtagcgccgggtcccatttggacgccgcttattccggctacttttccgccggaaaaaacggaaaaacacggcacagatacgccgatgggaaggcccggacagccttctgaacacgctgcagtgtatgttctgctcgcttcagacgactcctcttatatgacaggacagacgatccacatcaacggcggaagatatgtgacgacataatcccaaccggctgcttattgtaaggcagccggtttttttctgtttgttttttcggaaaaataagaatttgaaagaccactttcaaaaaagctgccccgtaagagataatagaaacagaaagagaaaggatgtgtatgaatgagcgaccgcagaatgacagcaaagtgggcatccaaacttggatttgttctcgccgccgcggggtccgccatcggtctgggagcgatttggaagtttccctatgtggcgggaacgagcgggggaggcgcatttttccttgtgtttgtcctatttacgatactgctgggataccccctgcttttgggggaatttgtattaggccgaaaaagccaatcggacgctatcggcacctatcaaaaaatagcgccagggacgccttgggtgatcacaggctggatcggaatcgccgcctgcttccttgtcctgtcgttttacagcgtgatcggcggctggattttgctttatatcattaaagcagtaaccggttcattgtcgggtctcacgcaggccggatacggggagctattcggttcgatcatccaagatccgctgcagacactggcagcgcagcttgcgtttatcatcatgacgatcctcgtcgtggcgaaaggtgtgcaaaaaggaatcgagcgcgtcagttcgattatgatgccgctattatttattttatttattgcgctcgttttaagggctctgacgcttgagcatgcgatcgacggcgtgcgttttctgcttgtgcccgattttggcagcctgacgccgcaggcgattctttttgcgctcggacaagctttctttacactgacgcttggcgtatctgtgatggtgacgtacagctcctatttgtcaaagtcacaaaaccttccgaagtcggcgctgtcgatcgtgatcatgaaccttgccgtcacgctgcttgccggcttggcgatttttccggccgtcttttcattcggccttcagccggatcaggggccgactttattatttgcggttctgccggcagtttttgaccggcttccattcgggatgctgttttttatcggatttttgacggcctttttattcgccgccttgacttcggctttttcgatgatcgagatcattgttgcggccattacaaaaggcgaccaaacgaaaaggggaaaatggacgtggacgatcggccttttgatttttgccgtcggcattccttcctgcttgtcttacgggatgcttgatgagccgttcatttttaagaagacgttttttgatgcggcggattatgtcgtcagcaatattttgatgccgcttggcgcgctctttatctccatttttattccgctgaaattgtccaaacacgatctatatgaagagatgaaaagcggatcaaaagcggggaaaggcttttttatcgtgtggttttatcttcttcgtttccttgttccgcttgcgattgtacttgtttttttaaatttaatcggagtgttttcattttaaaagatcaggagatgggtgaatatggtgttagactttcaacagatgtttccgagcgaggatggcaatcacgaggcgcggtatcagctgctggcattgcttgaagcggtattggccggaatggacaggctgaaggatcccggccggctgacgcttggccgcgagtctgaagtttcatctgactactatcaaagcgtcattgaagaggccgtcttgccggaaaaaggcttcggggcggaaaaaagcgttgaagagctattgaaattgcttgacggccaccgctttttaaacaggcattatgtggccaacgcgacgcctctgccgaacaacgccagcatcgccgggaatcttttaatggttcttttaaacggaaacaatttatgggatgtcgacggcacggctgcagccaggacggaagtgcagatcacggcgatgctttctgatattgtcggctatgacaggcacaagagcggcggttttacaacctggggcgggcagggagccgtttttcagtcgctcaggctggcgatcgcaaacgcgtaccctgaagcgaatcagcaaggaacgccgcatcatctgtacgcgttctgttcagagctttcgcatttcagcctttataagtcgatggaagcttccggaatcgggacggaccatttgatcaaggtcaagacgaatcacgatcattcgatggatctggccgatttgcgggaaaaaatgcaagccgtgattgaaaaaggcggacatccgatttatgtattggcaacgcttggcacaaccgacgcatttggcatcgatgatttggccggaatcaagaacgtgactgaagaaatagaggccgcatacggtttgccgcctgtttatattcatgccgatacggcgatgggcgggatgtacagcttttttaacggatacgatttctccggcaatccgctgcatattgaagatgaggtgcttgagacgcttgcccgctacaaacaacattttcagcatttgcacctggcggacagcttggtctttgattttcataaactcggacaaacgccgtatatcacaagccttttcttggtgaaaaaccgcaaggcattgcaggctgttgatttggatccggatgagacgccttatgtcggcaacagagggtttggcagctatcatacgagctatacgctagagtgttcgcgaatgggaagcagcataccgatttatgcttctctgctcgcatttggaatcgaaggctaccaggagatcttggccaattacatcagggttaacctggcgtttcgaaaaaaactgctgcaggcttttccgaatgcagccgtcaccaatgatgtatcacctgtgacgacattccgcttctatccgggaaatgtccgctatcacgaagaaatcagcggcgccatcacggaggaagaagtgcggaatattaacaaatacaatgagaaaatcgccgaaacattgggaaggtaccgcagtcacacctatttcggcagcacgaaaaagcaaacatacgtttatcctgctgacagccgtttgccagtgccgctttatgtccagaaattctacagtgtctcgccttacacgacggttgatacaactgatcaatatatcgcctttttaaaagcgcatgttgaaacgtcggatgtagcggctggataaaataaagaacaggaggtttgaacctcccgttctttatttagttcttacatgccgttcttttttgaaccggtatccatatttcgcttttaaacgttggggagctgatatcttgatcctgattccagaggatttccggccctttcgtttgctcataatgtgaagacgggaaccattcagcataaatgcgcccccagacattttgaagggtgtccggaaacgggccggccgcttcaaagacagcccatgtcgaggccggaacttcaagctgttcatattggtccggacattctttcgttgtcgctgtaccgatataatggtcaagttctccctgctcttccatcctgccttcggagaagttcgctgatgcttgaatcagtccaagcggttccacatttgaaagctcctttaattcatcgatgttttcactgcttaaagttttccacatcgaggcgatatccggattgattccgtgaaagacgacagggactctttttttgattccgacgatccggaatgccttcttttctacaatacggtagttcatttcgtttcctcctctaattgttaactggaaggtcatcggaggatatgctttcagtgtgctgatatcgtgtctggcctctgtcggcgtaatgccgtgcagcttttgaaatgcgcgcgtaaaagcatccggcgagtgatagccgtatttcaccgcaatatcaatcacttttctttttgtgttcttcagttcaaacgctgcaagggtaagccgcctgcggcggatgtattcggacagcgaaaccccggcaagaaaagaaaacatccttttaaaatgatattcagagcagtaagaaagcttcgcaaccgtttgaaagtcgatactgtccgtcaggtgttcttcgatatacgccatggcttgattcatgttcttcagcaaatccatttgatgacctcctctgtttacaaatatagcaggagcagaatccccatatccgactttccgtgcccgattgtgcagggtcaatcttgagactgtccgccgttaaaccatgcagtcttcagctttttgatgccgtctgcgatgcttttttcagaaagtccgccaaacccgaggaggaccgcgtgtgtatcaggggggggcatatacgagactgaggctggatatactttaacccctttttccagcgctttttgggtcagccactcttcactcggggcgcttttcacctcaaggatgatgtgaagaccggcgttctctcctctgactgcggcatgaccgccaaattcacgcttgatggcatcaaggagcgtttttcgcttttttcggtagagtgttctcattcgattcaagtgcctttgataatccccgtttttcataaaaagagcaatggcatgctgtacatggcgggaaaccgtttgtttaaataaggatgccatgttaagcccttctttgacgagcggaaaggggagaaccatatagctgatcctgagggagggaatcagcgattttgaaaaagtccctaaatagatgacccggtcgttccggtcaagcccttgcagggaaggaatcggctgtcccgcatagcggaattccccgtcataatcgtcttcaatgatataagctccggtcgctgctgcccagtcaagcaactgcagcctgcggccgaccggcatgatcattccgagcggaaactggtgggacggagtggtgtatgcgagctgcggctgatattgttcaagatcctgcacggaaatcccgctttcgtcaaccggtattggaaccacattgaagccgccggttttcaggactgtttttgagcgatgaaatccgggattttcaaatccgacggttgtgcctttaggaaacagatggcacagcaactgcagcaaaaccggtgtgccggctccgatgatgatttgctcgggggaacagaccacgccgcgcgattctctgaggtaaaccgcaatcattttccgcagcggaatgtctccggccggcgggccgctttgaaaaaggtcgtaccctgattcaccaacggttttggcgagcgtttttttccattgggaaacaggaaatgacgcgaggtctacgtggccgtggtgaaaatcgatcatgttagccgccgtctcatgttcttccagttctttttcggcagggggaggaggcgcagtctgtgcaaagtctccttccgcttcagccgcaaaccagccttttctaggcttgctgagcaaatatccttctgcagccagctgttcatacgcgtgttctacagttgtcaggctgacatttaagtgtttggaaagcattcgtttggagggaagctttgttccaggctttatgtgtcccgaatgaatgctgcgtttgaaaaacgtgtacagctgctgataaagcggctcgctgccgctgcggtttaaaaaaggggttatatccattcgatcagccctttcaattcatctggtatgttttattttatcaaaactggtcattttaaaaagcccagttttcgggttaaagtagtttcataaccaacagaagggaatgatgatgttgcttgattatagggaattgcattgtgaaacagagctcaaggaagtctatccgatcatgaaacagctccggccccatttggatgaaacgtcttttttggagctcgtcaaagaagctcgggaggctgaaagctacacgttatttgcgctgtacgacggtgatattccggtggctttggccggctttttgccgagggtttctttgaaccaaggccgtcatgtttgggtagcggacctggtgacgtgtgaaaaacaccgttcaaaaggctatggaaagaagcttttaggcgctgttgaagagtgggccaaagggaacggattggcttcaatcgctttatcatcaggcttgcagcgggcagacgctcaccgtttttacgaagagaaaatggggtatgaaaaagcgagctacctatttcgcaaggctctgaaatgaaaaactccccggtataaccggggagttattaaaagccgagctgcagattcgtatcgatggagacgatggtccatacgcaaacgagaatgaaaatgttcaggacgacgccgagaaatccgagaccggtccgtcctttttttatgaacagctcgataattccgagcggaacggcggccatcgcaaaaggaagcatcttatacgaatatgcaatcgtgtcgcttaaaatggccaagtttaagacgaacagggacagaatggccgtgccgacagacacccatccaaatacgttgtgctccttaaagattcttaccagttccataattccacctcacctactttagctgctttgacaggcccttttttgatcagccgttcaacctcttttgacggtccggtaatgacggctccatacacgttcacaccattctgttccacatagtcaagccgtttggaaagcttcaggtctttcctgcctgaaatggtttcagcccatttcttgttcttgatcatgtaggaaagcgccgctttaaactgttcgtcatcgttttcggcaggttgctgaatttcaaaaatccggtttgaatcttttccgggaaatccgatcggctctgcgtatggatgatcttttaaatcgccctctgtttcaatcgcattccacagaacgcgaacatcatagccttttaatttttcatacagctcctttgtcgggtatgctttttcaaaggaaaggaaagcttcggttacggttccgtcaggcagctgttttaaaatcgactcggctttggacactgatttttctttgatgccgtcagggtagacaaaatgacgttcttcttttgaaagctcctgattgtattgatgaatctgcggagacttcagctgatcgaagaacatttccacttcttcatttccaactacttttgtgacgtttccgatttgcttctttaacgggaactgtgtttcgattccaaagagttttactttgttgacaagggcttcagtatcgacttgaatattcgggtttgtgacggcaactgtcattgaagcggtttgcaccagttcattccctttgctttcatgcccgcccaacccgtagtatagatagctgccgagtgtgcagatcggcagaataataagcgtagaaataacagcaagggtggagatccgcatatatgatttattttttccgtatcttaaaatcgctttttgcttttcaggactgatcgccaaatcccagtcttcgtctttcatttcctgttccagcatgtcctggtattcttcaagctgttcaagctcttcttcgacccggagcatttccgattcggaaagttcgccgtttttatatttttcccaacgttttttaaaatcttcattcatcgttaacacctctgttgtaaagtgctttcagccgctgtctggcacgaaataaaacacttttaaaattagcctctgagatattcatcaagcttgacgcttccttgtagttcaattcttttaaatagtacagcgtaagcgcttcccggtagttatcggggagctggttcatatataaggttaacacttccttgatttcgacctggtgagcagggctttgcaccgcgttttgaaacaggtttccgatcatgtcgtcagaaatcgtcacttcctttttatgctttctgacatagtcgataaacgcattgcgtgccacttgaaaaagccatggcttcactttgctgtggtcgtaagaatggatgtgtatgtaagctctcataaaggtttcctgaagcaaatcctctgctagatgtttatctttcgtcatggagagcaggaacctgtaaacatcattcatatacatttggtaaatttcgtcgatagtcactgccttttctcccctctatgttataaacgcataagaaaggtttgaagttgcactaaatatgcccacggctcatttttcctccaatttcttacctttaaaatcatctaccctatataataactgaacacgttcaaaaaaactaatcttcatgatgtaaagcggccgaaatataaaacacagcaacaaaataagcctttagcatatgaatctttattttatgctaaaaggcttatttttttgaggatatccttcatttaagaggtgcgggtaagctgttttgatcgtctgtcaaaagtaacggtcatgagcgcggtgtccttccgcggccagcgcatcggctttcgttcgatggacggtgccgaatggatggttgggcggagcatagatcgaataaagtttaagcggagtattgcctgtattggtgagattgtgccatgttccggcagggacgacgatagcggtgtcatcatatacatttcttctaaatggcaaatgatgtttgctcggccccatctgaacaattcccctgcctagttcaacacgaaggaactgatcgacgtgaggatgcatttccaatccgatgtcttcgcctgggttgaggctcatcagggtaacttgcaaatgccttcctgtccataaagcggtgcgaaacgttttgttctgctttgccgcttcattgatgttagaggcaaacggtttttgtccataatctcttaacacgatacgttcttcggtgccgggtgttcgaaaagcgcctgcataccctgatccgtgaaaccgtccggcgctgtaaggcgaaggaaggtgataaggaaattgatatggatgcatatgtttttaggtctcctcattagctttattaacatcaacgtatgcaataggcgtatggagcgtgcctagtctcaattttataggcttcatggtatcagatatacaaaaagaaggagagccatggaatacaccaacatatcggaacatcgctcgaaccgtcgcgcagcggtcatcggaacatgggccatcggaggctccaagggaggaagccgattcaaacgattcatgccgcgcttgatcaagagatcaacctggttaataccgctccggcatacggtttcggaacagatcgggccaaaattcacggctccgccgacaaaagaaaaagtcaggaaaccggggaggaaaattccccggtttttttgtgaaaaatcattttttagtaccaggtaataaaaaaattgttataataataaagggaaacctcattcgactacatcaataaaggaagtgccatatgtatcaatttactggttatgctgcaaaagcgattctttctttgcgcggcggaattaaagtatacaataaagaaaatcttcctaaagacacaggtttcgttattgcctgcacacatgcaggatgggtggatgtcgtcgcactgggtgtcggcattttgcctatggaaattcattacatggcgaaaaaagagctttttgaaaataaattaagcggttcttttctttcaagcatcaacgcttttcccgtcgacagggaaaatcccgggccaagcagcatcaaaaccccgatcaagctgttgaaagaaggaaaaatcgtcggcattttcccaagcggaacgagatcatctgaagacgttccattgaaaagaggggctgtcacgatcgcccagatgggaaaagcgccgcttgtgccggctgcatacagcggcccttccaacggaaaagagcttttcaagagaggcaaaatgaaactgatcatcggcgaaccgctcaatcaggaagatttcgctcaatactcgtcaaaagaaaagctggtcaaaatgacggaggctttgaatgacagtattaaagctttggagaaaaagctggagcagctataattcaaacatacgcagggaaaaacagcttctcatgcacagagaggctgttttttttatttttctaaaattcaccttgcactccatttttatgataaaatagcagcgtttttattttttatgcagtatgttagaactatggttattggtggaggagctcatacatgaaatggtatttgaaagcaataaaaaactatgcaggatttacgggaagggcgaggcgaaaggaattttggctgttttgccttttctcatacatggttctggtcatctacggattttttaaagccattctgcatcttccggaatatgaaatagagacatttttaggaatggtttatttgctcgccaaccttgtgccgggcttggccgtcacgatccgcagattgcatgatacagggaaaagcggattctggatctttatcggtttaattcctctcattggaaagatcattttgctcattatgctttgtcaagacagtgaaaaaggggaaaatcaatacgggccgaacccgaagacagcgctctaagcgaaaaccgcctgaggacaggcggtttttttaattgccgggtgcagttgctttttctaaaaacaaaagcagttcctgccaaaatgtttgagctgcaatggcatcgtattcagtttttccgccataggctatttttctgctttttcttccggatgtcggaaagtatggaggcctgatattatgaccggctttttcaaaatacagatgtttaacagaataagagaatctgttctttttcagccgttcttcgattttctcgttcattgaggcagagggccatactaaatcgtcagtgcttgaagttaacagtataggacctttaataagttccgctttaatgattgcaggatgatcatctttcacttttcgtaaagccttttggtaaagatcaagaaaagcatgaggctgtcttgtgagcttatgtttcatcatattccacagctgaggaagcgaaaacatcggcagcggtgcaaaggcgagcggtgcgccgttcaggctccaggaagatgtctgccggaatttttttaatccaaccccttgaaagacgactccgccgcctacatgagaaacgacaaagcggatttcaggaaaatgagaacctattaacagcgccagttcgccgccttttgaccgtccgcatattccgatctgacgatgatgaagtccttcctggcgaccgagccaatcgatcgctttttgaaagtattcaagcggaatttcaaccagttttttaggcagctgtttgtattgaaaataagggattgcaagtgttgcgtatccgtaatttgctaacatgcctgccattgtttcgtcaaggccgccgtcagatccccctaatataatgattgcgggagggcggttaacggcaagcgggcgaaaaaaagtgccgcacaacccatcttcgtttacttccagtctatcaactgtttcagaaagcagcactcgttttatttctttactcaagatgatgcgttctttttgcttcacttcaatacggtaagcggacggatgaaccgattttttgtaaaacgagcaggaagattcaacagcctgcattgaccaaaaaagccccatttgatctttagactggtaggttccttttagtggggctgctgctgcagggtcgacttctcctaatctattcgcttgaaaaacagcgtgtgatctccactctgcgtcagcttcatctttcactgtaacgatgatatcaatggtgtcaaacggttgaagtccgcttatcttcaagtttattttttcatcccatttggaaactgcaggtatgtgcaaaaccggttgcaaggtaatcaagacggcacttccttttcaagttttgtgtaaaataaatcgacgcactcttcaacatagtcatcaatccgatcattgaacgactccttgaatccgggcaaatgttgaaacataatatattgattcagtaaaccgaaaaacatttggcttaacatttgaaagttgccgtctgaaatttttttttcggcgtagagctttgcaaaataagcctctaaaaagcggttgagacggcggggaatatccatgattaattcgcaaacttccttatcctgtactgcatcattaaagtaaagtaaaaaaacagtacctttttccaggttttcttttagatatgctttcgcaatgaatgagaggtcttgtcgtaaatcgccgctcagtattccttcaagttctccaataaaatctcccgatgacacatgttgaataacactttcccgaaataaattctgtttatttccgaagtgtctaaaaagggtcaaatgattgacgcctgctttttgggcaatttctctggtggatgcggcttgatatcctttttctttgaaaagggcaagcgccgcttggattaatcgatcccttgtagattgtgctgacataagtccctcctgaaatgtaatcacttgattacatgataattgaattttgctctgtaatcaagtggttacatattttgaacgcaaaaaaaagaggatacaaattcattgtatcccccggtttgttcacaatgttattccgcttcttcaagcagcggcgtttccgcagcttttttcacctcaacgtatgaaacatggtggccgtcgatttcgttgatcgtgaattcaaatccctgctcggtgatcatgtcgcctttttggacgtcatatttttgcgtcaggaaccatccgccgatcgtgtcaatctcctcattgtcgagctgaatgccgagcaaatcgttgacctggttgacgagcactttgccgtcgagaatgtagtggttttcgccgattttgcggatttcattaatttcatcaatatcgaattcgtcgcggatttcgccgacgatttcttcaatgatgtcttcgaccgtcacgagtccggccgttccgccgtattcatcagaaaggatcgccatatgaacgcgctctttctgcattttcagaagcagatcgtggatcggaacggtttcgatcacatgaatgatcggattgataaactgttcaatcgtgtcttctttggagcattctccgctgatgcaggccgtcagtatttccttgacattgatgacgccgacgatgttgtccttatcaccgtcttcgacgggatagcgggtatagccttcggccttcgtgatgtcaatcatctcggcgattttcatatcatttggaaaactgacgacttctgttctcgggatcatgatttccttggcaagacggtcatcgaattcaaaaattttgttgacatatttgaactcagattgattgatttcgccgcttttatagctttctgacagaataattcgcagctcttcctctgagtgcgccatttcattttcagaaaccgcttcaaggccaaacgctttcgtcaacagccttgctgatccgttcagcgcccagatgaatgggaacataatgcggtagaaccagatcaaaggttttgcaaaaagaaaggaaacggcttccgctttttggatcgcaagcgtcttcggagcgagctcgccgacaaccacatgcaaaaacgtaatcaagctgaaggcgatcacgactgaaacgatgtgtgatacagagctcggaatgctccatttaacaaatagcggttcaagcagccgggcgaccgtcggctccccgagccatccgagaccgagagccgtcaaagtgatgccgagctggcaggccgataaatattcgtctaagtgcgtaatgacttttttcaccgaaatcgctgttttgtttccttcagcaatgagctgatcaacccgcgagcttctgattctgataatcgcaaactcagacgctacgaaaaatgctgttaaagcaattaatacagcaacaaaaatcaaattaactatttccaattaggaccttcactctagcgtgagaatgaaggtaacacctcctgtttagtaaaagattaactaaagcagcagcaaaaatgactggatgaccgtcattttttcaggagaaagacggcttttcagaatcttccgttcatcgggattcagccgtttcaatctgtttatgatcacggagatattgtcattgacatgatcgatttccgttgtcaggcttccaatttcatcatcattcacagttgaagagggaaactggttttccagcctttctttaatgtcggacagggccaatctctgctgcttgcagtccataataaacttcagccgtttgagagcggcttcatcgtaataacggtagtttgaacatgatctgtcaggcgttaacagcccgagattcgtataataatcgacagtccgttttgttacgcctgcagcagctgctaattcgccaatgcgatatttctctgccccatctgcatccctcctcaaccatcacgttatagttataaaacattttaatatattagaagctgtttatacaagttaattgatcaaaaaaaggcgtaaaattgatgcaaaaacctttatttatctaaatattcgagaaaatattgttagatttaaagtttagacatttgactgactcttttttaataaagtaagataatagtatatatttggcttggaggtggttggatggggccctctgcatagtcatttttacagaacgcacatcagccttattaagggaatttgaattcatcaggaggtgactccttatcctttgtgaaggataaggttaaatggacgatattgttagtctgataatcatcgggattctgattgctttaactgcttttttcgtggcatcggaatttgcgattgtcagagtcagaagctcccgtattgatcagctgattgctgaaggaaacaaaaaggcggtccgcgcaaaacaagtggtgtcggatttggatgaatacctttcagcttgccagctcggtattacgattacagcgcttggactcggctggatgggggagccgacggttaaaaaggtgctgcatccggtctttgaaagcctgcatgtttctggcgctgtatcgcacgctctttcagttgccattgcatttttagtgattacattcctgaacgtcgtggttggagaactcgctccaaaaaccatcgcgattcaaaaagccgaacagatgacgctgtggctggcgggacctctgcactttttcaatgttgtcatgttcccgttcatctggacgctgaacgcctcagccagagtgctgaccgggttattcggtttgaagcctgcttcggaaaaggatgaatcccattcggaggaagagctgcgaatcctgttatcagaaagctacaaaagcggagaaatcaatccgtctgaatatagatatgtcaataaaatctttgaattcgacaatcgaatcgccaaagaaattatggtgccgcgtacggaaatcgcctctgtcccgctggatatgccgattgatgaggccatttcggtcatgctgcaagaaaaatatacgcgctggcccgtctataaaggcgataaggatcatgtcatcggcatgatcaatacgaaacagctgtttacggatatgctcatgatgtcagaggcagagaaaaagctgctgtctcttgaagcctacgtccgtccggttattgaagtcattgaaaccgtgcctgttcaaaagctgctgatcaaaatgcagcgggaacggattcacatggcgatcttaacggatgagtacggagggacatcgggtcttgtgacggccgaggatattcttgaagaaatcgtcggggagatcagggacgaattcgatgaagacgaaaaaccgctcatcgaaaaagtttccgatcacgaatacatcatggatggaaaagtgagaatcgatcaggtcaatgagctgtttgaagacgatatcgaggaagaggaagtcgaaactgtcggcggacttgtgctgaaagaaaacatagatatcgcggaaggccaggcggtgcatatcggctcttacacgataacggttctcgaaatggaagggcgtctgattaagcacgtcgaagtcaagcgggaacaaacacagaacatgtagagctggcaccggcaaatccggtcgtcgtaaacgaaatcaccttgagcgaaaaatagctcaaggtgattttttattttaagaaaaaagtcatttgaacaggaacattcgttcgtatataatgggaacaaacgttctgtgtgagaggtgattgatttgctgtggtacgagatcatttcggaggaagagagaaaaacgtatattaagcggatcgaatttcatttgaggaattggaaaaattacaaagccgccgtgctcaatttagaaaggagaatggagaaggagcaaaagaatgggctcgccgtcaaagaaagaaacgctgaatatcggatcgacgccgaaaaaaggctctatcaatttttgcttgattcgatggaaacggctgtctccgaattggatgaactcgagcggaagctggtagaatgccggtatattcataactggagcatgggcaaatgcgcgatggaaatcggctacagcgaaaaaacgctgtttttaatgaaaaaatcgctgctggacaagctgcttgtcagcttggcggcgatcacgaatatttaacgcacggcgggaaggggcttgtttaagacaagcccttctttttttgcgctgcttcagttttttttcaggttcttgacgcgatgatgacgcgggagagagcggtttttcttttatgataatgacaagctttaaacagcggggaggtttaacaaatgtgatgatacaaatgccggtcaatgtttgagacaaacgcttcaggaaaggaggagaagaacatggatttttctgaaatcgcgctcgttccgctgattacgggattggtgcatacagtaaagcttgtcggcattcagaaacgatttctccccatctgtgcaattgtcttcggcatctcgatttctctgttgtttaccgcagggaactggaaggaagacatgatgatcggaacttggcttggattgtcatcagttggattttactccggttcaaaaaacgtcttgaaaccattatcaaaggaggaaattgaacatgaagatttatttggatccgggacacggcggaagtgatccgggagcatcgggaaacggtttgctggaaaaggacgtgacgcttgccattgctctcaaaatcaatgacattttattaaaagagtatgcaggcgcagagacgaggctgagcagaacgacagacaaaacggttacgcttcaggagcgcacagacgatgcgaattcgtggggggccgatttgtttgtctccattcatacaaacgcttttgacggcacggcgtacgggtatgaggattacatctacagcggcctgtccgatgaatcagttaccgctctttatcaacggatcattcacggcgaagtaatcaagcagaacggactcagggacaggggaatgaaaaaggcgaactttcatgttcttcgggaaacagcgatgcacgccgttttaacggagaacggctttatcgatcaccccgaagattcggcaaaaatgaaaagcgccgcctggatcgaacagactgcgcggggacatgcaaatggcatcgcgctctgcctcggcctgacgcagcgcgaattccccttgtataaagtgacgatggacggggggcaaatcggggcttaccaagaaaaagacgacgttttgaaagttatttctgcgaattgggacagctttcaaaaagcggctattgaaaaagggtagaaagggaagaatccattttgaagcattcaaaatggattcttgacatttaatgagtccgcatcttttttcatttgggcgtaatgttcctttctgaacgctcccatcagaatttgagctgctatacaaatcaataaaccagaataattggttcatcataacaccatcattttcacggaatcagcatgctgccggcccagaatccgccgattgagcctgccattgtaagcaggatgtaaaccgctgaagcctttacccgctttgcagccaaaagctgaacagcttcaacgctgaacgtcgaaaatgttgtgaagcctccgaaaaatccagttccgaccacgatagagaccgtttgattgtcaatgccgaggcttatgaatatgccgagagcgaatgagccgagaatattgatcaccatcacgctgaccggaatgcgggggcgcggaatcatcgccatgagcacattgcccagccaaaatctcaaaacggacccgattcctcccgcgatcataaaagcagctgccatcatgattgataccgctccttttctttccccgcagctccgctgacctttttgccgatcacgatccccaaaaatgcgaagcataccccgcaggcaagcgatgccatcaagtacagaactccgatgtgagcggccgattgcagcagaagtacggtttctttagaaaaagcggacattgtcgtatacccgccgcaaaaccccgtccctaagcataattggacgagcggcttttttgcccgagccgcaaaaaagcctgtcaaaaggccgagcagaaggcttccggacgtgttttcaataaaagtcggccaaggaaaaacggcggtgccgccgagcagattgactgcgtagcgcagcagcgatccgatggctcccccgataaaaacggcaacatatgatttcatactcttccttctttctcaaaaataatccgggtagtcggtaatgatcccatcgattttccagcttttgaggcggcttcccgttttctgcccgttgaccgtccaagccagcgccttcaaatcacagctgtgaatcgatttgatcagaaaagggctgatcatcgtagctttcaggctgacgtattgggcaaacgaagcgatttgccgcagccggccgcgcggcagcaatccaaatctcggcctgatcaaaacggcagtctgaatcgaaggatacatgtgatgaaacgccctcatggcgccggcgtcaaacgactggacaattgtgttcattgaacggccataccggctgatcagttgtccggccgctttttcgattccgggctgggttttggacgacttgatttcgatgagaaggcccgtcttattgtgatacttcctcagaacagcttcaagtgaagggattttttcgccttgatattcagggccgaaccagcttcctgcatccagctgttcgagctcattcatcgtatactcgcgaacgaaaccggtaccgttcgtcgttctgtcaaccttgtcatcgtggatgacggcaagttttccatcctttgtaatctgtatgtcgagttcgataaaatcagccccgagctccaccgctttttcaaaagcggcaaacgtattttctggggcgtaagccgaggctccgcgatgtgcgataatatgcaaacatgtcagctcctcttgataaaatctttccatcacaaggatacccgattttggcgatgcaagtaaatcctttgactaaagcggacaaaaggcagggggaagagatgtgcgacaaatttcggcaaaatggtacaaaagtatcatttactaaaaattctgatattttataatggacaaaaggaggcgagatgatgggtaaagggagaattaaagtggaagaacggattaagatcgaaaccgatgctgaaatgtttaaagcgactctccttgatcaaacacagtctcagaagaagaaatagcggtgttggcccgtatcacgttgtctctgggaacaataaaatagaatgatcatcaggctgccgaaggtgttcggcggccttttatgcgtggcatcggtatttttggcgtacaataaagtgagaaattttttgctcgttttagtataataaaagcttgatgagtgaaataagggagagaaagcaatgttcgaaaagtatatgacaatggatttcgctgccgatatcgggatcagcatcggtatccttcttttatttttcgcgtttagaaaaatatttacgaagtacttattcaacctgatactgaaattgacgaataagacgaaaacggactttttcaatcaggtggtgctggcgtttgaaaagccggccaggtggttttttgcgatactcggtatttatctggcgattatttattccccgttttttgaggggcatatggggatcgttcataaactgtacagagtgtccgtgattttggtcattgtaagcggcctgtataacttaacggcggcttcgtctgttttattcgataaaatcaataagcggcttgagcttgatatggatgatattcttgcgccgtttttgtccaagattctccgatttatcattgtagcgcttggaatcagcgtcatcgccggagagttcaattatgatgtcaacggatttgttgccggactcgggctcggcggattcgcttttgcccttgcggcaaaagacacagtcggaaactttttcggcggagttgtcattattatggagaagccttttacaatcggcgattggattgaaacgaaaattgtcacaggaactgttgaagatatatcgttcagaagcacgaaagtccgcacggccggagaggctctcgttaccgttcccaactctgtgctggccaacgaagcgatcatgaactggacgaaaatgcgaaagcgtcaggtcacctttacgctcgaaatcgatccgtcaaccccgcgggagaaagtcgagcggtgtgtggagcgttttaaagaaatgctcgaatcgcacgaaggggtcaacccggatgtcattatggtcaatttcgatgtcctgaaggatacgcatttaagcatcttcttcaactactatacaaatacgacggtctgggccgaaaacttggacgtcagacaggatgtgaactaccgcattcttgacattatgaaagaggagcaggttgattttgtttctccggggcacagcctctttgagttgaagaaaatgaaagatcagcaaggaaatgcttagaaacagtttttgaagggagacaagccaaatggaggaagaagccctgagatttgcggatatgatcgaaaatgccgagcgcattaccgttttgacaggcgccggtatgagcacggaatcaggcattcctgattttcgttcagccggcggcatatggacggaagatctgtcgagaatggaagcgatgagccgtgattattacgaacgatatccaaaattgttttggccgaagtttaaagagctttttcaaatgaaaatgacgggaacttatcggccgaatgacgggcacctttatttagccgaactcgagaaaagcggtaaggatgtcagggtgttcacgcagaatatcgacgggctgcatcttaaggcgggaagccgccatgtatatgaactgcacggttcgattcaaacagccgcttgcccaaaatgcggggcgcgctacggtcttgaccacattcttcaagaagaagtgccaaggtgcaatcgcgtcaatggcaaggggagagcatgcggatttatattaaaaacggatgtcgtgctgttcggcgacgccgttcagcatttcgacacgctttttgaagtcctcaacgaatccgacctgcttctggtgatcggcacttcactcgaagtggcgcctgtcaggtttgttcctgaagaagcgcacctgatccccggtttgaagaaagccatgatcaatctcgatgaaacgccttacgatcatttattcgacattgtcatcaatcaaaaaatcgccgagtttgttcggaaactcaatcattaaaaaggaagacgctccagaccggagcgtcttttttgatcttcatcacagttttttataataaaaaacggatgcatcgagccggccgtctgcagattccgcgtattcaggaatgcgtccggcttcggcaaagccgagcgaagcgtaaaggaggttggaggggtctttttcccttgtatccagcacgagaagagtctgccttcctgtttcgcctgtcgatcgcttttgcattaacgatttggcgacgccctgccgcctgaaggcgggatctgtcattaacttgcagatttccgctctgtggcggccgttttgttttgtgcataagtgcaattgaacacttcctgcgatccggccattttgtttggcaatccataaaaccgaatccggtgcgacggctgttttccagtaagcctccgccagccgcttttcgagcggaggcagaaagccgactgatgccccgtcatcgacgacgcggatgagaagctcggccaattgattggcatattccgcggttgaatgcaactcttcgattttcatttacccaccccatggtataaagataactgcatcataatcagaaaactgtttttttggcaacaagtgtgtcagataatcacactcgagggaggaaataaaaaaatccccttcatcaggggatcagacaatggatgttattcatgaacgggtgtcatggattcatcaagtgttgcaaatgaataccccatgttttttaaatttgtcagcaataacggcaatgattgaaccgttgaaggaatatcgtgcatcaggatcacgatcggctgttttgtctgccgcttttccaggatattcagctggttcatgacttccggaacgaatttttggcttctgtatttccagtccaggctgtcaatattccagtcccaataaataaatccgttctttttcagcacttttttctgcgcttcggtcagcgacggtttgcttccgtacggcgttctgatcaaatgggtttcaaccccggtgatagacttcagcgttttttgagcctgcttcatttccagattaggagaattggcgcctttataaaattgcttttggtcatgggtcaccccgtgaagtccaagtgcatggccctgctgcttcatattgagaacggcttctttgtgaagcttcatgttcggttcgagcatgaagaatgtcgctttagcatcatgttcggataaaatttgcagcagcctttggcttacggctgaaggcccatcgtcaaacgtcaaataaaccgttttttccttcgatttttctttctttttttccgcagcagctttttgcttctctttttcctgcttgcgcttttcgatctgctgttttgtgctcaagtgatcgagaagttcgccttgcgttgcttttttgagcggaacgctgtctccttcatgcctcatttggctgttttccgacaccgtaagctctcttttctcagtagcggcagaggactgtgaaaggtcccacacgtacaggagaatcagacacaacacgaaaaagcacgctgctttcgtcaacaaataagctacagatggggcagttttttttgatacttggcgcatgtcactctctccgtatcatttttctcgttccgattccattatgagatagaatgctagtctcataaaataatggatcacaatgtctaagtatacaggattggaaagaagatgaatacaggatgaagggaaaaatatatcaaattttaagagaaaatgctgaacgataaggaatgctgcttttttgatcctgaaggcggaaaaaagtttttggaaatattgcactattttgatcggcagggtcgtgttagaatggaatggagaaaattcagaagtcaacaaaaataaggggatggagaaatgaaagttctttttaacggccggctgattgaacggagcgagtgtgcggttgatattgaggacagaggctaccaatttggagacggcgtctatgaagtcatccgcatttacaatggaattttgttcacgcttgatgaacacattgcccgcttatataaaagcgcagccgaaatcggaatcgacctgtctttttcagaagccgagctgaaaagccagctgaaagagctcgtcgacatcaatcagatgcgggaaggcgggctgtatcttcaagtgacaaggggaaaagctccgaggaagcatcaatacggagcagggcttacgcctcaggtgacggcttatacatttcctattcagaagcctgaaaaagaacagcaaaacggcgtttcggctattactgcggacgacatgcgctggctgaggtgcgacattaaaagcttaaatctgttgtacaacgtcatgatcaagcaaaaagcgcatgaagcttcttcattcgaagcgatcttaattcgcgacggtttggtgacggaagggacgtcttcaaatgtttatgtcgtcaaacaaaacgctatctacacccatcctgcgacaacgctcatcttaaacggcatcacgcggatgaaagttcttcagctgtgtgaagagaacggcttgaattatgtagaaaaagcggtgacaaaggatgaattgctgaatgcggatgaagtattcatcacgtcaacgacagccgaagtcattccggtcacctcgattgacgggcaaacaatcggctccggagcgcccggaccgctcacaaaaaatgtgcagaccgctttgcaaaacagcattttgtcggaaacagccaaaacggtttaacaaagaaaaacgccgtctcctggggaaacggcgtttttttatttgcggaaaccgaacaaaatcgaaaagagcggcgataaataaaggaaaaacacaaacggcaaatattcaatgacgggaacgccgagcgctgtggacatgaacgcgccgctgactccccatgggatcatcggattaattaatgtccctccgtcttcaagtgatctcgacaaatgcttccggtcgattccaagcttgtcatacagctttttaaaggactgaccgggaatcaagatcgataaatactgttctcctgtcgccaggttcatgccgatgcttgatgaaacggttgagaacacaagccggcctttcgtatgaatgcccttgattacgccttcaagcaggcttgtaatcatgccgatcttttccatgagaccgccgagcgcgaatgcgatgatgatgagagaaacagagcccatcatcgattgaaggccgccgcgatttaaaatcttttcaacggcttcagtatcggctgagaaaaccgggccattctgcatcgctgacaaaaacgatgaaatgccggcgtcaggctgaatcagcgcggcaaaaattccggcggaaacgatccctgctgcaagcgacggaatgacgggcgtccgtctgacagcaagtacaatcacaagcagaggcgacagaagcgtgaagacgctgatgttgaccatgccttctattccgtttatgatcgcttgaatgttttcggttgaagccggtgccgccgttaaagaacggcccatgaaaaagaaaagcaaaatcgtgatcaaaagagcggggatcgtcgttcccgccatatgtctgatatgcttgaaaatcggaagctccccgactcctgcggcaaagttggtcgtgtctgacattggagacattttgtcgccgaagcaggcgccgcaaatcacggctcccgccgcccatgtcagtggaacgcctgccgccgcggccacaccgatgagggcgacgccgatcgtgctgaccgtcgtaaagctggagccgaccaatgaactgatcacaagacagctgaaaagtgcggtgagcagcaggtgctgcggttcaatcagattcaacgcgtaaaccgttaccgtcggaatcgcgccgctgtactcccagactccgattaagatgccgattaggcaaaggatgatgatcggctgaacgccatttcggatgcctgagacaatgccgctctcaagatctttccaagaatgccctttcaccgcgccgacagcggccaaaaaaccgacgcaaatcaaaagcggtatgtgcggttctgctttaaatatgaataagcaggtgaaaataataaacaatatggccataaacaatagagccgatatggaaaacgatagtcgtttttcgtttgacaaatcatacacctcattagaagaaatctctttctttaatacttttatgcttttgtgcgtaaacgtattataacagaaaaatagatcatatacttaaattaaaatatttcaaacatttttcaaaggttcgcccattctattttgaaagcgctgacttttttaagatataatagattggagaaaggcatgtatttgatacacgtttcaatatccttaagccaaaatagggggaaatgcgatgtcttgcactgttcagaaaagccggtttttacatgaggaagcgatacggtttgaaaatgatgatttagaggcagtacttgtgcccgggtggggaagcaatttgatttcattgaggtggaaggcgggcggtttgaatttgttgaaaacgcctgaaacaaaggaagaatatgacgcgaatccgtttttattcggaatccctgttctttttcctcccaaccggatcgatcacgggagatttacatatgcgggaagaacatacgagctgccgatcaatgaaaagccgctcgaaaaccacctgcacggatttctttacgataaaaagtggacggtaaaaaaaatggaggcaacagaagagcggatcatcgtgcagacgatgctggactctgatgatcatccgggcatcaaatcgatcttccctcactctttttccatcaccatcacctacacattagaaggacagcatctgaaaattgatgcgtcggctgtcaaccgcggtcaagatccgatgccgatcggattggggtatcacacatctttccgctatcctttaaacgaatcaggggataaagaaaagtgcctgtttactcttcctgcctcaaagcattggacgctgacagaccgcatgctgccgactggcgagtatcgggtgacagaggagttcaaagcgggaaaaatggcagcgggtgaaaggcttgatgatatattggcggctgagcaagaccaagaaggaaacagcaccgccgtcattgcggacagcctcgccggcattcgcgtacgctatcaatgcgacggccattttaagcactgggttgtgtttaacggtacatctgatcaggatgatctgctttgtattgagccatacacttggatgacgaatgcaccgaacgtgaaccttccgaagagtgtgaccggatttcgggatttggggccgcaggaagagctgacgatgcgaagcaaaattgaggtaggcggaatataatcgatattccgccttttaccatgagcttttatcaagcgtaaatcctgtatgggacgcttgtttgccctctctccaatccaattgaaccgtcacctcgcggccggcgatttcagcttcttcaagcccttccaaaaaagaaacggattgttcttttgaccctccgccggggaatttgcctcccgcgtaatctttcaccggcgtttcgatttgggcgttcaaaacgatttcatcaccaaactttacgaccaatttttccaaatatgtatcgtccagcttgccgcggtcgcctgtccagtagagctctccgccgaacagcgcgcggccatctatctttttgatcacggcctcccaatttccgtcggcgctttgcccgttccattttgggtattccgccatataaaaaccgatcagcctcccgccgaaataaacggcgcaaaaggccatgaaaagggaggcgatgaaaagcaccggccgcttgtattcctgtttcatattaaccaccgcctaaaaagttctgctttaatcataaagcagaacaatcggaaaaaatatattctcttaaattttaagggaacgggtgcgggtgcaggttcagctgttctggtcttaacggctcttccgcaaagccgagcttcttcggcacggtgaaaattctctcaagcccttccaggcggatgaagcgctgtccgaatgtcatcggaatcaggcccgggatgagaactttcacacaataaagtccattccgtttgataacaggggaagtctgatcaacgacgatcacttcaaggttgagactccggaaagcttcaagcaggtcgcagaggtcttcggttaaatcaaggtgtttctttctttttttaaaggcatcgtcgaatgtttgcagaggccggctttgattcagcaaaaaactgagccgctcttccgcttcgggcagtccgtacattaagctgtgatcctccatttcccgcactaaagcaggactgcggagcatctggtgatatttgctcctttcagattcaaatttgcggtcgtgcttcaacatcatgcctgccagctcatgaagggcgcttttcaccgcttttacgggatcggggtgggcgcctgcggaacaaatcagattcaatccttcccgttttctgtttttggcgatcgcccaaatgcttggaatgccgtattccatcgttgaattaaagacatgcagatcatatcccgccacacttcgcaccctctctgtcatgaggcgcaattccggatctcctgaagagtcgagatccagctgccgaagtggaagcctggcataccaggcaagcaaaaatgaatcgcgctcagccgcttctaatatgccgtggaaaatcgcttcctccaaactccctccgagtgcacagccgttcgatgtttcatagacaaagctgtcttcccgccccaggctgtaatacgcgagcgattcaggaacgagaatcggccgtttctgcagaaatgaatagccccatacccagcggagcgggcgggccggatgaaacggctgaaaaggaaaatcgggatgcgtgtattgttcggcttgatgaagcccgacttttgccgggtcgagcgcacgatcttttacattttcataggtgtcatgtacgaccgtccgtttgccgcgcggttcaatcccggaatagcgttccaaaccttctaaaatggcggttaattcgctgtcttcatacgaatggctccgcccacctaccccttcatttcccatccataaagggatattgacgatcatatcggcaaacggcagaatcgcgtcataaattttggcgttgaatatccccgttctctggtccaaatagtctttggagagcgtttgttttaagtcgtccgtgttccgcacgcgaaagctgtccgggttcgttttcaggctgggccggagcgatatccgcgcggattccggtccgtcttcgggcagatttccgcatatagggcatgtcggttccggtatgaaagcgtgcagcgaactttctagcgttttcaaattgacgatgtacagctttttttccaatcggccgcgcccgccgttcatgatggtgtcgacttctgtgcagatcaggctgaccatctggcggcagccggtctttgaagcccacggatcgcggtttatgtcattgcttttttgttccagttcaagcgtctccatgctgtcggggccggagacataccacctcatatcggcgcattttgaacatcctgactctgacggataaacgagcggcccgattaccccttccccaaaagatgcaaacccgcgaagccagggaatccctgccgcccttagcactttttcggcctcgcgatataacaaaggccgccaagcgtcgtgcagcacaagaacgaacgaagtctccgccggtattctgttctcaaaatcagacctgcggataacgttatattcagcagataattgttgtgatgcgccttcagccatcaatccttcgccaacgaccaaaatacagcgcttcatcaaggttcctcctttcgcaactgcacgcaatagattcctgctagtttttcttttaaaaatggttcaacaggcagctcatagacatacagctgcaagccccggttgtttttcaaggcggaaagcagtgttttttgcaaagcagctgaaacggggatagcaagcttcagttcaccaggctccagcagaacatccgcacctttcaaaggatctttgtctgtcagtgcccgttcgagcacttttctgagagcggatgtgatgttgagtccagaacttctgtaccagcgcccgcgaattcccgcccatgcgacagggaagccttctatgtttttccctaaaccgatttccggttggccgtacaagactgtcagcgcttttaaataaaatgcagaatgccggtcttcgattccgtccagctgaacgagggaaatcatttcttttccgctttttatccgttcgcacaaccggtgttccaggcatttctccaatccccttaatacgccttcagccagcgtttctccggtggcgatcgcgaaatctccgttattcggataagaacgggtcaaccttgatgcatacatttcaatccccgtcagcccggcttcccgccgcgcctcttgatgggtcaaaccgaccgaaaccgtctcaggcaaaagctccgcaggtccggaagagagcggatctgctgtctgaacaaagcattgtgctaatggaagctgcggcaaatgtttttcttcccacagatgaaaaatgcccgttacgggtgaggtcagttcggtgaaacattggaatagccggctttctgtttcttttccggggtgttccgaaagtttcgcttcaaggtcgcagatgagttcagccgaatccttgccgcaactgaagtccggatggggaagaaacgcatgccagccgccttcgagcgttgccaaatcaagcaggtacacttgattcttcttagataatggctcaagctccgcagctgctttcatcaattcgaacacaataacatttgccagcatgtcttttcctgccaaaggaaaggttccaagcgttcgttcttcatggagcgcagaccgatggaggcgcctccaggcagcctcgaagcggctgtctccgtgttgttggaagacagggcctgccagtccgacttgtttcagacagatgccgggtatgaatcctttgttctcttcaaggcaaaacgtttgaagatcgtggagatcatctgtgaagccgcggtcagagacatacaaaacccaatcggcagatcgcaccgcttcccgccaatgttgcgtttcggcgaagccaatctccagtccgctttctgtttgctctgatatttctgccagttcgtctaaagcatgcccggatgcatccgtcacgatcgcacggattcttgaaaaaccggaatcgatcagcgaccggaccaatttcgtgagaaaggagccagtccctgcagccaatattttggtttggcgcgacagctgaaagcggtaagcgccggaatcggcaaagctttcaataaattcgatttgggcttcatacgttttaagcactgagctttccagtttgtgcgggtgatcgcggctgacgtcgcgaacgaatccgtttttataaagcgtttctccgatttcatatactctctttcggtacggagcttgcagtccttttgtcaaatcttcaagcgaatgttccccgttgaacattggcagaagtttttcgaaccattgagcaatcgaagatccttttaagcgaaacgacccggaattatttctaaaatacgcgccgccgttcggatcaggaagaaaccatgtatcccggtttactttcaggcgagcggaagcagtcaggtgtgtcatgctcctcctcctttaatgttttaaaaacaagacataccattatatgtaattttgtttgtcctttatgctataaaagaccccctgcggcaaaagaggcaggggaagtcttcttttttataaaaaaactacatgcctccgtgccagcagctccagcagcaatgtcccgcacagctccaacagctgtgtcccatgcagctccaacagctgtgtcccgcgcagctccaacagctggcacagcttccgcagctccagcagcttgcgcagtgtttaacattggcgtgatggcggtccggatcccaatgcgtcatatcgtctgcctggaagtgatccatctccaacgactgcagttcatcatggaatggttgcattttaatatcccccttcatcgttaaaatttttgaccaaaacacagtaaaagaagaatgaaacataagcaaagtcagattaagtcaaataccccgggtactcacaagatcaaattatgaggtctgttaggtggttgttactaatttgaacgcctatttttcctgttattggattttgttggagggaggtttttattttgcggccatacttgcggcagtttattgatataaagatcgttggaggctgggagaggatgaaatcctaggctaagtagagatgtagcatcaaagaatgcaatctatgaaaataaggtattaataaaaatttgactctaaaaaaacggattcgattggtaatgaatttcaatgtagtgaaagtcgaattctcaagggaaagtcgtaaattaatgcaaaaataacttctggaaacaaacacttaaagtaaagaaagcatagagggtaaaggtagctattcggcttacggattagcaggaaaaaatcaattggcgttgtatatagcagtgaagcatcttctaaggacacagtgctcttgcagttttatgctgatgcgaatgcttatgtatcagttgctacaaaaactctttcaacaagtatgctttctaataatttgatagagaaggagagattgccttggccaatttttcaataataaatgcggttattgtattaggagtcttactattaattgtttgggggattgtctcctttattagaaattcaagaggatcataacatgatgaaaggccggacaacagaccggcctcttttaaatcgttatttcacaatcagcacggggatctccgattttgtcgatatcttgtcgctgacgctgccgaacaggagctttttcaggcggttctggtcgcgcgtacctgtgatgacgaggtcagcgccgatgttttccgcatgctgcagaactgcgttggccgtgtctccttccagcacctcgatttccgcgtcgtactggttttcgctcaatatgattttcgctgccgcaatcgcttcttccgcgctgtcctcgtagatcatgggttcaccggccaagtctgaatcgcgggggatccggggtgcggccgggaagccgctgtaaaggtatggcgctccggcagctggtctttcggccgcagcctctgttctcacttgcctcggttcatggacatgggcgacggtcaattgtgagccgagccttttcgacaggtcgatcgcttttctcagcgcttttttgctttcctcttttccgtcaaacgcgactatgatccggtcagctttaaacaaattgatcattcctttcagaatggatttactgtcatattacccgttttcccaacaaatctaacgaaatataagaatatgaatcaaaagcctgccattcgccaaaaaaacaaattgacaattaaagggccgtactataagatggaaaatattaataagattggagggtatcgtcatgattagaaatatcaatgcatcagttcaacaacaaaagcacctaaacgtgacatttccataccttccttatgctcaggaatccgtttcactctaacaattttcagaaggaaggcgcatgtcgcgtgaacaagcgtacatgcgcctttttatattaaaaaaggcatgctggtacacagtgtgccttttttttcggagaaaaaacatcctgtttccgatgcggagcagcatgtttttccaataaatcaaccgcacataaggaggaattttttatgccgagtatcagaaaaaacgaaatcaaagattgtaaggaaaaacttgaaggcggctaaaaaaggagaggatatcgatgttttctgttttatggaagctgggctggttttttaaagcctcatggcggcgctacacgatagcggtcgtcctattgattattgtaaacgtattggaaatgtttccgccgaagctgcttggcaacgcgattgacgatatgcaggcgggcactttttccaaggccggcatgctcggctatatcggtttatttcttgcgcttggcgcagttgtttataccctgtcctattattggatgtatcagctgtttgggggagcgaacctggtcgaaaaaattctcagatccaagctgatgggccatttgctgaaaatgacgccgtctttttacgagaagaaccgcacaggggatttgatggcgagggcgacaaatgatttaaaagcaatttccatgacggcgggcttcggcattttgacactggtcgattcgacgatgtatatgctgacgatccttttaacgatgggttttttgatcagctggaaactgacgcttgcttcgatcattccgcttccgctgatggccgccgccatcagcatctacgggaaaaaaattcatgagcgtttcacggaagcgcaggatgcgtttggcgctttaaatgatcaagtgctcgagtccgtgtcaggggtaagggtgatccgggcctatgtacaggagaaaaatgatgtcagccggttcaacagcatgacggctgatgtgtacaagaaaaatatgaaagtcgctttgatcgattcgctgtttgaaccgacggtgaagcttttggtcgggatcagctatttaatcggtcttggctacggcgcctatcttgttttccgcagccagctgacattgggtgaactcgtctctttcaacgtgtacctcggcatgctgatctggccgatgtttgcgatcggagagctgatcaatgtcatgcagaggggaaatgcttcgcttgacagggtaaatgaaacattggcatatgagcctgatgtgagagagcccgctgaacccgaagcagcggagccgggcgatattgtgtttgacggggtcacttttacgtatccgagctctgcgtcggaaaacctggccgatatttcatttaccgtattagaaggacagacggtcggaatcgtcggaaagacggggagcggcaaaacgacattagtcaagcagctgctgaggcagtatccgcaaggaaaaggaacgatcaccatttcgggcgtgcccattgaacgtctgccgcttgatcagctccgcagctggatcgggtatgtgccacaggaccacgtgctgttttcaaaatcagtgaaagacaatattttgttcggcggacacctcgctgaagaacgcgatttgcacgccgtcatctctgcagcacatctgaaaaaggatattgagatgctttcagacggcttggagacaatggtcggagagaagggagtcgctttatccggggggcagaaacagcggatttcaattgcgagagcgatgattgcggagccccatattttaattttggatgattcgctgtccgctgtcgacgcgaaaacggaagcggcgattattgaaaacatccgcagcagacggaaaggcaaaacgacgtttattacatcacaccggatgtcggctgtcgaacacgccgatttcattctcgtcatggaggatggaaggatcgttgagagagggacgcatcaagaactgatcggccggaaaggctggtattttgaacaatatgaagcacagcagcttccttcgggagaagaagggggcactgtagcatgacaacaggaaaaaggcttttccaatatgcgcttctttataaaaaaattctcatctgggcgctcgtcatgctgacgatcgccgtcacagccgagctgactgggccgatgatcgccaaaaagatgatcgacgatcatattctcggaattgaaaaaacgtggtatgaaacgacagagaactcgaaatatactgtttcctacaaaggaaaggaatatatcagggaagacaggacagacccttcagctgaaaagctgcaggaagttcacatctttcaagtcggtatgaactactactttgtggggaaaccggtttcctttgacggggagcggacggtttccgggggagagctgagaatgacgagcggagaccggacggaaacctacaaggccgatcgcctgtctttgtctgaagtgtatgctttttacgagcctgaaataggagggctgatctcgctcgtttctatttatttcggccttctcattttctcgatctttttccattacggccaattctacctcttgcagatgagcgcaaaccgcatcattcaaaagatgagacaggatgtattcgccaacattcaaaggcttcctatccgctattttgataatttgccggcaggaaaaatcgttgcaagggtaacgaatgataccgaagcgatccgcgatctgtatgtgaccgttctttcgacgtttgttacaaatatcatttatatggccggaatattcgccgcactgtttttccttgatgtcaggctggccggcgtctgtctgttgattgtgcccctgattgtcatttgggctgctgtttatcgaaaattcgcttcaggctacaatcataaacttaggtcaatcaacagcgagatcaacgccaaaatgaatgaatcgattcaaggcatgacgattattcaggcattccggcgcggacaggacacaaaagaagaatttgaacagctgaatgacagccactttcattaccaaaataaaatgctgaaattaaactcgcttatgtcccacaacttggtcaacattctgagaaatgtgatgttcaccgctctaatatggtatttcgggggagctgccctgaacgcggaaggaatgatttcaatcggcgtactctatgcattcgtcgattacttgaatcgtttatttcagccgattacgggcatcgtcaaccagtttgccaagcttgaattggcgcgcgtatcatcggagcgggttttccgcctgctggatgagccgggcgtcgatgtcaaagagccgagcagcgaaagagcgcgggggcgagtcgtgtttgaggatgtatcatttcgctatcatgacggtgaagatgtgctgaaaaacatctcatttgaagcgaagcaaggggagaccgttgcattggtcggtcatacgggctcaggcaaaagctcaatcatgaatgttcttttccgcttttacgatattgaaaagggcgatgtcaaaatcgacggcagaagcatatatgatatgtcaaggcaggaaatcagaaagcatatgggcatcgttctccaggatccttacttattttccggcacgattgcttcaaatgtcagccttgacaatgctgatattactagagagcaaatagaagacgccttgaaacaggtcggggctcttgaggtgctcgcccgtctgccgaaaggccttgacgagccggtcatcgaaaaaggaagcaccctttcttcaggagaaaggcagctgatctcgtttgcccgtgcgctggcatacgatccggctattcttattttagacgaggcgacggcccatatcgataccgaaacagaagcggtcattcaaaaagcgcttgacgtcgtcaaacaagggcgcacaacctttatcatcgcccacaggctgtcaacgatcaaaaacgccgaccagattctggtgcttgaaaaaggccggattatcgaaaggggaaatcatgaagagctgatgaagcaaaaaggccaatactatcaaatgtatgaactgcaaaaggggaaaggaaccctgatagggtaagccggatcttcacccggccttaataagcgagccccaccctcgccttgacaaactggtcagactctagctgtgtaaaaagaaaatgggcggtgtcgccggtggatatttctcttccgccgggcggcagaacatcctgttcaaaacggtatgtcttcaatgccggcccatcggggagatacgtcgggcagacgatcgtccaatccagatcagattcgcggagccgttcgtacacacgggcatgttcttgagctgcgcgcgtagagcgccgttttgattcgtttgtttcaaagcggtaaagggccgggttctgccttgcgtttaaaatgccggcggttccgatggtaatcagccgtttgatccgatgtacgttcatggcgtttatgatgtgttcgatggagacggtcaatgtatcgtctccatctgtgtttaaacagctgacaacgatatcgcaatcttttattaaagactcgacgtcatgccggttcctggcgtttcctatatgtgcttggcataaatccggaatgcgggcgccttccgtcctccggacaagtgcgttaacggaatggtgcccatcctcttcaacaaaattgagaaaggcctgtccgacacggcctgtacctccaaaaagcgcaatcttcaacatgatcactcccatcggatctatcatacgtcagatcgtccggaagaaaaagccccgcgtaaacaaaaggttccatgataaggacggacatttgagacatactcattcaatagagaaatcccgacaaattgaatcaattcccaattgatgctcaacatcagctgcatgccgacccctcctttataccagcatatgaaaaaaggagaagcgggtgcgggctttcacaagatatgccagaggggaggcccccgtgatggtaatgaatgagaaggtttgccgaaaagctaaagaaggtgcagtatatgcaccttctgttatccatgaatatgaagttgtttaaaattgttgaccgcccatagatgcttgagcttgggaaactaaacgttttgtaatttctccgccgacagaaccgtttgcacgggaagtcgtgtcagcgccaaggtttacgccgaactcagaagcgatttcgaatttcatttgttcgatcgcttgcgctgctcctgggacaagcagttgatttgaagaattttgattagccatttgtcatcaaactcctttataaaaatggtatggttgggctgactggagttgcaccagctgacggcttccaccgatagaaaaccgctgccttctcggctaaagcccaatgttggtttgtactacgtattatggtggattcaataaaataaatgcgcgtttcaatctggtaaatgttgaaagacgaaaaggttatgattggggcaagctaaggaaaaaagccaggaggatgaagaagatgatgtgtccagtgtgcaacgggattctcgtccagacgaggcattgtccgaagtgcggcggggaaatggcggacgccgggagagcaaccgattttttcggtccttacagtccgtacatggagttcgattcatttaaacaaacgcaaaccgcgtgcgttcatttatatacgtgccaagactgcacttatgaagaaaccgttgaaattgaaacgaccgaagcatagctgcatagagagccgcagcatgcttcggtcatgtttgaaactgtgttatccttcagagcggatgcggagctccgtttctttatcaaaaaagtgagctttattcatgtcaagcgccagtggaatcgtatcgccggcctgaacgtcggtccttgaatcgactctggcgataaacggctgagtgccggcctgcgaataaagcatcgtttccgcgcccatcagctcggctacctcaattttcgcatcgactttcgagtcttttgacgcttcaatgaaaacaggttcatcatggatatcttcaggcctgattcccatgatgatttccttgccgacataaccctggccgcgcagaactttcatttttccttccggcacgcgaaccgaaacgccgtcgaatgtaaacatgtcttctttcagagtgccggtaaagaagttcattgcaggagacccgataaagccgccgacaaacacgttttccggattttcgtagacttccttcggcgccccgacctgctggatgattccgtctttcatgacgacgagccgcgtagccatcgtcatcgcttccgtctggtcgtgggtgacatagatggtcgtcgtctgcagacgctgatgaagctttgtgatttccgcgcgcatttgtacgcgcaatttggcatcaaggtttgatagcggctcatccatcaagaacacctttgcatcccgaacaattgcccggcctaaggcgacgcgctggcgctgtccgccggaaagcgcttttggctttctatccaaatattgttcaaggcccagaattttggccgcttcatggacacgccgtttgatttcatccttcggaaacttccgcagcttcaagccgaaagccatattgtcatagacgttcatgtgcggatacagggcatagttttggaataccatcgcaatgtcgcggtctttaggagcgacatcattcatccgtttgccgtcgattgtgaattcgccatccgtaatttcctcaaggcctgcgatcattctgagcgttgtcgacttgccgcagcctgacggtccgacaaagacgataaattccttatcctcgatatgaagattaaaattatccacagccgtaactttgttgtcatacactttgtatatccgatcgagcacgagttccgccattttttctccccctcttttatgtaagcgctttaactgatttaagtttataaaaaacggcagggcggtgtaaatggacatggtgcacaatttcttttcgtgcatattgctgaagccgctaaaggagatgcatcatcaaataaacagcggctgcttcttcaaactgtctgatgtcaattgcagtccgttcgataaatttatcaattctgtactgcaggctgtttcggtggataaacaaacgtttggctgtaagagaggcattcaggttgcatctcatatacgttttgatggtcagggatgtctcgggatcagacagcgcttctcttacggcgtccgaaaatgaagaagcatgaacccgctccggttttgccgtcaaaaaagacgggaggcactggcaaaacgtggcgacgtttccgatgtcacccgcttccagcatgtaatgaaacatttgtttttcaaagcggattttgccttgaagcgatccgttgactggatgaagctggccgctgaaaaacacaggagttgccatgaaatcgcttgtcagtgcatccgcaagctcggacagctctttttttgcgagaaacggtgaaggattttcgtggacgataacggcttcatgccggtcgtaccatacaacaagcgggtctttaaaaaagccgctgaccgcttctttaatcgcctgtctttcttcaggggcatgctccattttaaaaaaatggccttgaatcagctgaatgtttcccgggttttggaggggggcatcgcaaaagaaatattcgtgccattctttctcccgctttgtcagctgctgcggacgatgcggttctgaaaaaggccggaataggcaatagagcagctctttttcccggtcggtgaccgcgcttttcaaaacgccgaaagtttcgccttcgtcggtttgaaaccataatgcatcgtgctttgaaacagccttagatccaaccatccgttcaccgtaaagcgtctttaatttctccagcatacgtcaacgtccttttctttactcgtaaatatggaagagcattaattcatgaatttcgcttttcagggaaggctcgtcatcatgcgggggataggtgctgccccactcgatttcccccgatttatgataaattccttcataatgaatccctttatgataaaacgatattttccagccgggaagcctttcttttttaaacagcggcttccattgaaagtgagaaatcattaacgccacgctccttcattgatttcaggtgggcaaaatccagcgagcagactaaacgttgatttgttatcattgtatctcattcacagaaaagatcatagattcttttcaaatggagattttcaaaaaaataccgtgaagaagcagattcttcacggcttgaggtcatgccacatgtcctccggattaaggattgactgttcggttaaataagaagcatattcaaagcttcttttcttcgttaagcggctgacagatgccagacggggatgggagaagattcctcggccgggccgggagttggcttcaaacagccacacctttcccgaacggtccaatcccaggtcaaagccgatttctccgatgaaaccgtcaagcttttcgtcaaggacccggctgagaaggaccgccgcttttgtcagcttttgcagagtgtgaagcctttcctgaggatcatcataaatctctgcaagtgttttcacggcgccgccgctcgacatatgggttgtaattccgtcctttccagcgattttggccgcgatggctgtgacggtccattgaccttttccgtttttgtttgtatgaaccctgaaatctgccgggtgatgatccacttcgatccgttcgatgccttgctgggcaagataagaagtatgtttgtgaagcatctgccattcttttaaacattcagcagcggacgaaaaagatgtgacgccttcggcatgtctggcaagaataccgttttcttcccgttttgaaagctggaatatgcctttgccgaaactgccgccggcgggctttacataaatgaagccgtattggtcgatcatgtcttcgattttatcggcatcgggctccaatgccgaaaatggaagcaattccgctgtcctctcgtcttgctgcagacattcatagatctcccatttattaaagaagcccggattgaaccacggaatgcggtattcatccataagccgtttttttgtttcccgcaaggcggaggattcttcggctttgcggttcggcagtctgtcgtatacaacattaggcagcgggactatggcctcctcccagccgttttccctgaaaatgagagcctgcaccgtgccttcttcccaattaatctggtgcgccccgaacagatagctgtagcctcctgccgggagatccatcgtcaaaagcttcgaaaaaaataaagaccttcctctgacaggatccagctgcgattttgtgaaaccggcggtgaaaatcccgattaaaggcccgatatagacggtattgtcgcgaaaaagcagggaggctttgccgcggtacggaatccgcaggtttttgtacagattttcggataataaaacggtgcgcttcaaatggctgtcaaatgagacatggcaccgttcaacactcgtaccgaaagcggcgaataacagaccgtcctgtttgaaagaagcgggcaggagcatcgtgttttcactcgtctggtggatgccgaccgtcagcggttgaccggtcatcttttctcagcccctttcgcgccggctgaagccgttaagaatgagcagtactccaaaggacctttatacaaaagctcccttttttcaggagagtgcttgataaaagcgtgttttccgggctttgagttgacatccagcagccagacttttccgtcttttgtcaggcagatatcaaggccgagctcgaataatggcccgtgatttgattcaagcgccaggggaacggcctgcgccattgtctctaaatcatcgagaaggacggcctggcgctttttcggcacggataaaagccagctgtcaaagctcaccgcctcagagccaccggccaggtttgcaagcagtccatgctgatagctccgccttaccgttttaccggctgtttcccattcgccatagccgtttttctgtagcagcaatctgatatcacaaggaaaaccgtccttgtcttgaatatcgaggaacgattgcagcagatagcggtgctgaagaactttttggcaccacgtttcaaatgaggcctgtttcgaaaatgatttcagctgtttgtgttttccggtttggtaggcggcctttaccgtttttcccgtaagctcaagatgaatgatgccgcggcctcctgatccggatgcaggcttcaagatgcatgatttttcttttgcaagcttgcgcaggatatcctgggcattttctgcaatcgttgttgcaggaaggtaggacttgatgacgggatcggctttcaatgctttgtaaaccgtccatttgtcaggaagtccaagtcctaaaaatgtcgttttaggatactttttgagccattcgacaatcggttttgcttttttcgattgctgatctctgccgtaaaagcagcggtcatagatcaattccgggatttctctttcaatttcattccactgtcctgacttcgggtgaaaggagagccctttcacaagcagggaaccgggggaaatatccaggggggtgaaccggataaatcggattccgtagtccgaagccactttggccagttcttcggcataggctttttcatgtccgtgcgacagcgacataaatccaagcgtgatcatgattatacctccttcatgaaaaacaaggcttaacaggctgagactgtcaaacttcgggcaaactttaatatatagacttctgtttcatgatacgcttgagattgcagaaataggcttttgtaaattggaaatgattaaaaattttagagcgccctttatacaattgccatctgacccattgtattttgaagcggcttgctccattccgttatttgcccgtcttttattcagctactataataacgttaggcaagacggtgaggaccatcgccaagacctacgctgtacagctatgatgtcaggtaaaaaggaaggcagttgaaaagaacatgtatgtatttgggatttttgccgttatgattgcagtcggtgcacttatcggcgctgtaacgaatcattttgcgattaaaatgctttttcgcccctataaagcgatctacatatttggaaagcgggtaccttttacgcccggattaattccgaaaaggcgcgatgaattggcgagacagatgggacagatggtcacaggccatctgctgacaacagaagggctcaaaaaaaggcttgcatccgatgcggtcaaaagccaggcggtgcaggttggagagaggcttttggcccgcctctcgcaatcaacggccaccgttgaagaagcattggaaagcatcgggatttcaaaccccgcccaaaaagcggatcgagcggtatccagattggcggatgagaagctgaccgcatttttagaggcgtatgagaatgaaccgctgaaaaagcttttccctcttgaggctcaagaaaagctgaaagaaaaaattccgatggtgtccagctatattttaagccgggctgtcagctactttgaaagcgatgaaggcaaggaacgcctcggacatatgattgacgattttttgaaagaacggggcatgctcggcagcatggtgcagatgtttttaggcaacagcagtctggttgaccgggttcagccggagattgtgaagtttttaaagaacggcgagaccgcggggcttttacaggatctgcttgaaaacgaatgggacaagctgaaagaatatacgttcaaggaagcagatgacaaatggaacctcaaacctctcattttcgatttgaaggaaaagcttttgaaacgattctcgcttcagccgtttttcgaaaagacgataggctcctctatttccagttttgagcaggatatcgctttgcgccttccgcagatggccgaccgccttctggaagaagcgggccgccgccttgatcaagcgctcaaacagctggaactcgagcaaatcgtcaaggaacaggtggacaacttccccgttgaacgtcttgaagaaatggtgctgtccatttccaagcgggagtttaagatgatcacgtatttaggcggcctgcttggcggaatcatcggagcggtgcaagccatctttgtgattttgatctgaggctgaagacggcctgctcatacggaattatcgtataactgtgaaaaacactccatagtttgttatagtggagtggtgccgattccataagaagaatacgggcaggaaaggagcggatcaatatgacggtcaatttacatgactcggcttatgacttggaacaagcattgcgtcaaagcgaagaatattcccgattgaaaaatctttatgatgaggtgaatggcgacccatctgctaaaaagatgtttgataactttcgcgatattcaattgaaccttcagcaaaaacagatgaacggcgaagacatcacccaggaagaggtcgaacaagcgcaaaaatccgtggcgctcgtccagcagcatgagaaaatctcgcagctgatggaagcagaacagcggatgagcatgctgattgctgatttaaacaaaatcattatgaagcctttggaagagctttacggaaatccggagagctgataaaaaatcccctcttgtcttgacaagaggggattttttcactaagtgaacaaataatgttcataaagatttaaaaaagacttgtcaatttgtgaaatagttgcgataatactaaatgtaagtgctttcatttttgccgggatacgatcatgaaaaacggactggcggcaaaatgataaggggtacagaggaatttgacagattgaaagcaccgtctgctggtcaaataaaggggttgtcaatatacggtgaattgaacgaaaggggcgttgaattcactgttttgaatatgagggagaatcatgatcgtatccacaagatgcgaagtcaaaagtctgtgaaaacaggctttttttagtatgtacatcaagagggctgttctaaaaaaagggaccgggacatatcctctataacagattcagtcatcaaagaagggggacctcctggtgtcaaaacaaatgcttgcgctgaatatagacggaacgctgcttcggacaaacggacggcttcatcccgcaacgaaggaagcgatcgaatatgcaaagaagaaaggtgtatatgttacgcttgtgacgaacagacatttccgctccgctcaaaaaatcgccaaatctttaaagctggatgcgaagctgattacgcacagcggagcgattatagcggacaaaatcgccgaacctttattagaaaaaaggatttccgaagaacagacatttaaccttgttcaaatactggaaagctatgattgcaatatcagaatcctccatgaaaaatattcgattggaaatcggaaaaaaacgaattcaaacctgctggggaaaacgatgattcacccgtctgacccgattttttatcccgtccagtttgtcgattcgctgagcgacatgctgatggatgaaccggtcagcgcgccggtgatcgaggtttattgctcaacaggtcagtccgaagaaatcaggcagacgatcacaaatgcgtttcctctcgtcgacatcattgaagcgggagaaaaaatgctgattgtccataaaggagtttcgaaagaagcgggattgacgatgctcgccgccgacctcggattaaaaatggaagatgtcgttgcgatcggccatgatatcgacgaccttccgatgatcgagcttgccgggctcggagtcgcaatgggcaatgctcctcaggaggttaagcaaaaagcggattgggtgacgcgctccaatgatgaacagggcgtcgcctatatgattaaagaatacttcagaatgcagcaaagcaaagggtttcttaaaaaattccatattaaaaaaatctgattcttataagatccccgcttcaactggaatgcggggattattcatttatcggtctcctaaaggaatgtatgtttcccggattgattttgcccatttatttttgtacactaaagaaagttttgaaacgaaaaaggtgatgacattgcgcatttatatagaagggctccaagacgaaaggttccagagaccgcttgagcatatagcgaacttattctttgaggaaagcgaagtcgctcttggcgaagaagcgccggcagaccttgcgatcgttctcggctatgaacgggaagaaaacggcgtcaaggcttccggtgcgataaaggatacggacattacagcagaatatgcgaaaaacattgaccccaagctgacggaaaaggaagcgtttaagcaggtgaagaataccgtttcctacgtttttttgagcatgcttcaggagcataccgggatcattcagaaatgggggattctcaccggtgtccgtccgacaaagctgcttcacaaaaagctggagagcggcatgccaaaggaagaggcccatgccgagctgaagcgggattatttaattcacgacgaaaagatcgaactgatgcaaaacattattgaccgtcagctgaaagctgtacctgatttgtatgagctgggccaagaggtcagcatttacatcggcatcccgttctgccccacgaagtgcgcctactgcacgttcccggcgtatgcgatcagaggacaagccggacgagtcggctcatttttgtgggggcttcactatgaaatgcaaaaaatcggtgaatggctcaaggagaacgatgtcagcatcacgaccgtgtatttcggcggcggaacgccgacaagcattaccgccgaagaaatggatttattgtatgaagaaatgcaccgttcatttcccgatgtgaaaaacatccgcgaggttacggttgaggccgggcggcccgatacgattacagaagaaaagctcgcggtcttaaaaaaatggaacatcgaccgcatcagcattaacccgcagtcttacgaaaatgaaacgctgaaagcgatcggacgccaccataccgtggaagaaacgatcgaaaagtaccatctgtcgcgaaatgccggtatgtcgaacatcaatatggatttgatcatcggccttccgggcgaaggagtaaaagaattcagacactctctttccgaaaccgaaaaattaatgcctgaatcattgaccgttcatacgctgtcatttaagcgcgcgtctgaaatgacgaagaacaggcataagtataaggtggctgaccgcgaggaaattgtcgcgatgatggatgacgctgtctcgtggacgaaacagcacggttaccatccctactatttgtacaggcagaaaaacattctcggcaacctggagaatataggctattcccttcccggccaggagagcatctataacattatgatcatggaggaaaaacagacgattatcgggatcggctgcggagctgcgagcaaatttgtcgatccgagatcgggaaaaatcacgcacttttccaatccgaaagacccgaaaacttacaatgacagatttgaacattatacaaacgaaaaaatccgctacttgtctgagctttttcagaaggatggttctcaacaagaatagaagctgctgccgggatcaccggcagcttttttattgcggaatcaggccggaatcggcaacaaaaaaaggttttggagggcaaaggtggaataatttaaatagtatcaattgtaaacgtattcacggaggtgcaagatggaatatatcaaatggaaagacgaagacgggatttttgaaattgtactgaatcgctctgaggcgtacaatgccttgaatgaaaaaatgcttgaagaactgaatgaagctttgcgtgttgcagaggaaagcgaatcgctgcttctccttgtgagaggcagcggcaaaggattttcggcaggcggagacattaagatgatgctgtcttccggagatcaagacagctccgcccgcgtcattgacacaatttctgaaattgcggtgaagctttacagcatgccgaagatgacgacagcggctgtccacggtgcggctgcgggtctgggattgagcctcgcgctcagctgcgaccatgtactggtcgaaaaagaggcgaagctggcgatgaattttatcggcatcgggcttgttcccgacggaggcggacacttctttttagagcggagaatcggtgaaactgcggccaaagaattgatttggagcgggaaaaaattgacgggggccgaagcgcacgagcttcggatcgcagacgccgtattcagcggggactccggccgttttgcgcgcatctatcttgaaaagcttctgcacgctccgctggcagcgatgattgagacaaaaaagatctatcaggcgttgaatggaggcaggctgcagaaaacgcttgaactcgagaaaacggcccagatgaaaatgaggctgacaagcgaccatcaggaagggatccgcgcatttttagaaaagcgccagccgcaatttaaccgtcagcaagtataacaagagcggtccggcaggaaattgaccttgggaaatgatgtgcagaaacaattgtaaaaaaatttaagtttccataaaatgattcataagatacagatctgtacgaagtcttgggaggcggcgaaattgaaacagaagattccatctgaatacgttgctagaaagctgaatgattggtacaacgccattcggaaaaatcagatcgccgccagtgaatcattgaaagcggaaattttaaatgattttcaagacatggaagaaaatcgggacgtcctgctctactattcgctgcttgaattcaggcataaactgatgctcagctatttgaaaccgaaagagactgaaaatattgaaaaaaacctccgcgacttagaagaaaaagaagaccaaatgacgggtttattaaactattattactggttttttaaagggatgtatgagttcaaacaaaagcggttcgtcaaagcaatcggctgctataaaacggctgaacaaaaagtcagcgcactggaagacgaggttgaaaaagcggaattttattataagcttgcggaaatctactattatatcaaccagagatacctgtcgatcaactatgcgacgctagcttccgacatttttaaccggtatgaaacgctaaaagaaaaaaagattttctgcgattttatcattgccggtaattgggttgaatcgatgacatacggacccgcgctgaaaagcctggccaatgcgcttgaagacgccaggaaaatcaaaaacagccatttgacggcagccgctcattttaatttgggaaattgctatttccaccaagaatcgtaccgggaagcctcagatcatatggagagcgccctttccatttttgaacaggaaagttcatcatatattcccaaagtgctgtacaacttgatgtacgtccgtctcaagcaggggaaccatgccggagctgccgcctgttatgaaaaaggcatccgaagcgcggcatcgctcggggatgaagaacacgcggcaaagcttaacattctgtgcgggctgtatttagacggaggggatcagaaagccgtggaaaacggatttgattatttggagtcaaatcatttatatgctgctgttgaagagctggctttagatgcagcccagtattataatcaaattgagcggctgaaagattccattttttactatgaaaagtgcgctcaggcaagtcgaaaaatcaaaaggggagatgcgttgtatgaaagctaaactgttgttcgtcgcggtgtcgctggctgttgtgttaacgtcttcaagctttttggcagatgcggggaaagccccttccttgtatgcggacaaaatgatcacgactgacaaggaggctcgagtttaagggcatgatttcatctgagaatgagcgggctgacgcagcgaaagaatgggcgatgtatattacagtttcttgccttttcatcctgatcgtctctgtgatttgttttttcgctccggtctaccgcttgcaggatctcttgtttcgaatgtttgatgctgtcatcatctgtgtgctgacggtcaatggtctttattatctgaaaaaaaataaaggcgtcgcttgcgcatcgtttttactcggcttcatcaacatgggactgctcgttgttttgatggtccgctagtgtttggcggataaagggcaggcggcggcagcgtgaaacttttcccccgaagcgccgccttacccgtattttagtcagctgcggaaaacaatgattttaccggacgaatgtactacccggtgtgtatgctccaaaaattgcttttccttcagcattcctcttcctttctctttcgcttcttcatcatcggccgcttcaaatcgctcattcaaaagcgtttctccactagtgtcgaaaacggttacataataattttccatttctctgcccctttctcaaaatatgatctatttgtttaaaattatataaaaatcaaaaaaatcctttttaaaatggtatgactaacgtatgattgtaaattggaaggaggagttataatgctcaaaatcgatcacgttacgaaaaggttcggttcatttacagccgtaaacgatctgacgctggagattccagacaagcaaatgttcggtctgctcggcgccaacggagcagggaaaacgacgacattccgaatgatactcggccttttgaatgcgacagagggtactgtcacatggaaaggacagccgattaactacggtgtcacaaacagcatcagctatttgcccgaagagcgcggactgtacccgaagctgaaggtgaaagatcagctcgtgtacctcggacgcctgaaaggcatgaccaaacaaaatgcgctcaaggaaatggagaagtggctcgaacgcttccatattacagaatacgccgacaaaaaggttgaggagctgtccaaagggaaccagcaaaaaatccagtttatcacggccgtgctgcacaagccggagcttttgattctcgacgagccgttcagcgggctcgatccggtgaatgtcgagcttttaaaagacgcggtcatttctttgaaagacgacggcacctcgattgtattttcaagccacagaatggagcatgtcgaagagctgtgcgaacacgtctgcattttgcagcgcgggacgcctgtcgttcaagggaaattaaaagaaatcaaacgttctttcggcagaaaaaatgtcacgattcacgcggacggcgacttgagcttcttgaaagaggcggacggcatcgtcaaatggcgtgatcattccgaaggagtccgcctgcaggtcgagaatgaagaagtctctcaagagctgtttacaatgctgcaaggacgcgggtttatcagaaagtttgaacttgaagagccttctttgcatgatattttcgtcgaaaaggtaggtgcccgttatgaataagttttggattgttctttttcatacatatatcagcaagctgaaaacgaagtcgttcatcatttcaacggccatcacgcttgcgcttgtcgtgctcgtcacaaatttgggatcgattatttccatgtttgacgacggcggagagggtgacaagatcgctgtcattgatcgctcaaatcagctgtacgacacgtttgcccagcaggtgaaagcactcgatactgatgaagcgctggaggtccaaaaagcggataagccggaaaaagagcttgaaaaagacgtcagagacgaaaagctcgagggcattttaatcctggagagagataaaaaaggggtgctgaaaggaacgtataaagcgctcgatatcgctgattccacagctgtctccacgattgaacaggcgctctcgcaagcaaagatcgccgttggaacggctgaattgaacgtacctcaggaaaagctgagtgaactgtttacaccggtaaaagtcaacagtgttgccttgaaagaaggcgcgaaaaccgaggaagagcttcaaaaggcgacagggcttgtgtatgttgtgctgtttgtcatctatttttccgttttgatgtacgcttcaatgattgcgacagaagtagcgacggagaagtcttcccgcgtaatggaaattttaatttccagtgtgccgcctgtccagcaaatgttcgccaaactgttcggcgttgccctattaggcctgacacagcttgccgcgctccttcttgccggctatctgtcgcttcagtccagccaggaaagcggaggggatgcggctgagctggttaaaggattttttgatgtttccggcgtacctactgcaacgcttgtgtacgcggtcattttcttgatgctcggctacttcttatacgcaactcttgcggcatttctcggaagcgtcgtcagccggattgaagatgttcagcagatgatttcgccgatgatcctgttggtcgttgccggattcatgattgccatgttcggactgaatgctccggattcgacgtttattaccatcacttcattcattccgttttttgcgccgatgatcatgttcctcagagtcggcgtgcttgatattccgttttgggaagcggctctcggcatcggcatcaccgctctcacgattgtgattctcgccgtcatcggggcgagggtgtataaaggcggcgtgctcatgtacacaagcggcggcggattgaaaaatatcaaacaggcgcttcgtctgtcaaaagatcgataatgaaaaagaaaagcagcttgaaagataagctgcttttttcatgcaaatagtagaacgtgcattcgctttcaacccgtggtagaatgggagcagaatgttttatgaaaaggagcagaagattgacaaacatcactttcattcatgcggcagatctgcatctggacagtccgtttcacggcatcagccagcttcccgaggagatttatcagcggatcaaaaacagcacatttaaaagcgctgaaaatgtgtttaagcttgccattgatgaacaggccgacttcattttgcttgccggggacctgttcgacgaagcaaaccgcagtttaaaagcacagatgtttttgagaaaacaatttttaaagcttaaagagaacaacatccaagtctatgtgatttttggcaatcacgatcatctgggcggcgattggacgccgattgaatggccggacaacgtccacatcttttcagcggaagacattgaagaaaaatcgttttacaaagacggccggctcgccgcaagcatctacggctacagctatcccgagcgctcagtttatgccaataaggccgctgaaatcaaaaaaacgaccgacgcgcccttgcatatcggcatgattcatggaacgctttccggggagagcggccatgacccgtactgtcctttctcccttcaagatttaaaaaacggacagatggattattgggcgcttggacatatacataaaagacaggtcatttcagccgccgatccggcggtgatttatccgggaaacacacaatcccgccatatgaaggaaacgggggagaaaggctgctatctcgtcaatgtttgcggcggagaactgtccttcgaatttaaagccgtatcggatgtcctgtgggaaacggccagcatcgatatctccgggacaaagcagatgacagagctgatcagcctcatgcacgatgcctttcaatctttcagaaaaagaggcaagcccgcatgcgtcaagatggtatggacaggagaaacaccctcttatttggcggaaggacaggccggcatcgcggacgagatccttgacatcttccatgaagaagaacgggaggaagacgcgttcatctggcttaccgcgatcgaagatcaaaccgatgccgccttgtcgggaatcgaacgggacgcttttttccaggagcttttgcaagaaatccatgagtttcaagatttcagcctgattcttgacgatttggagcggcatccggtctttagaagacacggagagctgtttaatgaggaagacttccgggacattcgcacgcaggctgaaaaactgctgcttcatgaactgaagacattgaaaagataaggggggatgcagggtgaatatacatgcgatacatatatacggatacggtaaattcgccaatcagacattccgcctgtctccttcaaatctgcatttgatctacggactcaatgaagccgggaaaacgacgctcatgtcgtttattgaaagcgtgctgttcggttttccgaagacgaaacggtacgagccgaaaacgggcgtcatttacggggggatgcttgaggtcggacaccctgatttcggccaaatccgaatcgaacggacggccggaaagcccgagcgggtcaccgtttacttggaagacggcagcacgaagccggaaggttttttaaatgagctgctgtcaggcatcgacaggcagctgtataaagcgatctactcatttgacgtgttcggccttcaggaaatccataaattcaaccgcgacaaaatcggccgttttctgctgttttcaagtctgttcggctctgatgcgatttccaagctggatgccggcctcgtgaaaaagcaggaagagctgtttaaaccgaacggaaggaagccggagctgaaccaggagcttgatcggttaaaaaggctttctgaagatttgaaaaaggcgaaagcgcgggaaggcggctattaccgtctcttaaacgaaaaaaaaggcgctgaggcgtcgataaaggaaagcggacaactgctcaaagatcttgagcatctcgtcttacaaatcgagcaggccattgagattctgccggcggccgcggaaatgcgccagctaaaagagcagctcgcatccctcggcggctcagaagaaagccgtttccccgaaggcggacttttcgagctcgaaaagctcgaatcccacctgcatccaaaagcggctcagctgaaggcgctggaagaaaaaaagcgcggtttggaacagcgcgccgccgcttttgcaccggctgaagacttcctcgagcacgaagccgaagcggaagagcttttaacggcgtatccgttttaccagtcgtataccgaaaaaatcgcgtctttgactgaacagcttcaccagataaacggacgggttcaagcggggcttgaccgcctgcaaatcgaggaatacgatatcctcaatgcggacaccacgtatgaatacgagtggaaactgcaggaaaccgttcaggcatacatagagctgcgcgaactgaagcggtcgctcgacgagcggtttgagcaggcgagggctgatctggaggaagcggaacaggcccatgccgctctcagcaatgaagtgatgcccgatgatgtccgaaaacaaaaggaagaaacccttggccgccttgcgtccgccggcggtcatgccggaaggcgggaagagctgatccttcagctgtcctatctgaagcaagaacaaaaagttcggatgaaaagaagaaggaccgcttttgcgggagcgctttgcgctgcttttgcggcagcttttgcggcgctctttttcaaggagtggttcccgggcgctttgctcgcgccgattttgctgatatttgccgcttttattttaaaaaagcctgagccttccgcggcggcggcttttattcaaaaacagctggatgatattgaccacagcggttcaaaaggcggagtaagcgacagcgctttaagggaggagctgtggaaggacgaccaaacccggcagctccttatcgccaaacaagctgagctcagacagaaagaagcggaatatgaaagagcgattcaaaaattcgaagagtgggaaaaggatatccgtccgtatcaggagaagaccgagcgctatttaaaagagctgaatctttcaattgacccgtcatttttagctgatgcgtacgctttgattaaggaactcagagaggaaattttgaaaaagcgggatatcgagaaggaactgagccgccttcatgctaaaaaagcatcctttgaagcgggattgagaaagcttgtcacatccctcagccttgcgggcggaagcgtccaagagcaggtgtttcagctgaaaagcgagcttgagtcccaaaaagagaaacttcgtcaaaaacaggaagcagacgtgtctttaaagcatgcggccgaacaaatcaaagagctggcgaaagaggtggaatacttccaatctcaaattgccgaactctttcaaaaagcaggggcggacggccgtgagatgttcgtcggactggcgaagcgcgatcaagccagaaaagaactaacggctaggctcgggcagctcaaaagagagctcggcagacaggacgagaaggccgttatgctcgcctcaggccactctctggcagaactgaaaggaaagctggccgagactcaggaaaaaagagcgcgcatagaaaagcagctgacagaagaaaggcagacggcggctaatttccatgcagagctcgccagacttgaggaatcaggagcggtatcggagcttgcctatcagaccgggatgcaaaaagagcgggtcgccgaattggccaaaaagtgggcagccgtcaagctgatccggcaggcggtccaaaacaagatagatgaacataagaaggttcggcttccgaagctgttacagacggctgaaacattactgaacccattgactgccggacaatacgaaaaaatttatttttctgaaacagatgattccatgatggtcatgcggaaagacggagctcttttttgcgcacacgaactgtctcaggcgacttgtgaacagctctatttagcgatccgattcgctctggccctctcccatcaaaagaatgtcaaattgccgttccagctggatgacagctttgtccacttcgaccaagagaggtttaaacaagtgctgaacattttaaaaaagctttcaggcgaagatcagcaaatcttgtattttacgtgtcatgaacatgtaagagaagctttccgcgatgaagatgtgattctgctgccttccggaatgaaaaaggtggaaggaaaggagatgactaacaaataaaagtgtgtgctataatgattttatgtaggaaaacggagggagctttatcatggcaaaaggtatcatgctgcacgaagttggcgagcaggtggatttgtacttgctcattaaatcgtcaacgaaaggaatcgcaagcaacgggaaaccgtttttaacgctgatgctgcaggatcagtccggagatatagaagcaaagctgtgggacgccaagcagcaggacgaagtgacctacggcccgcagacgatcgtgaaagtggtcggcgacattcatcattaccgcgggcggaaccagctgaagctgagaaacatcagacctgcaggcgagaacgaaaacgtcaaaatcgatgactttcttgaaactgcaccgattcccaaaaacgaaatgatggatgcggtcactcaatatatttttgaaatgaaaaacccgaatatacagcgaatcacaaggcatcttgtcaaaaaatacggcaaggaattcattgattatccggctgcgacgaaaaatcaccacgagttcgtgtcaggtctcgcgtaccatgttgtttccatgctgaacctggccaaatcggtcgcagacctgtatccgtcgctcgatcgcgaccttttatacgcaggcgtcattctgcatgaccttggaaaagtaaaagaactatccggcccggtgtccacgacatatactgtcgaagggaacctgctggggcacatatcgattatggtgacagaaattgcaaaagccgccgaagagcttcaaattgattcagaagaagtgctgattcttcagcatttgattttaagccatcacggcaaacccgaatggggcagtccgaagccgccgatggtcaaggaagcggaaattcttcactatatcgacaaccttgacgcgaagatcaatatgatggacagagcgctcgaacgggttaagccgggagaatataccgaacgggtcttcgcattggataaccgttccttttataagccccgtttttcacaaataagcgtcataacttgtctcccttttgcataatgtctggtatacagtttattcaaaaaagggggaaaagccgtgctgctgtttccgtggtgggtgtacctttgcatcgtcggcattattttcagcgcctataagctgatgacgacggcaaaggaagaggaaaagattgaccaggcttttatcgaaaaagaaggccgcatttatatcgaacggatggaaaaagaaaaagcaaagcgcatgaagcgtacactggatgaagatcaagaacagcatgaaaaatcggctgacagccattccatcgcataaaaaaagctgtccgaccccaacgaggggaggacagcttttttggcgtcagctgctgctgcttgtctgagcttgacgctggtcgacttgttttttcaactctttgtcttttacttttaaatcagcatctttgacaagtttgtcaatgacggattgcagttcagtttgatcattttgcttttgttcttggacttcttttttaagctcttttttcatgtcttcatatttgccgcgttcttcgtcttttttaatgatgtgatagccgaattgggatttcacaggtccgctgatttcgccggttttcaaagcaaatgccgctttgacgaaatccttgtccatgttatcgtctttgccgacccagccgaggtcgccgcctttttcggctgtaccgtcagttgaatactcttttgcaaggtcttcgaatttttcgccttttttcagctttttctcaacttcttcagccgttttcttttctttcacaagaatgtggcttaagtggattttgcctttcaggccgtcataatattcttttacgtcatcatcggttacttttatgttatcctttgcggctttttgcatcagaagttcgtatttgatctgttctttgacgaagtcttcgcctttttggtcaatgagctggttgagctggtcacccattgattttttgtactcgttcagctttttgtcgatttctttgtcggagacatcgtatttatcatcgagtactttttgctgaacaagcatgttcagtgcgtccgctccggcattgtcttttaatgtttgataaaggtcttcttttgtaatatttccagcttttgtttccgcaacaacctcagaatctcccccgctgcatgcgctgagagccagcacgcttgtcgctgtaatcgccgcaattgcaatcttcttcataaatgcaaacactcctaatcataacagtttaaactttcctttgaattgtatcatatcatattctgacatgctgtaaaaagattttcaacagaggggcatccgtctagtcaaattttctttccgctcatacaaatatattgatcaagaaaaggaggtcaataacatgagcggaggatactcaagcggttttgctttattggtcgtgttgttcattttattaatcatcgttggtgcagcttatctgtactaaaaccttagaaaatgagaaaagaaccgtcattttttcaggcggttcttttcttttggacgatagcctaatcgtttcatgacattcgtgcatacactaatgtaacgactggggcagaggaggtgtcaatatgggcgacggttatgcaggaggtttcgctggcggctttgcgctgcttgtggtgctgttcatcttattaattattattggtgcttcttggatatgctaataaacaaaaggatagctgccggatcaatacgatcggcagctatcctttttctttacaccgtaaaggaaatctcaatgaatgatgagatcaataaaattaagatcagcacattaatcattctaaataccttatcctgccgctcttcaggaatctctctgacaaggcataaagagtttgtaagcttgtttatgttgaagacagtaaaaaccgcaaacaagatgaaataaaaaaggatgataggagatccccctctctgtttctgctccatactacattaccaaatatttattaaaaaagatagaaaatagactgaaaaaaaggaatttccaactgcctagcagctggattatttttgtattaaaatatcaaaatcgtcggcttcctgatcgacaaagcagtttttaggcgctttgatcagtttccaggcaaacagaaaatcaggcagacaatagccgaaatgaatgcttgagatgatgcagaaatagtgagcaaagctcggcatcgccgcccccgcgtaaaacaaaacaggcgtgatgaccaaaaaagggcagagaagagagacaagcatcatgtttttcggaatttctctccatgttctcattttcaaccaataaatctttttttctaactttttcttgctgatcatcggcaagatatgaagaattttatgggcgattatagctgcaaccaaaagtcctgcaaacaaaagggcatgatcgcctctctgaacagtttgcggatgaataagctgcatcgctaaatattcgggaataaaaaataaaatcattaaactgacggcagtgagcacgatgcgcatgcctccataatctttaacgagattgatggttttccagcaactcataaatgacatccttccgtttcaacaaactgttatatgaaatcctcagaataatttactcctctggatgagaaaaatcaatccctttttcgaaaaaaatttcgtcattttccaaagaatttagaagggtgtaaaaggatcagaaatctccagtgttgaactttcatcagaagggaatatcggctaaaataagagaaagggagagaagagacaaatatgaactcaatggagcaacgcctcgagcggctggaatattacatcaaactgttattgaacaatgcggatatggaagagtatccgtactataaaatattgatcgaaaagggcttatcagaggaagaagcaaaggaaacggaaaagctgtgcgaagagctctcaaaggagcttgaagcacaaaaagcgcaaggatttgtgatgttcgatcatctcctcacgctttttgccggacagttaaatgaaaaacttgaagtgcacgaaacgattttcgcccttcacagacaaggtctttacaaaccgctgatgagcgaattcatcagcattatcaggcagtacgatctggcttagtttttaagaggctcaagcggtttgtccacctctatcgattccccggcttcttttgcttcttgttttttcttcattttgccctcttcgctcgtaaattcattttcgatgtttgaaaacgatttttcgaaaatttccatgaaatcatcgccgtaaatatggcggatgatcgacatcatctcgacgatttctggaaacttcccgtacagctgatgaaggggctgagcgccttttaagacggcgttccgggtcggatcgtaagactcgaggattttaaggaaaacttcttcacctttcggagtcagctgaatgtaagtgttgcgtttgtcattcaattttttggaaaactccaggtaacctctttcctcaagcttttttgaaaaattaaacgctgtggatacgtgcatgacgccgaacttggcgatttctgaaatggatgctccgttcagctggtaggcgatccacaaaatatggtgctcgttaatgttcagatcataaggtttaatccactgctgccaatccttttctatcgacttccaaagcgccttgctaagctgtgccattctttgactgaataaaagggcttctttcaccgtatagggctcttccgctcgattcattcacttcacctgcttctctttatcttataatttctattatgccaataaaataaagattaataaagatgtaaatttacgaattttttaaaaaatccagttttacggtgtgaaatcaggattttacctaaaaaaggagcgtgaaaattttccattcacaccccttttttaaggtttatttttttcgctgagtatattagttttgtaaggttttctccagctgttttatcttttcttcgatctcagcgatttccttttttaagtcctgctgatgaggtttgatttcctcgcgccattcctggatggacgtttgcagttcgctgccgacgtctttaatgatttccgcgccttctatggcggttttgacgaattgctcttttaatgcgattccgtcgtttttcagccttttgacggtgtcttcccatttaccgcagttggctttaagctgtcctctcaagttttttcctgaagtcggcgcggtcagcaatgctgcaacaccgccgataacaccgcctacaatcagtccagctgctaaagatcggccttttgacatgtaaatcaccccggttatatttttaaagatcaggcttggcaggcgccggccttctcatgattagatattggcgtccgagccgggcaaaccgttcctcttcttagaaacttctgcatagcttgctttattttagcatacttttttaaaaaggagggagagggttgtctgtcataatcattgttttgacaattataagcgctgtgtttaccgccggctccttttattatttaaggcttctcggatattctgcatcttatccgccgaaacgcattcttaaacaaaaagcgcttttttgcacgggaagcgcagggttggcgctcctgctccttttttttattcagcttcttatataaaatatcgggcggattcccctttttttgaccatcaaaacgaaaaaaacctcttccaaaaaagatattccttttctagaagaggttcttgttttatttgacttgttcaatcagccttgaacgcttcatgatcgactgcacgatcggaaagatgaccgccatggcgatcgtgttgatcacggcagctggtaaaacgacaacagagaacagggtgatgaatccctgatttccaggcaggccgacaatgaacagtgcagccgtgaggaaaatcgttccggaaagaacggttcctgcagcagttaatccggcggcagcaagcgttttgctgttcagctttttcacaagcagaaatacgccgaagaacatcaaggctgttagcggtttgtcgatgatgttgggcagctgtcccccgggaaaagccgtcgtcaacgcggaaatgacgcctgtcacggctccgatgacgagaacattttgcagtctagggaacaaaaggattcccataaacatcatgatcagcatcatatccggcttcattccgtagaaaaaaggcggaatcacagcgtgcagcgccgctccaatggcgacaaacagggccatagccactaattcttttgttttcatgtctattctctcctcatctaggctctttttacgctttccaataatatgctcgtcatttattgcgaaagctttctagtagtatatcaaactttcgaaggaatggggaagcctttttcgccatcttccatcatcaggataaacatcagttttcttcgcggaatttcttcataaaggcagccagcttttcgcagtcttcaactgatacggcattgtaaatcgaagcgcggcagccaccgaccgaacggtgtccgccaagccctgacattttttcttcctttgcctttgcgatgaatgatgctgtcagctcatcatttttgagcgtaaaggtgacgttcatgtttgagcggctgtcttctctcgcatggccgcggtagaatccgccgctttcgtcgatcgcattgtataaaattccggccttttcgcggttgcgtttctcaatggcatcgaggcctcctttttccttgagccactccagcacgagagacagcatataaatcgcaaatgtcggaggggtattgtagagcgaatccgctttggcatgtgttgagtacttcagaattttggcaacttgctcattttccttgccgagccagtcttttttcatgatgacaacggtcacccctgacggtccgaggtttttctgagcgccggcatagatgatgtcaaattgggaaacatcgatttttctgcttaaaatatcgctggacatgtccgcgacaaccggaatcggagcgtcggggaacttttgccactgcgttccaaagatcgtattgttggaagtcaggtgaaggtaggccccgtctgccggaatctccggtacttcaggaatatagctgtacgtatcttctttgctggacgcgatgatcgatgtgtttccgaagagctttgcttcggccagcgctttttcagaccaagcgcctgtcataatgaagtgggccgttttgtctttggagagaaagttcatcggaatcattgaaaactgaaggcttgctccgccttgcagaaacatgacttcataatcatcaggtatgtccatcagttcttttaacagagctttcgctttttgatgaacggcgtcatactctttgctgcgatgggacagctccatcacggacatccccgcaccattgaaatcaagaaattcgtcttttgccttctgaagcacttctaaaggcagtgctgctggtcctgcgttaaagttcgttgtacgtatcatcacaatcgctccctgttcgtgtataaaaatataaaacaatcctatcataaaaggttccggttatacataaaaaatttgaattgtgtgaaatatagagcaatggctatttagccgtgccgggcgatctgataaatgtggagtttttttgaacgaaaaaagggcgccggcagctgccgacgcccttggacaacgtctcgattacaggtgtttgttgatggaagctgcaatgttctgcaagtcttccggtgaatagtcatccgcatgggttttccagacggctccgaatccgtctcctttgccgtagcggggaataatgtgcatgtgataatggaagacggactgtcccgctttttcgccattgttattcagaaggttcaagccgatcggctcgtattcgtctttgatggcttgcgcgattttcggaaccgcttcaaaaaactctcgtgaaacttcaggtgtcatttcgtaaatattggttttatgaacttttggaatcacaagcgtgtgtccttttgtgacttggctgatgtcgagaaaagccagcacatgttcattttcaaatacctttgcacaagggatttccccgtttatgattttgcagaaaatacagtcgctcatacttttcctcctttttccattagggaaaggttatgtataagcaacatattaccacaatttgcgcagaaacacgaaaaacaggatgaacggctccaacgttcaccctgcctgaagaaggttacgctttaatgaagaaacgttaactgccttttgcaagcaccccatttttcgtcaaaatgaagacttgtaacgcctatacatttcctgcgacaaacacctcatttgatcgtcacaccttttttatatgacgaagacgtcaaataaagcaggtgctttctcaattcagtggatgaaagaaatttctaagcttgacatgtttcatactcaggactcttgccggattttgtctttgacaaacacctcattcgccagagttgataagctttcccttcttcaagaattagaatgtcctaaggcgctttcgattattcgttttatttttacggccgaaaagcgggagggaaaacgtttcaaatacattcttgtttttggtactattaagaaaaatgcaggaaaggaacgaacgtatgtcactactgactgttaaagagttaactggagggtatacaagaaacccggtgctgcgcgatgtttcatttgcgattgaacgggagcagatcgtcgggctgatcggtttgaacggagcggggaaaagcacgacgatccggcatatcatcggcttaatggaaccgcacaaaggatctgttgaattgaacggcaaaacgttcatggacgatccggaaagctaccgttcccaatttacgtttattccggaaacgccgattttatatgaagagctgacattgaaggagcatttggagctgactgcgatggcgtacgggctttcgaaggaaacgttcgagaaaaggctgccgccgcttttgaaggaattcagaatggagaagcgtctgaaatggttcccggcccatttttcaaaaggaatgaagcagaaggttatgatcatgtgcgctttccttgtcgaacctgacctgtacattatagacgaaccgtttctcggtcttgatccgctggcgatcaatgcccttctcgagcggatgaatgaagcgaagaaaaacggctcggccgttttgatgtcgacgcatattttggcaacggcagagcgatattgcgactccttcatcattctccataacggcgaagtgcgggcgaaaggaacgcttgaagagctcagagaacagttttcgatggaagaagcgagcctcgatgacctgtatcttgaactgacgaaggaagagagctatgaatagcattctggggatttggaagacaagaattgaggagtatgtcaaagaaacaagatcatatttgaaatacatgctgaatgaccaccttgtcatcgtcatgatttttttcctcgctggagctgcgagctggtacagcaaatggctgaaagagatgcccgaaggttttccagcctattgggtgatggccgtcatcttttcgctcattttgacaggctcgtacgtccgcacgctgattaaagaagctgaccttgtctttttgctgccgcttgaagcaaagatggggccgtattttcagcaggctttccggtttagttttttgacgcagctgtttcctctggccgccgcggccctcgctttggcgccgctgtattttgaagcaagcggcaaggggttttccgcgtacctcgtcttgctgattcaactgctcgtcttaaaaggatggaacacggctatgcaatggcggatgacgtttttcggcgaaaaaaacatgagggttaccgaccggtttgtcagactgcttctcaacacgatcgggatctatttcgctttagagtcttcatacgcatttgccgcagctgtctacctgatcatggccgcactgtatgtgtattttaaggtgatcgataagaaaaaatcgtttaaatgggaactgcatattgaagacgaaatcagaagaaagcagcggttctacagaattgcgaacttattcacggacgttccccaccttagaaaacaggcgaaaagaagagcatatctcgattggatgctccggtttattccgtatgaacagagccggacatttacatatatgtacggaagggcatttatcagatcaaacgactatttcggcatcgtcgtcaggctgaccgtgatttttggcatcatcatcgcttatttttcggcatatgagtgggtatcggccgcgctcatcgtcttcaccgtattcattacaggaattcagctgacgccgctgtttgatcatttttcacacctgccactgcaggagctttatcccgtcaaagcagaagaaaaacggaagagctttttcggcctgcttcacatcgttctgagcgtccaggcgcttgttttgtctgccgctgccggagccatgatgcagtggaccgggatgctcgccggactggccggatccgcgctgcttatatttgtgattttgaagccttatttcagcagcagattgaagaaaagtgccaagagatagatgaatccttttctttttccgcaagtatgatgaaagaagaggtgagtggcgcatgaatgaaaaccagctatatttggaggaagcgacccgctggaaaatgaagtttctcagaaagccgtcgatggctgagcggatgtcgaaaggggtacagtcgaaaattaacgcccgcattcccgccaaagttcacaaggcgataacagaaagcattaaaaagatggtcgaggctactttgctcggctcaaatttaacgacttttgacaagaaaacaggcacgctttcgctaagggaaaaagatgagctggctcagaagacaatcgctcaatatcaaaaggcggctgctgttgaagggatcggaacaggcgcgggcgggatttttctcggactggcggactttccgctcttgctcggcattaaaatgaaatgcctgtttgaattggcgtcgatttacggatacgatattaaggagaaagaagaacggatgtttcttctgtatatttttcagctcgccttttccggagaagcgcaccgaaaagaaattttccgcatgatcgaacattgggataccgaaaagcgcgaaatcgattggcaggcttttcagcaggagtaccgggactatctcgatcttgtaaagctgcttcagcttgtgcccggcttcggcgcggtcgtaggcggaacggctaactataagctgcttgggcaccttggggaaacagcgaggcacgttttccatctgagattgattcatgagacagccggatattgatgatccggctgttttttatgctatttcggttgttccattgcaggcgtttcgcggaccgcctgctctttctcctgataggagaccgcggcatttgccagcactttggctgcgatcagcatcgctttttcatcgatatcaaacttcggatggtgatggggaaacaccgcctccggatcttcaggacgggcgcctgtgaagaaaaatgtccctttgacgtgctgcaagtagtaagcgaaatcttccccgcccatttgcatgccgctttcttcaactttttcaacgccttccgtctgtttggcgatttttgcgagaaaagacgtttcttccgggtggttgcagacaggcggatagcccctttcgaaggaatagtcgcagtcagcgccatgcatgccgcatataccttttgcaacctgttcaatttcgttttcaatcaaggtgcggatttcttcattgaaggaacgcgccgttccgattaaaacggctttatcagcgattacattaaaggagttgtcggcaacaaatgaacctgtcgaaatgacagccggctgagtcggatcaagcctgcggctgacaatctgctggagggaagtgacgatctgcgatccgatcagcacggcgtcttttgttttatgaggctgtgcgccatgcccccctttgcctttaatcgtaatcgtaaaacggtctgcagcggccatgatcggtcctgtccggtattgaactgttcccgtcggctctgtagcccacaaatgggtcccgaaaatcacgtcaaccccgtcaaggcagccgtcttcaatcatcggcctggctccgcccggcgaatactcctcggcatgctgatgaatgaagacgatctttccttttaaacggtccgcgtgctcattcaaaactttagcgaggacaagcagggttgccgtgtgcccgtcgtgtccgcaggcatgcatgactcccggcacagtcgatcggtaaggcgcgtctttttcatcatgaatgggcagcgcgtcaaaatcggctcgaagcgcaatgacggggccgggagatccgccttcgatgtaggcgagaactccgcctccgcctacgttggtgcggataggaataccgagcgcttcatagtaagaggcgataaatgcggctgttttcttttcttgaaaagaaagctccgggtgctgatgaaaatggcgcctcaatttgaccatttcatcgtagtgggcatcaagctggttattgatttgtcggacaaatccggatgcgctcaaaaaaattcctccttttaggaatggtaagtttttataattttatgacaattggagccgctgttcaaccttgctgtcccgtatttatagaagaaaaatggcggcaatcgttgtgacggttaatccggcagctacaggaataaagttttttctggcaagatcgaacgggtcaactttgcaaatcgctgcaactggaatgagcgcccatggcacaagcgtaccgccgccgacccaaatggctgagatttggccgagcgcagtcagaacggctggattgctgtcaaccgccgcagcaaacatcgaagcggctgatcctgcgagagaaatccccgaaaatccggatccgtcaagaccggtcaccgctcctgtgacagtgagcgcaacagcggcgatttccggagagagcggaacgctgtgggcaaaggccgagccgaggtcctgcacgatcctattagaaaaaccgggaatctctgctgtcagtactttttcaaaacccgcatcgcccaagtaaaaaaaggcggcgattggaatgacgggggcaaacactttaaagccaaactgaaatccgctaatgaaatagccggtgattttctcaagacgccggtgtttgtggacgataaaatgaatgagaatcatgacgaagactgccgttcctccgacaagcgccgtcgcttcgtccccctgcagttccaatatcagcatcgcggcgatatctcctaaaaaaatgaccggaatcaacagcgcgagccattttctggaggtctggggaagaagccactcaggctcgctttgcagctgcttactggccgctgctctattgcctttctctttccggagcatcaaaaaggctgcccccgttgtcgaaaagcccatgatcaagacgagcggaacgcttgcagacatcacttccgcaacgggcagcccggctgcatctccggtcaatttaggcgctgcctggatgatgtaatcgcctgataaagcgaaaccgtggccgaataaattcatggcgcacgctaccgccatcggggagaggccggctttcagcgcggcgggcaggaggacggcgccgaccaatgcgacagccggggagggccaaaaaaatgaagaaatgataaacattaaagctccggtgatccagtaggccaagacagggcctttcatccatttggcgatcggagtgaccattgcttcattgacgccggtctttaccagtagctcactcatcgaaacggtaaagcagatgatgaaaatagtcggaagaagttccccggcggcgtagattaagctgttaaacatgcccatcacagacgccatgactgaatgggtcgcggctaatgagatgaaaaaaatcccgacaagcgatataaaggtggtatcaagacgaagtagcataaatgcgagaatagctgcaataaagcccaaatataaaaagtgaacggacgttaattcaatttccattttccgatcccccctttaaacataacctcatacagcgtattcctgggctgtcagagtgtgaaggaagggctcatttcctcggaaataaaaaaactgcctaaaaggcagttattcgacagaatgatacgaagaaatataggatgggcgggaaaaaatcgttccgccttggttgattcctgcggaagattccttcttttggtgggcttcgctgaacgacttggagtttttccagtcttgaaatgactgttctctgtcccacagtgtcaatacgatatacgtatcgctgtctttcggcctcagcaccctgagggctttaaagccgggctgattttcgatttttccggctctgtttttaaaacgggcttcgaaaagcggccttccttccggtgtgacagggatgttgttgaggacggtgaatccggaatgttccaaagatcccgactgatcgatgatttcgtagcggtgaggagaatgaaagacgctttctccgtcggtttcgtgaaagagaatggcggaatcgtggcttttcataaataacatgttttcaagaccgtgctgtttggcgagcttttttaaaaaatcgacagttccgtatgtaatgtaaaaattcaattttatcaccccttttttgatagtataacaaaaggacgatttaaaattctatccattacccgctataaatgctgcaacataatttgaagaaaaaattcccatactagctatagaaaggaatgaggtgaccatatgagaaagagatttttcattccaatcatcattacagcggcgatattccttttatcgttaatcggatatattacgattttgttcctgggggattatgtgattgatgaaaagaaactgattttccatgcttcttctaaaatcgtcgaccataatggagaagaagtcgcaagcctctataccgaaaacagaaggcctgtttcaattgccgaggtgccggacaatgtaaaaaatgcctttatcgcggttgaagacaagcgcttttatgagcaccacggcatcgattttaaatcggttagccgtgcggtctataaagatatattagcaggaggaaaagtggaagggggaagcacgatcacccagcagctcgcaaaaaacacttttttgacaaatgacaaaacgtttttaagaaaaacgaaagaagtcattatcgctatcaatttggagcgggattacagcaaagacaagcttttggaaatgtatttgaaccagctatatttcgggcacggcgtctatggaatccaggcggcggcaaactacttttttaacaaagatgtgaaagacttgacggtcagtgagggagcggtgctggcttccattcctaaagcgccttcaacgtattcgcccattctcaatccggaaaaaagccgggagcggcgcaatgtcattctcggcatgatgaacgagcagggatatatcagctcaaaggaaaccgtcagggcccaaggcagcacattggggctccatgtgaaagaaaaatcaaaaaatccgtggcttgacagctatattgatcttgtcatgaaagaagcggaagacaaatattcgatatcgagcgaacagcttctccaaggcggatacacgatcagtgttccgctcgatgtttcgattcaaaaagcggcctacacgctgatgaagcaggacggctattttcccggcacagacaacaaagctgaagggagcgccgtttttatcgataacaggacaggcggcgtagtagccgctctcgggggacgggaatatgctccaaaaggctataacagggccaccgcccagcgccagccgggttcgacgtttaaaccgcttgccgtatacggccccgctcttgaagaaaagctgttcaagccgtattcgatgctcgaggataaacagctgtcatacggcggctactcgcctaaaaactatgacggccaatacgcgggcaaggtctcgatggtggatgcgctgacatacagcaaaaacgcgcctgctgtatggacgttaaatgagatcggaatcgaaacggtgaagccttatctcagccgtatgggcatgaacgtgccggatgaagggctggcattggggctaggcggtctggaaaaaggggtgtcgccgctcgagcttgccggggcataccggacattcgcaaattcaggacaatacaccgagccgttttttattaaaaaaatcaccgatgaaaacggggatgtcatgttccgccacgaggaaaaatcggaaaaggttttcagcaaacaaacagcgtggaacatgacgcggatgctggaggaggtcgtgaaaagcggaacgggaaaggccggtgatttttccggggagattgcaggaaaaacgggttcgaccacgtataccggaaaagagggcggaactaaagacgcctggtttgcggggtatacgcccgaagtgacgggagctgtctggatgggatacgataaaacggatgagtcccattatttaaaaggcggcagcgcttatccgacaaggctgtttaaagacattttaaaacgcaccaaccataagcctgaacggtttaaggcgcctgaaggggtaaaagatctggacaggccgatacgcctcgaagacctggaaagcgttaaagcagactattcctttacgccgatggggctgattacggtgtcattaaaatggcatgaacaagaggataaaagggttgaataccgaatatatgaaaggaaaaacggaaaagaaacgctgattgatacggttaagggaaaaggaagcttttcaatcccttatgcaaacatcttttccgatgcttcctacaaaattgttccatacaatccgcagacgaaaacagagggaaaagggactgattatgttgaaccgaaagtgtttccttcgggtcattagatacccgaaattcatcaatttcttgaacaataagtctcatgagtataccgttcaataaaaaaacggtatattggaaggagtaattttgcgaacgtatggttgcagcttgaaaggtggatatcatgatgaaaaacgacaaggcttttaatgacacattcttaaaagcatgccgaggagaaaaggccgcccatgtaccggtatggtacatgaggcaggccggaagatcacagcctgagtacagagcgctcaaggaaaagtacggtctgtttgaaattacgcatcagcccgaattgtgcgcttatgtgacaaggctgcccgtcgaacagtacgatgtcgatgcggcgatactttataaagacataatgacaccgcttccaggtattggcgttgacgtcgaaattaaaaacgggatcggccctgtcatcgatcagccgattacatctctcgcagatgttgaaaaactcggcgaactcgatccgcaagagcatattccatatgtgctggagacgatcaggctgttgacggaagaacagctgaacgttccgctgatcggttttacaggggcgccctttacattggccagctatatgatcgaaggcggcccgtccaaaaactacaataaaacaaaagcgtttatgtacagccagcctgctgcatgggatcttttgatgaaaaagctcgggaagatggcggctgtatacgtcaaagctcaaatccgcgccggcgccaaagccatccaggtgttcgattcctgggtcggcgcgctgaacgccggtgattactgccgctacatcaaaccgacgatggacgttcttttcaaagagttgaaaaaagaagacgtgccgctgattatgttcggggtcggcgcaagccacctcgcgactgaatggcacgatcttgacctcgacgtcgtcgggctggattggcggatgagcgtacaggaagccagggataaagggctgacaaaaacgctccagggaaatttggatccttcgatcctgcttgccccgtgggaagtcatcgaagaaaggacgaaagccattctcgatcagggcatgcagacggaccggtttattttcaacctcggacacgggatctttccagaagtgagtcccgacacactgaaaaaattgacggcatttgttcatgagtattccgcctcaaaaaaatcgagcctgatcacatgagcatttcagttggtcttttcaatataaactgtcaaaatacgtatagatcatgatctttaaagaggtgttcacgttgggtaaaaagaaaatggggcttcttgtcatggcatatgggacgccgtacaaagaggaagacattgaacgttattatacacatatcagaagaggcagaaagcctgagcctgacatgcttcaggacttaaaagaccgctataaggcgatcggaggaatttctccgcttgcaaagatcacgcaggagcagacgaagcagctggaaaaacgcttaaacgagcttcaggatgatgtggtgttcaaggcatatatcggtctcaaacatatcgaacctttcattgaggatgccgttcgggagatgcataaagacgggattacagaagccgtcagcatcgtgctcgcgccccatttctccacctttagcgtacagtcgtacaacaagcgggcgaaagacgaggctgaaaagctcggcgaattgtcgatcacatcgatcaacagctggtatgatgagccgaaatttatcgcttattgggcggatcaggtgagaaaaatctatgacgaaatgccttcggaagagagggaaaacgccgtcttgattgtatcggcgcacagccttcccgaaaaaatcgtcgaaatgggtgatccgtatcctgaacagcttaaagaatcagcgaagctgattgccgaagcggcgggagtaaaagattacgccgtcggctggcaaagcgaaggaaacacccctgatccgtggctgggaccggatgttcaggatttgacgcgcgacttgtcagagcaaaaagggtacagcgcttttgtttatgctcccgtcggctttgtagccgaccatttggaagtcctttatgacaatgactatgagtgcaaagtcgtcacggacgatatcggagcaagctattacagacctgaaatgcctaacgctaaacatgagtttatcgatgctttagcggatgttgtattaaaacaattggagaaagaacagtaaagaaggcgattgtaaatgagtggagaacgcaggcagattgtcatcatcggcggcggtattaccgggttggccgccgccttctacttggagaaggaaatcaaaaagaatgatctcccggccgaagtcacgcttgttgaagcaagcccgagactgggcggaaagatgcagacggtacacaaagacggctatgtgattgaacggggtccggattcatttttggaacggaaacaaagcgcacctcagctcgtgaaggatctcggactggagcatttgcttgtgaacaatgcgactggccagtcttatgtgcttgtcagcgaaacgctctatccgattccggaaggagccgtgatgggggtgccgacaaaaatcggtccttttctgacaaccggcttgttttccttgccggggaagttgagagccggaatggatttggtgcttccagcaagcaagccgcaggaagaccaatcgctcggagaatttttcagaaggcgcgtcggcggtgaagtggtggagaacctgatcgaaccgcttttgtcaggcatttatgccggggacatcgaccgtctcagtctgatgtcgactttcccgcagttctatcagacagagcagaagtacagaagcttgatcatcgggatgaaaaaatcgcgcggcgcccagagcgtcggaaagcctgcaaacaaaaagaaaggccagttccagacggtgaaaaccggcctgcagacgatagttgaagaattggaaaagcagctcggcatcacaaaggtttataaaggcacaaaggtcgtcagcattgagcgtgcgggctcggcttacagcatgaagcttgacaacggcaaggtgcttcacgccgattcggccgtggtcaccgctcctcataaagcagctgccgcgatgtttcaaaaagaggattggctgaagggtttagaggatatggtgtcaacatctgtcgccaatgtggcgctcggatttccggaagaagccgtccaaatggagcatcaaggcacgggctttgtcatttcaagaaacagcgatttttccattacggcgtgtacctggacaaacaaaaaatggccgagcacaacgcctgaaggaaaagtcctgctaagggcttatgtagggaaagccggcgatgagtccgttgtcgaacagtctgataacgaaatggtgaaaatcgtcctcgacgatttaaaacggattatgaagatcgacggcgaaccggaaatgacctgcatcacaagatggcatgaagcgatgccgcaataccatgtcggccataagaaaagaattaaagaaatcagggaaggcttggaagcgtcctatccgggtgttttcattacgggggcctcatttgaaggggtcggcatccctgattgcatcgaccaaggcaagcaggccgtcgccgatgtactctcgcaccttttcgaataaagaagagcaaaaaaagctgaccgaaaccattcggcggctttttttattttcactctttttacagctttcatcattttaaagtttgtttatggaaaagataacatttaatctttgcattttacatttatatgtgttacattactttttgtacttactgaccaaaatgtcaaatagtcaattccggggtgagaaaccgtgagcaaagatcgaaagcactgattttagaagcggcgacaaaatcgtttacacaattcggctacaaagcgacgacgatggatctggtggcgaagcttgccaatgtcggcaagggtacgatctatacctttttcaagaataaagaggaactgttcgatgacattttttcttcgcttctgattgaaatgaagcaaacggctgatcaagcgattgaccctgatctgccttttcacgaaaatgcccatcgcgcgatgatggcgatattggagtacagaaagaggcaccagctgaccattaagatctttcaggaaggcgcggagctcggcacaccggcggcccgcgaggtgattgaaaagctggaacgcatggtcatcggctatattaagagaaaaattaaagaagcaattaaaaatgacgatattagaccgtgtgacccagagctgaacgcgtttgtcatcttcaagctttacatcgcgctcatctttgactgggaaaaaaaccatgaaccgctgaaagatgaagagttggcagagatgctgaaaatgtatattttaaaaggattatctcgttagattatcctttctttgtttaaaggggtgcttagtcgcgtaaggagagcggctacttactaggaggcgtatcaacatgaatgttttcaaaaaccagtggagagaactgataaccaataaaaaactactgatatccgtgatcggggttctctttataccgctgatttacagcagcatatttttggcggcttactgggacccatacggaaacgtcgatcagctccctgtggcggttgtgaattccgacaaggggacgacatatgaaggaaaagaccttcatatcggcgacgaccttgtcaaagaactgaaagaaaacgataaattcgactggcattttacgacgaaggaaaaagcaatgagaggcttgcaaaatgaggaatactacatggttgtagaaatccctgaaaacttttcgaaggatgccagcacggttatggataaacatccgaaaaagctgaatctgatttatcatacaaacgccggacgaaactatgtcggcgcccagatcagcgataaagcgattgaacagcttcagcattcagtcggctctgaaatcacggagcaatatgctgaagtcatctttgacaatttcggcaaaattgcaaaaggtctcggtgaagcaagcgaaggagccggaaagctggataaaggactgaaagatgcgaaagaaggaagcgaaaagctgaaaaagaaccttgaaaagctcgcgaaaagccaaattcagttcaacaaagacggaatggagaagttcggcgcggcattcaatacgctgaacgacaaaattcatgagcttgattccgggcttgcacaatttttggaaaaaagcggccagctgcacagcggtgctcaacagctccaacaaggcatgcctcagattgtggcgggattggagcagatgaatgaaaaagcgcagaagataagcaaactcgaagaagcgatttcaaatgaaaaaattcagcagctcgaaacggcgctttcaaatgccgaaaaagcgaaaaaagaaatcagccagatttcgaaaaatattgatgagcttgaagcggcattgaaaaaccagcacagcgaagtcaaacaaattattgaatccagcaacatgctgacacaagaacagaaagccgcgcttatgaaacaagtcgatgaaaaaatgggaacggtgaaactccctgagtttgacaagttgaaagcgcaaattcccgatgtcagcgaacttcccgatttatccgggctgaaacagaagcttgaggaattgaagcgagtcccttcggatgtgaataaactttataaaggatcgcagaagattcagcaagggcttgatgcgctgacaaacggtttgggtgcttacaacgaaaaattcgcagaagcgaaaagcggatcatccaaaatcgccgaaggcagccagacgttagtcggaaagttcggcgatctgcaaagcgcggccgataaactgaaagacggttcttccaaacttgcagaaggggctaaatcccttgatgaaggtcttggcaagctgtctgacggaagcggggagctgtttgataagctgtctgacgctgccgatcaaaccggcgatattcaagcgggagacgaaaactacaatatgttctcagaccccgttgatgtgaaaggcgataaaatcgatccggtttccaactacggaacaggattaaccccgtatatcttgtcgctcggcttattcgtcggcgcattgatgattaccgttgtcttcgatgtgaaagagccggctgtccggcccgaatcagcctttggctggtttatgagcaaattcagcgtgctttttgcagtgggaattcttcaagcggcgattgcctgcacgatcattctctggggcatcgggcttgaagtgcaaagcgtctggagattctatctgttcagtataatcatgagcattacatgtcttgcgatcattcagtttttggctgcgacaatgggaaatccgggacgattcattgccgtcattctgctcgtgcttcagcttggaggaagcggaggaacatttcctcttgcacttgtccctaagttcttccaggtcatccattctgcactgccgatgacctacagcattgccggatacagagcggtgatttcaagcggagactacgcgtatatgtgggaacaggctgccgtgctcggcggtgttgcgatcgtcatgatggctctgacgctgatttattttaaagtgctgctgaaaaaaggaaaaattgaagagcagcatgcataaaagaaaaacatcttttcaagcccggcaagggcaagaaaagatgttttttttgatattaggaagctggcgcgccccattttacaatcaggcccgtatatgtaagacccccgccaaaaccgaacagaatcaaggtgtcgccttttttcagctttccgtttttgacggcttcatcaagggcgagaacgattgatgcggatgaggtgttgccaaaccattcgacgcttgtcagcgctttttcggctggaatttcggttttttcgcaaatcgattcgatcattcgcagattcgcgctgtgcgggacgaaccaatcgatatctttcagctccatttcagcttgggcaagcagttttttgacgccttcaggaacggacctgaccgcccacttatacacttcgcggccgttttgaaccattttcccttcacctgaaagcggctctcctttaaggtcgcttcgcaagccggttctgtataaatggcgggctccgtcacctttcgtgtcctgggcaaaagtaataaagcttgggtctttgtcgtcccgttcgacaagcagggcgcctgcgccgtctccgaacaaaatgcaagacgtgcggtctgtatagtcggttgtttttgataaggtttccccgctgatcacaagaatttttctatgcagtccggaagtgatgaggccgttggccatatgcaatccgtacgctaatcctgcgcaggtcgcatttacatcgaccgcgcccacttcgttccatccgaagtgttcctgaacctggcatgccgtgcttggaaaagcgtaatccgccgttgtggtagagacgatgatcatgtcaatatcgtcaagcgtgccgctgtatctgttttttagatcttcaaccgcctttatgcaaagatctgatgtgaattcgtgactcccggcgattcgcctttctttcattcctgtccgctgaatgatccattcatcagaagtatcaacgatcttttcaaactctttgtttgtcatgcgcttttcgggaacataggtgccgatggcggaaattcgcgcttttgataaagttttcatgaaattcactctcctttttcttattatatcacctagtattagtatctggtactaaaatgttgatatgaggtatactataaccattacaagttgggaggaatgaaccatgtcaggacagaaaacgatggagctcatcaaggagctcgtctccatcccgagccctaccggaaatacgtatgacattatagactatatcaaccgccttttagagaaagaaggagttgaaacaaggcataaccgtaaaggcggcctgatcgcgacgataccgggctctgacaaatcccggcacaggatgctgaccgctcatgtcgataccctcggagctatggtgaaagagattaaaccgaacggaaggctgaaaattgatttaatcgggggcttcaattacaactcgattgaaggcgagtattgcaacattgaaacagcatctgggaaaacttacaccggcaccatcttaatgcatcagacatcagtgcatgtatacaaagacgccggaaaagccgagcggaaccagaaaaatatggaggtccgcattgacgaaccggtcaatagtgaagaagaaacccgggcgctcggcatcaatgtcggcgattttatctccttcgatccgcgcgttgaaatcacgccgagcgggtttatcaaatcgcgtcatctcgacgataaagcaagcgtcgccctcctcatcgagctgatcagaaccatcaacacagaagggatgacactgccttatacgacgcactttttaatttccaacaatgaagaaatcggttatggcggcaactccaacatcccgcctgaaacggtggaatatttggctgttgatatgggagcgatcggcgatggacagtcaacagatgaatatacggtatccatttgtgtaaaggatgccagcggcccatatcactacgggcttcgaaagcgcctgacagccctttgtgaagcacatggaatcgattataagcttgatatttacccatactacggttcagatgcttcagcggccgtcaaagcgggccatgatatcgtccacgggctgatcggcccgggaattgacgcatcccatgcgtttgaaaggacgcatcaatcgtccttggagcagacggcaaagctgctgtatcactatgttcagtctgacatggcataaaaaagctcccaaaggaccccggtcccttgggagtaaaaaaagagtggaagtcatccatccgtaaaggatggcgtttacttaccagtaatcatagtgttttttctttttgcagtgatcaaagtggtcaaacttcttgtagtcatagtcataatcatacttcttaaagcatggataatagtagtaataatagtagtagtagtatttcttgcagtcatggtctttcttgtggtaatcatagtcataatctttcttgcaatggtcatggtaaaaatacattaaacttccctccaattttcttttctaatttaactacagtacatcgtatgtaaacaaaaggaagttgtttggacaggttgcttgagaaattcgtatatttttttaaaaaaacgtatgtcttcccgggatggaaaacatacgttttttgatagaaaagggggtcagccggatacttctatatctgccggctcccgttgatttaagacgttctgccctttaacggcgtcatattcaccttcccattttgacatgaccacagcggcgagagcgtttccggtcaagttgacgaccgttctcgccatgtccataatccggtcgactccggcaatgaaggccagcccttcagcaggaacgccgatcgtgcccaaagtcgcaagaagaacgacgaaagatgtgccgggaacggcagccatacctttagaagtgaccatcagaacaaggattaacgtgagctgctgtccaatggatagatcgatgccgtagacctgcgccagaaacagcgccgcgatcgcttgatacaggacagagccgtcaaggttaaatgtatagccgatcggaatgacaaacgacacgatgcctttcgggcagccgattttctccatcttttccatgacgcgcggaagcacggtttcagagcttgatgtactgtacgcaagaagaagctcatctttcaaaaaagccaaaaatttaaatatattgataccgcaaagcttgccgacgatcccaaagataacgatcaagaagaaagcaagagccaggtagacaagtaaaacgagctttcccaatgataaaagcgaagaaaaaccaaattttgaaaccgtcacgccaattaaagcaaaaacgccgaacggcgcgaatttcataacgatgttgacgacgtggaacatggcttgagacgttgcctcgaaaaaggagagcacaggcttgcctttttcgcctatggcagacaccccgagtgcgaacagaacagtgaagcaaatgatcgcaagcagatcgccttcagcgagcgactggaaaaagtttgtcggcacaatgtgcaggaacgtgtctgcgacagatttggtgcttgcttctttttctgtttctacatattggctgatatcctgtttttcagcaccagaaaagtttacgccgtgcccaggctgaatgatgtttccgaggagaagtccgagcacaatcgcaaaagtcgtaatgatttcaaagtaaaggatcgtccgaaagccgagcctgccgacctttttgccgctgccggcccccgcaaccccgacaatcaagcttgaaacgacaataggaatcacaatcattttgattaatcttaagaacaaatcgccgacgggctgcagatacgttgcaaccgcaggatttccgaaccaaatcgctcctgctgcaacacctaaaatcagcccgaggaaaatttgtgtggctaatccgaatttaagtcttttcatagatgccctcccaacgcatacttaattttatactagaatattaaactgagatcgtaaattaagtatagcgaaagaaaaagcagctcgtccattaaaaaaataacgtctgaatatattgaaaattcgaatatgagatgatcatcccagctttaaattcaaatcgggacaatcatcggtgtatattttcctaagtgaaatagtgaaatgttattaaaataatgaattgtgacaagaatctctctctttataactaactttatgacaaaaaaaagccccggggaatccgccggggcctttctagtgaagtctatatatcttttacttttaagcatttagagcaggtgtttccgtagcattcgtgctgctcatcaatatcgtggccgcacactgaacattttttggaaggcaaatttctgaagaactcggtgattttagcgagcatgttgattcccccaattcgtttgttgcaattattgtattataacagagaccggaaaatcaatgtctgttttatgacaaaatataaaacatgcaatttttaagaaaaatgggtatattgaatagggggacgatagacacgaaaaagaggtgtgtatacatgaaggtgacagtcatcggctgctgcggaggatttccggctgcaaatgaagcgacttcaggctatctctttcaatccggggactattccgttttaatcgactgcggcagtgccgttttatccaaacttcagctgtttctgcccgttgaggagctagatgccgttatattatcccattatcatcatgaccatattgcggatgtcggccctttgcaatttgccaaactggtcggctcattcctcggcaagggagcggatgcccttccgatatatggacatccttttgatgaagagcagttttcaaagcttacatataaaacgcataccgctggattggcgtatgatccgacacagcctttggctatcggaccgtttacgttcacgtttttaaaaacggttcaccctgttgactgctttgccatgagggtgacggacggtgttcattctgtcgtttatacggccgactcgagctttcaggaagcctttattccgttcagcgaaggagccgatctcttgatctcagagtgcaacttttatgcggatcaggatgggaggagcgccggtcatatgaacagtcttgaagcggggcggatcgctgcggaagcgggtgccgggcagcttctcttgacacacctcccgcatttcggggaacaccaaaaactgatagaagaggcccaaaccgtttataaaggtgcggttgttctggcgcacaccggttatgtgtggggagaatagaaggaggaactgacaaacatgctgtttatcgataatcaaaatattacagatccgaggatcaacttggcgattgaggagtactgcttaaagcatctcgatcctgaagagacgtatctgctgttttatatcaaccagccgtcgatcatcatcggcaaaaatcaaaatacgatcgaggaaatcaacacaaaatatgtagatgaaaacgggatcattgtcgtccgcaggctgtcaggcggcggagctgtctaccatgatctcgggaacttgaacttcagttttattacgaaggacgacggcaacagcttccacaacttcaagaagtttactgagcccgttgtggccgctttaaaacggcttggcgtcgatgcggagctgagcggccgaaacgatttgatggcaaacggccggaaaatctcgggaaacgcccagttttcaacgaaaggaagaatgttcagccacggcacgctgttgttcgattctgagattgaacatgtcgtatcggctttaaaagtgaaaaaagataaaatcgaatcaaaaggcattaaatcgatcaggagccgtgtggccaatattagcgagtttctcgatcagaagatgacgacagtggaattccgaagcatgcttctccgctatatttttgataccgaaggggaaataccggagtataagctgactgaaaaagactggaaaatcattaatcaaatttcaaaggaacgctatcaaaactgggattggaactatgggaagtctccgaaattcaatctgcagcattctaaacgatttcaagctggatcggtcgacatccgcctcgaagtgcaaaaaggcgtgatccgcgagtgcaaaatattcggtgactttttcggagtcggagatgtcagcgacatcgaagagaagctgacaggcgtgcagtatgaaagaaaagcgattgaagaagctcttcaaggcgtggacattaagcattacttcggcaatattcaaaaagaagaatttttggatcttgtctactaatagagaggctgcggtttccgcggccccttttttaacatgagaggaatggaagatatttcccggcagcccttgagtgttttctgttcatttactataatgggaatagattttgattatcacaaaatgaatggtcattcattcattttttaaaggggtgggagaatgaatttagtttcaaaattaggggaaacagctcaatcaaagcctgacagaaccgcttatatttttggagagcaaacggaaacatacgggggattgcagcagaaaattgattgctttgccgaagggctgcgcgaaatcggggtggaaaagggagatcatgtcgctttgctactcggcaatacaccgcattttgtgattgcgttttacggcgcgctgaaggccggggctgtcgtcataccgatcaatccggcctatacgccgactgagatcggctatatgctgacaaatggcgatgcaaaagtgatcgtggctctgggacagctgcttccgctttacgaaaaggtgcatgaatcccttccgaaagtcggctgcgtcgtgctttgcgaaactggagagccgcttcaggaaccggaaaacacagaggttaagatgaaattgaaatcgtttacaagcattatgaaacctcctgtccggccgtttcctgaaatcgatgacgaagatacggccgccatcctctatacgtcaggcaccacgggaagaccaaaaggggcgatgctcacacatcaaaatctattttcgaatgcaaatgatacagcccgctatctgacaatgaatgaatctgaccttgtcgtcgccgccctgccgatgttccacgttttttgtttaacggtctgcatgaatgcaccgctcatgaacggcgcagcgattttgatcgtgccgaaattcagtcccgccgaggttttcaagctgattaaaaagcatcaggcgacgatcttctcaggcgttccgacaatgtacaattacctgtaccagtatgaaggagcggatgaaacaggctttcggtccatcaggctttgcatctcaggcggagcggccatgcctgtcgctctcctgaaaagctttgaagaaaggttcggcgtcctcgttttagaaggctacggcttgtcggaggcttctcctgttacatgctttaacccgttcagcaccggccgcaagccaggatcgatcggcacgaacattctcaatgtgaaaaacaaagtcgtcaatgaactcggggaagagctgcctgccggccaagtcggcgagctgatcgttaaagggcctaatgtcatgaaagggtactacaaaatgccggatgagacggcccatacgataaaagacggatggctgtatacaggtgatttggcaaaacgggatgaagacggttatttttatatcgtcgacagaaaaaaagatatgattatcgtcggcggctataatgtctatccgagggaaatcgaagaggtgctctacctccatccaaaaatcgcagaagcggttgtgatcggagtgcccgatccgaatacgggagaagccgttcattgctatgtcgttccgaaggataaaacgctgacagaggaggatgtcttgtcgcactgcaaaaagcatcttgccaaatacaagcgcccgtcggcgatcgttttcatggatgaaattccgaaaaactcgaccggcaaaattttaaggcgcgctttaaaagacattctgacaaacaaatcttgacccgctaaaagggacgcctgccgcgtcccttttttgcaattctcctaggagggcgtctttttccctttgttggagaacgaaatatgtgccttcctcttctttcaggatgacggcttcatctttcttcagccagacggtgaagtgaacgcgatgtgtgccggtcatgctgatgtatccgtgatacgccggagaaggcaggtgatgcgctgtctttttcttcattcttttccctttattaaatgtatcaagcaggacggctatgttgtgcctgtctttgatgctgaccgttttttcactgtctcccgcctgcttcaagatgatttcttctgcatttcttgagtcgaaaggctccgccatcaagtggaatacataaaagacagtgatggataaaatgccgaaaaaaagtgcgatccccattatttttttcagaatgatcaccccaggctatctattttctccctttaaagccttttcatcctgagaaattatgctataatgttcaataaattatacgaatgtttaatttattataagggggcggaagatgaattcgattgaaaaacaagtggcagaaaacattaagaggctgcgaaaaatccgcaattacagccttgatcaattgtcatcgatgaccggcgtcagcaaaggcatgctcgcgcaaattgaaaaaggctcttcaagtccgacaatcacaaccttgtggaagatcgcaaacgggctgcaagtatcatttacttctttggcagaaaggcctgccggggagccgacggtcgtcagaaagcacgagaaaacgcctgttatggccggagaagaaaaatacgcggcatttccgcattttccgttcgaccagaaaaagaagtttgaaatcttttatattgaacttgcgcccggctgtgtgcacgaatcagagcctcaccacggagggattgaagagtacgtgctcgtctctaaaggcgcgcttgcggtgacggcgggtgattacacctgcgacttgaacgagggtgatgcaatgcatttcaccgcaaacaccgttcatacgtacaaaaacaacacggaacaaacggcatcatgctatacactcatttattatccgtaaagaggtgtcaagatggaaaagcaggattcactcaactttctagacgggcttcgttcaggggtttcccttgccgtcggctacatcccggtcgccttgacattcgggcttttggcaaaaacaacggggctgtcgctttttgaaacgtttttgatgagcgcccttgttttcggaggagcgtcccagtatatgtctctgagcatgcttgccgttcagacaggaatcatcgaaatcgtcatgacgacgttcattgtgaacatcagacattttttattttcagcgactttgaatcaattggtagaaaaagattcgccttggaaaaaagcgttttactcatttttcgcggtgacagatgaatcgtttgccgtcgctgctttaagaaaggaaaagctgacgaccgggtacatgatcggcctcggctcgatcggctatgtaagctgggttttttggagtgcggccgggcattttgcaggagccgccatgccggctgttcttcaggaaagcatgagcatcgccctttatgccatgtttatcggattgttggtgccgcctttgaaaaaacagcgcaaagtcctgctgctggcgggagctgccgcgctattcaatacggttttccaaatgaacggaatgttgtcggcaggatggtcgatcgtctgcgctacgcttttatccgccatcctgatcgaatggctgtaccaatttagaacagaggggaagagaaactatgtttagtccgatcatctggatgattatcggcatggctgccgttacatatgtgccgcggatgttgcccctcattgcttttgaaagcctgaagcttcccggatttttggagcgcgtgctgaaaaatgtgccgtacgccgttttaggagctctcatttttcctggaattttttcggtgcaaagcggtatgctctatggacttgccggcgctcttatcgcatttttattttcctattttggagcaagcgtcatagtcgtcgtgatggggacgattttgacgctcgcaggggccggcctcttgctctcattgtaaggcttggttctaactttcacaggaaaagcttacaatagaagtaactgctatgtgagaggaagtgattcgccatgcggaaatggatcgcgggagcctttctcctgtatgtgctgtacggcctttttttctattggtatctctttatggccggtgaaccctccgttcccgaggcgctgaaagggacaagcgcagacccggcgacatttatgaacgaaagggaactcatgctgacggaagagtactcgaaaataaaggactttctgttttttatccggattccgtttgagtggttcttatttttaatattgttgattgccggtttatcgaagaaaatgaagaattgggcggagcagacgtcaaagcggagaacgattcaaataacggcatatgtttttgctttgtttctgatcgtcacgatcgtttctttgccgcttgactggatcagctatcaatattcgcttgactacggcatatcaacacagacaaccgcgagctggatcaaagaccaggtgatcgacttctggatcagctttccgataacggctgcggcggtgatcgtcttttactttttgatcaaaaagcatgaaaaacgctggtggttttatgcctggtgcctgacggttccggttacgctgtttttatttttccttcagccggttgtcatcgatcctttatacaatgacttttatccgctgaaaaataaagatctcgaacaaagcattctgaagctggccgatcaggcagatattcctgcgaatcacgtctatgaagtgaacatgtctgaaaaaacgaatgcgttaaatgcttatgtgacagggatcggcgccaataaaaggattgtgctctgggataccacgctgaacaagctggatgagccggaaattttattcattatggcgcacgaaatggggcactatgtgatgaagcatgtttacataggactcggcgggtacctgcttttatcccttgccgtcttttatgtgatcgacaagctgtacaagcggatcatcggccgctatggaaaaagcctccgcattgcgggaaaatccgatcttgccgcactcccgcttctcctgatgctgatgggggtcatctctttcgcgtcttctccatttacaaacgcagtttcgaggcatcaggaaaaagccgctgaccagtatgcgattgaactgacgaacaacagcgatgcagcggttgcgacttttcaagagctctcaaaagccgggttgagcgaggcgaacccgccgtttctcgtcaagatttttaaatacggccatccgaccataatggaacggattcaaaatattgaacagtcttcaactgaatgaagaaaaagctagtgctaaaaacactagctttttctatatgccatttgttagaatatgttattgagcggcagcttcgacattgatcagaccttttccatagtagaaggagcttcccaaataagtcgccgtactggagagacggttgcggacttgtgaagctgaaaggttcggatgttttgacaagatcaaagctgctgctcccgctacatgaggagaagccattgacgttccgttcaatgttgcataagtgctggttgggtaagtgctgtacacgcctgcgccaggagccatgacttcaagctctgctccgacgctggaaaatgaagctctgttgctgttagagtctaccgcgccaactgcgatgacagagtcgtatttcgcaggatagccgattgtattcgtgtttcctgaagatccgctgttcccagcagccgccacaacgacaacccctcttgcatatgcattgtcaaccgcctgtttcatcgctgttgagcctgatggtcctccaaggctcatgttgataacatccatgccgtttgtcgtcgcccactcgattccgcttacaatgccgctgtaagatccgcttccgcttgaattcagcactttaaccgcgtacaaggatacgttcggcgcaacgcctaatacacccgttgtattgtcaagcgcagctactgtaccggcaacatgcgtgccgtgtccgttgccgtcggtgttataagcttcgccagctacgaagcttgctccgccgactacgttcaagtccggatgagaagcttggattcctgtatccaggacggcgacttttacgttcgctcccttgtagccttgagcctgcactttgtccgctttaatgagaggaatgccgtaaggaacggtttgcgccaaagcatgagctacgtgatcctcttccacataagcgacatccggatcatttttgacttcctcaagcgcttctttgtctagcttcgcttttgccgcgttgatgattctaaactgcttgtccacttttccgccgctctctttgatgatgtcctttttgacggatgcggttttcactcccgacttaaatccgacaatataatccttttcaacatttttcgccggctgagcagcagacgcggaatcgctgaaggccatcgtgaacacgagcattaaggccgtcagcatcccaagccaaaaactctttttcctcatcattactcactctcctccgttttattcagaataattgaaatagaagaataatatactctattctaattattctgttaatttattatagaaaaaaaatgaattatatggtagacccatttttttgaacggccaatttaaatttattggttattaataactgttttagaaaaatattcggttcgaaagtatgaatagaccgcttcaacctggcagggaaagaggtcccggggtccgtgaatgacaggagattgcttcgtctgattcattttatgaaaatactattcatttattttatgagatcattttttgccgaaggaggttgcggcctagtcgatcatctattaaaatatgcaatatatcgcatacagaaacgggtgtaagatatgaaatcagctcatgtgaaaggcgtattgatggtgctggcaggggcttcgttgtggggattatcggggagcgctgcacagtttgtatttgaaaggggagcggctgatgccggctcgcttgtctccgtcaggcttctggcgtcgggcgtcattctcttgctatatgtttcaatgaaaaacggatttcaacatgtgtgtcagatatggaagaaaaaaacagatatttgttcgattttggtattttccatttttggaatgctggccgtccaatatacattttttgcctcaatcgaaaagggaaatgccgctgctgctgcaattcttcaatatttggcgccttttttcgtattgttttacctatatgttaaaaaagaacttccgcctaagtggaaagatgccgtgcttactttattggcgctttccggcgtgtttcttcttttgacaggcggaagaccggacagtttgtatattccggccgaggccgccgtttggggcgttttgtccggtggtgcgcttgctttctatacggtttttgcaggaggtttaattcaatcgttcggtgccttgacggttacgggatggggaatgctcgtcggaggggccggtttttcttttttgtttccgccgtttcggtttaacctttcgcacattggggcaggagaggcggcagccattctgtttgttgtattgtgcggcacagctttggcgtttgcactatacattggcagtctctcttatctttccgcaaaagaaacgagctgtctgagctgcgccgaaccgcttgcggccgttctgtcgtcggcgctctggctgggtgtgcccttcaatgcctttcaaggagccggtacggtgatggtgatcattacggtcatcatcctttccctcagcagagaaagaaaagcagcagattctgtcaatgaaagggtgtagaaaggagagggaggctcctttcttttttaaaatgataatgattatcattgtcattgatggagggagttgctataataagctcgtctactacaaaaaaggagatatatatgaagcacaaatattttgctattttatttttattgatgatatcagtgatgacggcctgctctggaggaagcgagagcacgaaaacttccggtcaggattccgtgacagttaagcatgatcttggagaaacgaaagtgcggaataaaccgaaaaaagttgtggttcttgaattgggatttattgatgcgctccttgatgcgggtattaagcctgtcggaattgcggacgacggcaaacctaagtttattaacgagaaggtcaggggaaaaatcaaagggtatacttcagtcggttcgcgcgcccagccaagctttgaaaaaattgcttctttaaagcccgatttaattattgccgattcgagcaggcacagcggcgtctatgataagctgtcgaaaattgcgccgacaatcgcgctcaaaaacttgaatgccgattatcaggacacgcttgatgcatctcttacgattgcgaaagccgtcggcaaagaaagcgcaatggagaaaaaattggctgaacataaacaaaagctggatgaattgaaacagaaattcggcagccggaaacagagcattcttctgctcgggaacacaaatgaagaaatcaccgtgcgcgatgaaaactttttcacgtctcagcttctgacgaaaatcggctatacatacggtgtcggagacagcggcaaaggcgatgccgaaaacggtgaatccgtcaatattaaaatgacgctcgaacagctgcttgagaaagatcccgacgttattgtcctgatgacgggagaaaaagataaagtcgatgaagacgggaaaagaccgatcgaaaaagatcctctttggaaaaagctcagcgcagtcaaaaacggcaaggtttatgaagccgacagattcgcctggtcgctccgacgcagcattgacggagcagatgagctgatggatgaaatcgatcagcatcttctgtctgaggatcaaaagaaatcttaggagcctgccggcttgttggacgggatgacgcatgcttttgtaaaaaagcatgcgcttgttttttctaaaggagtgacctgttttgatatatatgaaacgttttgcaccgctcatttttgtttttcttttgcttgcgagttttgcgctttctgtttcaatcggttcgtcaatgattgcactgtccgatatttgggcggctgtttttgcgtacgacggttcaaaattgcacgcgattattcagtccatccgaattccgcgcgcattgaccgccgcattaatcggcgcgaatctaggggctgcgggcgcgctgatgcaggcggtgacaagaaatgcgctcgcatctccgagcatcttcggaatcaatgcaggggcctcgcttgctgtcgtatgtttgacggtgatgtttcctgcgcttgcagctccccagacagcgatgggagccgcatttgccggcggtgcagcggccgcgctgatcgtgtacgcggttgcctcagtattcagcgaacatgacagggatatcagctttgccttgattggcgttgtcattcaggcgattcttgcttcgatgacgcaaatgctgcttatctttcatgaagagtcgacggaaacgctattgttttggctttccggttctttagcggggagctcatgggataagcttcatttattggttccggtgagcattgcgggtttgttgacggctttggccttagggagggcggcttccgtcatgagtctcggagatgaagtttctcatgggctgggacaaaaagtatggctcagcagattgctaatcgccttcactgttgtcgcattggcgggagtgtccgtttccgccgccggtccgattggtttcatcggtttgatggttcctcatatgatccggtatctcatcggtgctgactaccgggcggtgattccgtattcggcattgcttggagccgttcttttgctgtttgccgatattttgtcccgctttgtctattttccgtaccaaacgcctgtcggagttgtcacggcaatgattgggacgccgttttttatctatttggcgagaagacggaaaaagggggcggcataatgaacaatccggcaagaaagacgaaaaggcggcgcggacaatcggcggttgttctctgtgcgctattcgcctgtttgtttgtgctcattgtactcaatttggcgatcggcgatgaaaacatcggactgtgggacgtattgaaatcgctggcaggacaaggcgatgcgggagtccgctttttggtgatggaatttcgaatgccgcgaatcctcctcgctgtgcttgccggaggggcgctttcgatcgcgggtgtagtcgctcaatttctgatgaaaaatccgctggccgcccctgacacgcttgggattacaggaggagcgggattgggcgctgtgatcgttacggtcttgttttcacagcaaagtccgcttctgctgacaggcgccgccttttcaggaagcgttttagctgcgatcctcgtctatttattggcttatcgaaatgggatctctcctgtgcggctggctcttgtcgggatagcggtcaatgctttctgccattcgggcattcagctgttaatctcaagggggagcccgaatgtcaacagcgcattaatttggctgaacggaagtctgtggggaagaggctggcaggatgtattgcctcttttcatatggtgctgtctggtgattcctccgatatggcttgcggcaaaaccgctcgatatcatcaaatcaggggacgggattgccgtcggcctcggcatccggcttgaaagaacaaggtttctgctgcttgccggtgcggttttgctgacagctgctgctgtgaccgctgtgggaacgatcggttttatcgggctgatggcgcctcatatcgcaagaaagctcgcaggggctgaaacgaagatcttgattcccgttgcagctctcgtcggcggcatcgtccttttgatagccgatgccgccggaagaggtcttgttccgccgcttgaaataccggccggattgatcgcagccgttatcggcgggccgtattttatctatttgctgcgccgcgaagaacataaaaaaagacggcatgcttgatgccgtctttttttaatctgacaaatggtgtgaaaggttgtaatccttcacatgccatttattttcatgaaatttgatgttgcttaggcaggcattgacgagcttcgtgttttccaggttgatgtcgccgtttgagatttttgacagaagcgcgtgtatcgcggctccgtgtgcgacgatcagcacttttttgtccggataccgctcactgaccttttgaacgccggccatcagccgttcggcaagcgcttcttttgattcctgattcggatattctttatcaggatagagcctcattctttcttcgaatggcattccttctgcatctccgtaattcctctcgatgaaatcctccatttcgatgatttcaagtccgaggtattgattgatgatttcagcggtttctttcgctcttcttaaagggcttgtaatgatgacgtcccagtcggaccctttcaaaaacgccccggtttcttttgcttgttttttaccggtttcatttaaagggatatctgttcttccctgcagttttcctaaagcattccagtccgtctcgccgtgccggatcaaacaaatcgcagtcatgctaaaagtctcctttcgaacttggggtgcgcattttcggtgatatggccattatactaaatttaaaaaacggaaccacgaaatatgactggcaccgaacaacatttacatgattttttcaaacaggctgtgccgattctgctgttttttcgatcacgtctgcaatcgttgtcgagcgttgccgtgatggctgtgaatatatatctttgcttgcacggcagacttctcaaagtatggatgtgaaaaaatacacaggtcatgattgacctgtgtacggtaacgcctcatttttttgtcagctctacgagagaatcgactgaaactgcgacttgtgatacggcggcattgacatcttgaaggccgcttaaaaacgactgcaggtcgccttcgattcggccgctttgctctttgctcgttttcatattggagacgatatcatcgaataggcgattgatctccgacatcttgtctttgctttcgttcacaagctgatttacatctgtaatatgcttcgtgacgatcgagatttgagcgtttgtgttattgacgagctctgatacggtggagacggtttttttcgtatcatcggacagctttctgacttcgtttgcgacaactgcgaaacctttgccgtgctctcctgcccttgccgattcgatcgaggcgttgagcgaaagcaaattcgtctgttcggcaatgcctgttacgatgccgaatatcttttcgatctgcagcgcgatttcttccagctttttaatttcctgctcgatttgcgtcatgctgcttcccatttgattcagctgctgttcctgttcctcaagctccttttttccgccgatcgatttttgttcgacagaaacggctgtcttcgttccggctcttgacgtttcggcgatctcggaagatttgtcgaccaattcctgtacggcgcccgtcgtttcggcaaatatagcggccaaagaaccggaagtatctttaatttgcctgtgaagttcatttttgctttcttcatcaagtctgcggagtctcgcgtgttcgtcttcaaaggcctccaggacgatctgctgttcgatgttgagaattttggtgacggctttgacagaccgcctgtattcctcatcggataaggcgttttcaaagatcttcagcattgaaagaaggagatcttgaaatgcccccagataccactttggcaacagtccgatgcgaagatgaacgtgggcgatccggattcttttttctaaaaaggcttcgtcgatgacgcctgaaaacatttcctggatgtggatcgtcaatgtctttttgagacggtcgaccgagctgttgtcatggatgatctccatgagagagctttcatgctcaagattttgataaaatcgggtgacgatggtttcaatatgttcagtgactaagggcttcagcctgctcagcacccaaagatcctcatccgtcaaatcgaccattgccagctgttttttaaattctgcgtgctgattgagcctgattctttttgtttggtcagggctttccccagcaaaaaatgatcgttctgtctttctatcctttttgaataacacgatcgtatccccctgtaatcattaatgataaaactgccgtttttttgaaatttccagcatttatctttttatcggcaatttttcattactttttaacttgtacatctcagctttctggatctttaagaggttctacggcagggccctcaatgacatcgccgtcgatcgaaaaccttgagccgtggcacggacagtcccatgtcttttctccatcattccactcgacttcacagcccatatgggtgcatgttgtgtcaaccagatgaagctcgcctttttcatcgcgataagcgcccgcccgtttcccggcatgcgacacgaccgcgccttctccgttgacaaggtcttccggcttcctgatcggctgctcgagttttccttcggcaaagtgttttgcaacatccgcgttgtaggaaatcgcttttttgatgcttggatccgggtggaaacgggccggctgaaagacggcttgataaggattgtcttcacccgcgatatgatctgtcatcagctgcgcggcgagggtgctcgttgtcatgccccatttccgatatccggtggcgacgagaatgcgcttttctttcggatagatcggcccgatatacggaattttgtcaagcgtgattaaatcttgcgctgaccagcggtaagggatcgattcgatgccgagcacgccttccgcaaatgattcaagcgcctgataatgcttgattgtatcttctccctggccggttttgtggctttcaccgccgacaagaaccattttttctccgtcgatcgtcaccgagcgaagcgagcgtgaaggctggtctatacttaagtacatgccgcctggatacggcgttttcggcttgacggcgagcacgtatgaccggctcggctcaagccttgcaaaatagaatccttttttatcatgaaatggaaagtgcgtgcagcacgtgacataatcgctgaagatttgatgtccgcttcttgtcagcacttttggccggtcgccttctttgatttccttagacgccgtgttttcgtatatttttccgccggcttcccggacggcctctgcaaggtatttcaaatagtgcagcggatgaaactgggcctggtttttcatgacgagtcctgcttttacatcaattgggacggggagatctttgatgaattccctgtcaatcccgagcttttggtatgcttcatattcctttctgagtttttggaccgattgttcttcagttgtgtaaatgcacgcgtcctgttcttcaaaatcgcacggtatcttttgctcaagcacgaggtttttgataaaggacagcgccttgagatttgcttcataatacagcctcgcattcggcattccgatatgcccgatcagttcgtcatagatcagatcgtgctgcgcggtgattttggctgtcgtatagccggttgttccgtcgagtatccggccggattcgatcaagacgacgctgtagccttttttcgtcagcaaataagccgtcgtcagtccggtcatgccgccgccgatgatggcgacatctgttttgacatcttcagacagttcctcgaacgaaggaaggtctgtactgtttctccaatacgattcaggcgagtccggcagtttttgttcttgattgctcacaaagttccctccatcatgcatccgttttgttcttaaattttcccaattgagaaatattcatgcatgtgaagcggcttgtcataaaaaaggggcgttttcataaaatagtaaggttgaatcgatgtgaaggaggaatggttttgagcaagcagccgaagaaagtactgcctccccagcaccaaacacagcgtcccggattggagtatttgatggatccccggcccgttttcgaccggccgaaacgagagcgaaaactggctgggaaaaccgcgattattacgggaggagacagcggaatcggccgtgccgtgtccgttttgtttgcgaaggaaggcgcgaacgttgtcatcgtttacttaaatgaacaccgcgatgcagaagaaacaaaggggtatgtggaaaaagaaggcgtcggatgcaagctgattgcaggggacatcggggacgaggctttttgcaacgatgtggtgcgccgggcaaaggaagcattcccaacgatcgatattctcgtcaataatgcggctgaacagcatccgcaaaagggaatcgaaaaaatcacgagccatcagctgatccgaacgtttcagacgaatattttttccatgttttatttgacaaaagctgtgctgccgcatttgaaaaaaggcagctcaatcatcaatacgacctcgattacggcttatgccggcaatgaaaggctgatcgattattcttcgacgaaaggagcgattacatcatttacgcgttcgctcgctttgtcgcttgtcgatcagggcattcgtgtgaacggtgtggcaccggggccgatttggacgccgcttataccgtcgacgtttactgagagagaggtcgaaatattcggttcaacaacgccgatggaacggccgggacagcctgctgaagtggcgccgagctatctgtttctagccagcgacgattcttcctacatgacgggccaggtgctccatgtcaacggcggaacgattattaacggataaaaggccggactatttaaaaagccggcttttttcgcataagaaagccaatcccttgggattggccgttatgcgtgctttttcagcgctgtatattctcttgaaagctcaaggaaagattgcttatctcctttgtctaatgcttcattaatcttcttgctcagcgtgtgcaaacgccgtttaaaaagcgattcatcaaggaccatttgaatgtagatatccgtgatggttacatcaagttctttcaccttttgggtattgcgggacttcatgagctcagcgtacgattttttctctttcataaagattccccctgatgccttttttatagtatatggattacacaataaaaaatcaataagtatttataatttttagaaaattattcggagatgcgtgtttatgagaataaaagtttgtatatttggacaaagaaacacggatttaatcgaacaaaacataaaaatggcattttaaaaacatattttcaaattaattggaaaaaatcctgtcgttttgtaaaggataatgttagattaatagtataaatttactaacgattaggaggatcaaaatgagcacagaggatatgacaaaggatacgtatgaagtaaacagttcgacaatggctgtcctgcctctgggagagggggagaaacccgcctcaaaaatacttgagaccgacaggactttccgcgtcaatatgaagccgtttcaaattatcgaaagaagctgccgctatttcggatcgagctatgcgggaagaaaagcgggcacatatgaagtcattaaagtttcccataaaccgccgatcatggtggatcactcaaacaacatttttcttttccccacattttcctcaactcgtcctcagtgcgggtggctttcccatgcgcatgttcacgagttttgcgcggcaaagtatgacaacacgtttgtcacgtttgtcaacggggaaacgctggagctgcccgtatccatctcatctttcgaaaaccaggtttaccgaacggcatggctgagaacaaaatttatcgacaggattgaaggaaaccccatgcagaagaaacaggaatttatgctctatccgaaagaagaccggaatcagctgatatacgaattcatcctcagggagctgaaaaagcgctattgatctggagcggctttgaataaatagtgctcaagaagcgcggatacctggttgcggatgcggggattaaagtacttatgctcttcttcgtaaccctcatatataaaggaatacatcgtaaaggcttcgtcccgcgacacttcatgcaccttgattttccggcggcgcagttcattttttacgtcgtacaggtcgcgctgggcaagctttaacgcctgttcgatcagatgcagataggggtctttcagcttaaacggcccctgctggatgattttcatgtcccggtttaatatgctgacggtcatcgggaggtaaatcgccttttcaatcatatccctggcttcggcgggaattcttgtcatggcttttctcctcatttctttttttgttcaggaacatttgttctgtttttattttacacgaaatacggccttttaatcaagaacgggaaaaaatgactaaaatgatcaggttgtttcagactaatacagaaaacaaccgagacggatgatttaaagtttttgatttaaagtgtagaatagaagtagacaaccgccctgaggagaatcaatgttggagcaattattcagctattttacagaagagaatttaacagagttttttcagagctacagggcttttggtccttttgtagccgtactgctgccgtttattgaagcgctgctcccgtttttgcccctgctcgtgtttgttgttgccaatgtaaattcgttcggtttatggcaggggtttttgttgacgtgggtcggggcatctttaggttctatagcggtttttctttttatccgccatttcggccagcaaaaagcactcggttttatccgcaggcatccatccgtaaaaaaactgatgatctgggtggaaaaacggggcttcggtccgctgtttctcctgctttgctttccattcacgccttcggcggcggtaaatgttgtggcaggactttcgcgagtcagcctgctgcctttttcattggcggtgctttgcggcaagttcgtgatgatttttatggtgagctttgtcggccatgatctgaaggcgctttttacccagcctttgcggacagccgccgtgatcatcgtcatgctgatcttatggtacgccggaaaacgggttgaacatcgtctgaacgtgagattcagccagagagagaaagactagggggacacagaattgaaaaagcgttttttggtcatagccggggtactgcttgtcatcgtcgtcgggattcaggtcaaaaatgccgttttcattgaatataaagtagaaggcgtcagcatgaatccgacctttcaggagggcaacgagcttttgatcaacaggttcgcccaccgctttaaaacgatcagccgatttgacatcgtgctgtttaaaggacctgacaaagatatattcattaaaagggtgatcgggcttccgggcgaaaccctcaggtatgaagatgatcagctgtatatcaacgaagaaaagatcaaagagccttatctggacgacttaaaggccgtcaccgccggaggggacttgacaggggattttacactgcaggaagtgaccggagaggagaaggtgcctgaaaacgagtacttcgtcctcggggacaaccggatccacagctttgacagccgccatttcggctttgtttcagaacgggacatcgtcgggattgtgacggaaagaattgataagaagtgattggagagtacgggggagagtaagcggccgaccaaggaatacgattacgcaaatgacgagcccgaaatgtcaattagtacaacagcatcaataatgacgcatttgctaaatatgaaaattaaaaggcccggatgattccgggcttttttccgtactacttcagcttaatggcattgatccgtttttgcagcttcgttttttcggcggatgctttcagcttgcctactgctgattgcgctgctgattttgtttttttcgttctcttttgttcggccgttttgactttggcctttgctgcagaaacttttttattataggctgcagctgcttgctttttcgcggtgttcagccttttttgcagatttgatttgtcttttccggcgggaagctcattgatcgctttttgcgctttgccgaggtttgagtctgttgccgctttttcagctttggcaacggcctgctttgcggtcttcaagaggcttgaacggaccgcgttgatccgtttttgcaaattcgttttgaaagtgccgctgtcgagttcgttgaccgctttttgggcggagtcggcattggttttctttttttgcttctcagcgagtttcactttgctttcggctgtttttttaagctgctctttaacagtattgagtctctttttcaaagcggttttatctgcgtctgcagggagcggttcgatcgctttttgtgcggtttgaatgtccgcttttttctttgtcttttccgcttgtccgacggctttttgcgctttttccaatggctgtgtgacctctttgaagcggattaatccgtagccgaacaaatgatcacggccgggagcgcccaaatcgcttgtataaaactgcattttcttgcgcagctcagcatttgaagcggttgggtacagctgtttcaaaagtgcaaacatgccggtgacgtgcggcgttgcctgtgaagtgccgcttccgattgcatagccgcgatcggaagatgtactgataatcgatgtgccgggagcggaaaactcgacggcgctgccggtgttggaaaatgaggcgatctgatttttttcattggttgccgagacggcaatgacgctgctgtaggcggccgggtaataaacggattttccgtttccggcatttccgctcgctccgactaaaatgattccccgtttgtatgctttatctactgcatcgtggagaacttgactgtcgcctgaaacgacgaggctcatattgatgatatcgattccgtgctggatcgaccaatcgatgccttgtaagatacctttcagatcccccgcaccattccggtccagcgcttttacggcatacagctgcgcgccgggcgcgatgccgtcgatcccccgtccgttatgcttcgctccgatgattccggcaacatgggttccgtggccattatcgtcacggtatgaagcggtatagccgaccatcgatgcaccgccggcgatcgacagctcctcatggggggaaatcccgctgtcaataaccgcgatcttcacctgttttccggtcaaacctttattccaagccagtgcggcttgaatcagcttgatgttccactgtgaaaacgcggaggcgttttgcgctgtgctgctggagaaagcttttagagcggtgctgtcggcagcagctaccgggaggttgtcttcgacatacaggacgtcgggatcgtgttcaagttcgcgcactgttttgtcgtccgcagtgacagcggctgcgggaatgtgccggtaaacgtgttctaccgtgtctgcctgttcgatgacggtttcttttccgctggtatttttatatacaacaatgacctcgttttcctgcttattgctttccgcttgaatgcggggtgaatttgcgaaaaaaccgacgaacattgcagccgaaaccgcgattttccataactttttcatccggctctcctccttttttagcggcgttcgctatatatatcggaggatttttgaattttcaaagagaaagaaagcttatcttaaggtcgcttgtcatgcacctttagtttttaaaacgttaaaaacactgttatatcaacatttgtgaagcttcctgtttattcgggaagttaaattgggtactccaagttagttttaaaaaagagtcataaggccagcttctatcgatgaatcatttttaagcgacgccttttgtctaaaatgtataatgttacttttgtttttgttgaaagtgaacaatgttattgactggcttacaacctacaatttaattaaataaaaaatagattaaaagaagggagcgttctcataccgtggaaaaaacaattaaacatgaccccaattattacaaaaagataattattgcattgtgtttagggtgggtcgctatttggatttatcgtacaatacttacgccaatatatccgcagattcaagaatcattagggaatattagtgacacgcaaatagggttggttgcttctatttatttctttgcatatacgggtatgcaaattccatcaggagcacttgtcgataaatttggacaaaaaaaggtgttaattcctgcatttatcgtttttgcgctggctacatttgtgattggcacaagttcaactatcatgcaagtatacattggttcgttattggctggtatttcgactggttcatattacggtgcagccttttccttatcagctaaacatacgccaaaagataaaaaaagcttttccaatgcgattataaatagcggttcagcattagggatggtaattggactaatcggatcatcggttttagtaggcggttttgaaattcaatggaattatatgctttttataacagctatcgttatcgtagctgtaacatttgtgtttgtgctgtttattaaacaagataaaacatcagataaggaagtggctgaagagaagaaagacactgtacaaagcacagatattcaaaatgaaagcttattttctccaagacaattagttgtatattttgtatattttgcaacatgctatggctattatatgattgtaacttggttgccgtcctttcttgtagcagaaaaaggatttgctcaaggttcagtaggatatgtagctgcactagttgcggtcactgcagtgcctggtgctttgatatttactaaatatatagacaaaaatgcacatttgcgtctgcgtttaattttatttttattaattgcagcagcagtaacaattagtttgacagtgtttgcaccaaatcctgcagtactgtatattgcgttaattttatatggcttattaggtaaacttgcgattgatccagttttaataacctatgtatctgattccgtatcaggagacagagttgccagagcattaactctctttaacttctttggaatgagttcatctgttattgcaccaacacttactggttatattggtgatgtaaccggctcgcgagtattagcattctatattgcaaccattcttcttgcagcagcagcgttgctatttttccttgtggttatgttaagacagaataaaacagcagctaactaagagaacttccagtggtgctcctttgtattcacaacgatattttctctgaagcaaataacgccaaacgaatgctcagtgatgtatcaggagactctacagattgacctaatatttcttcgcattttttaatacgatatttcacagtattacggtgaataaaaatatcttctgaggtttttgtaagatcacattggtttgccatatagacacttaatgtgaatcttagttctttttccttcgttgtctgaggataggctaaaggaccgagtgtataaatgataaatggctttaatttattcgttggaatgagttgtaataattcttctacgcttttggatttgtagggctctataaattccatttcgccttgttcatatttattatcataagcctcattcgcttcgaaaaaagacagtggcaattgtgaaagctcggaaacctcattaccaatgccaaatgaaagggagctattaaaaaatagctgatactctttttggatatatctgcagtattccaaataataatgatgtcttctttgcagaagtatcgtaaatctgcgttctccctgagacatatatatgctaatggaagggtcaattccagtaaacttatgcgtcagccactcaaaagtcatctgatatcgctcatttaagtaggcgctattttctacattcttttctttgtcaatcccgcaaataatcacttgatagaatgtagaaggttgaatgtgatatttttttaaaagatcagtgtgttgtgctagtgaaacaaggttgtcaggatgttcggacataagtgttgtgaaaaaatggttcacgtcctgctgctctgcttccttgattttactatttttataaatagcgagactaagtgtgttcactgcctgttctattgttaataaactaatcggatagttgagcaaattaacatttgaaatcataagataatacggaaaatatttaaatgcaggaaccttaaatacagcatattcttcctggaaaacaccattatgatttggttcggtttgctctgaatttaaatatcttctgaaataattaaggtttttttgaacatgttctgagttttgatgaaagtgatgactcgatgattcaacttgatgaaaagaatttagcagcattacaggaacctttatgagtctacttaaacgttcaatcatcatgttcaggctaaacccttgcattagcatagcatttaactcttgttggatatctaatgcgaagtgtaatttttctgtttcttcatccaagataaatgaagatatatgatgagtaatggatcccaaattccaactttccggaatttcaataattgggaattttaatttatttgcaaatgcaataacctcatcatctaatttttttaaaaatcgggatagcttgatacctagaccagcaacttgtatatcatttaactctctaataagattgattagtccggattgatcatcctgatagctcattcctgttgtgacgataagtgagtgcggcgttgtaaaatttttaatatcaggcgtttctgtaatatcaaccatttctaccactcgttccaaatcgccctgctcattcagcaatgttaaatctgaaaattgcagtacagataatatttcttttaatgttgtcataaaggctgcctccttatctttgttagaaaaagataaaataaaaatgaaatatgtaagatattacaaggataacttttcaatctgatagtacactgtttttgaaggttattatacgtataatcctttagttaaaaatattaaaggagaatcattatgcttgaacaaaatcaagatattcatcatgattcttcgtttttgaaaagtgtggttattataaagatatcatgcccaagatcacttgaacaaagaaattcatcctcatttaacgttgcagtgggagcagggcgtaatattcagaatgatatagccgttggtggtctttttaaaactgggatcattaccgctaaaattaatggtatcccttattataagttccttcttagatagtcttaagactcgccgtaaacggatacaagggttcaaaacatatgcatttaagatatacctatggtgatataggtgctaactgcaaggtgtattacgtggtgctgcggattggatctcctcggtttgattgcagacatttgctggttcacaagctttattgagtggttccggctccacacaaataaaatcagcaaaaacataaattattggacaagtttccggtattgttgctgctcacgttttatttgcgttttcaactgtaaccattttaattggatgctctattgggtcaacaaggacggaatatactgaatgttgttaatcaataggatatatatttgcggtttccttgctacaggtgtacttctatttacagaaatctctatcaatgcagcaagtaatattattcttgcagcttaaaaaagaggaggatgattttgatgaattttgattcaattatcaaaaatggattagtcattctagaaaatggtgaacaagaagtcgaagtagggatcaaagatggcaaaatcgcagcaatcggtcaggatttgggtacaagtgcaaaaattatcgatgcaaaaggatctattgtatctccaggtatgattgatgcacatgtgcatatcacagagccgggcggcggctatcgtgatgaatgggagggctatgacacaggaacacgtgccgctgcaaaaggcggtgtaacgacgtttattgaaatgccattaaatcaagtgccagcaacggtagatgaggaatctattcaagaaaaatttaaagccggaaaaggaaaattatcagtagacgttgcgagttacggcggtttagtaccatttgacttagatgggggtattcaagaattagatagcaatggtgttgttgcatataaatgttttttagcaacatgtggcgaccgttctatagaaggagatttcatgaacgtagatgactattccctctacgaaggcatgaaacaaattgcgaagacaggcaaaatattatctatacacgctgaaaatgccgcaattaccgataagttaggggaaatagcatctaaaaatggggaaacttcattgcgtgcttatgtagattctcgacccgtatttactgaagtagaaccgattagaaaaattattctatttgcgaaagaaacgggatgtcgtgtacacatcgttcatatagcttgtgaagagggcgtagacgaaattgtcaaagcacaacaggaaggggtcgatattacatgcgaaacatgtacacactatttatatttctataaagaagaactagatcatatcggaccggttgtaaaatgctctccgccaatccgtgagcaatcacgcttagaaggcatgtggaatcgggtattaaacggagatatttcattcgtaacatcagaccattcaccatgtaccccggacttaaaagctacggataatgcatttgaagcttggggaggtatcgcaggtttacaaaataatgtcgatgtattatttgatgaaggtgtgcaaaaacgtaatatgccattatccaaatttgcagccattattgctacaaaccctgcgaaacgttttaatctcgcatcaaaaggcagtattgcagtagggaaagatgcggatttcgtatttattaagaaagatgcaccttatgaattaaaggctgaggacttagcatatcgacacaaaattagtccgtatattggccgcaaaattggtgctcaggtagtgaaaacaatccttcgcggtgtcgaaatctatgataaagaaaaaggaatttcaaatgaaaaagtaggaagatttattccttaagtgacggaatagccatcccgtcaggaatttgaggcataggaagatgtgaaggcgacctgagattgtgttacactcgcaaatcagtgtgtcatcagcatttcttatggcggctatacagctgaagtgagcatggtaaagtgacttcaccgcaatctctcgctattacagcagcagctgttaatcaaattaaaacgagtaaaaaatttccaatatacactaacagcttagaattgctgctgctcgtatgtattctgactcttggcatatcattttaaactaccctataaatcaatgttttttattgatttatagggtagtttttttatttgcaccttatttattaatgggtaggagagatgtgtcgctcccatctataaatttttaagcgagcgatctgtgattttctttaggagaaattcgatgcaaatttaatttgttattttttgagtttttatgtaatcgaaagccaacagtttctttttatctctggcattagcccattatttagataccgtaaattgattaaaaggtgtctttgttaaaagtgcataaaatgcttttctattattgttggttatgtcaatgaatggtcgtaaacagggttctatgatgaaagtaaatagagaaaggaggagaaaaaaatagatattcgatcaacctttgaaacgttggataagaaattcacaagttttggcggtttagaacaagggggtattacgcgtctgttatactctcctgaatggattgctgcagttcgcgaactggaagcgacattcaaggaagaaggtttagaagtaagctttgatgatgttggaaacttatctggtcgccttgttggaagtaagcatcctgaagaaactattttaacaggatcacatatcgatacagttgtagaaggcggtcatctggatggacaattcggtatcttatctgcattggttgctgtgaaatatttaaaagaaaaacatggtcaaccattacgaacaatagaagtactatctctcgcagaagaagaaggaagccgattcccatatacattttggggaagtaaaaacttctttaacttagccaaaaaatcggatgttgaaacaatagaagatgctgatggaattaaatttgaagatgcaatgcacgaatcgggttttgattaccgtaaaacagatcatgttcgtgacgatattaaagcatttgttgaagtacatatcgaacaagggaaagtattagaggcggaaaataaagcgataggtgttgtaactgggattgttggccaaaaacgttacacaattaacttgaaaggtgaagcaaatcacgctggcacgacaccgatgtcattacgaagggatacagttgttgcatatagtgaaattgtaacagacttaacgaaacgagctagagaaattggggagcctcttgtattaacgtttggacatgtcactcctgttccaaacacggtaaatgtcgtccctggagaaattactttttcgatagactgtcgtcatattgatcaacaactattaaataattttgcgaaagaaattgaagataaagttaaagcggttgcagaagcaaacaacatgacttatgacattaatttatggatggatgaagcaccgtcattgatggataaagaaatcattaaaataattgaacaagcagctaaggccaatgtgggggacagctataaattgatgccatctggtgcaggtcatgatgcgcaaatttttgcggattttgtcccaacagcaatgctgtttgtaccttctattggcggaattagccacaataccaatgaagaaacgaagatagaagaccttgtgaaggggattgaagtattgaaagatgtattgtttgaactagcttataaggaataataatgaaaaggagccagatactcatgagttacttaaatcataatcaaggatacagagaaggtttattagaaacacgttcagtaataaaaaaggataattatgcggtaatcacacctgatggcttggttaataatgttgtacctggctttgaagattgtgatgtaacgattttaggatccccgcgtttaggtgcaaggtttgtagattatttggtaacagttaaaaacaagggcggaaacaaaacaggttttgccggtgatggtatccaatcatttgtgtacgttgaatatggtaaaatcaacgcttttgcggatggtgaaaaatacgaattagcaaaaggcggattcttatatgtgcctccacacttacaattgacatttgaaaataataataatggtgaggacagccgtttgtttttatacaaaaagcgctatcagccgcttgaaggacatacaccagaaatcgttgcaggtaatgtgaataacattaaacaagaagcctatgaaggtatgaaagaagtattaattcaagatttactgccaaaagaaatcgcatatgacatgaacattcatattctttcattcgagccaggtgcttcgcatggttacattgaaacgcacgttcaagaacacggtgcctatatattaagtggacgaggtgtttacaacttggacaacgagtggatgccagttgacaaaggtgactatatttttatgggagcttatacgccgcaagcaacctatgcaattggtttggatgaaccattctcgtatatttattctaaggatgcgaatagagatattaatctataaagaggggcaattttaatgagtgaaccattagtgtatgtagaacgtaatcgtctccggcagctaatgaaagataaattagtgaaagcaggtttacctgaagaacaagcggataaaacagctgatttactcatttttgcagatgaacgaggtgttcactcacatggtgcagtaagaatgcaatactattccgaacgtgcattaaaaggtggatataacctgaaaccaaacttaagcttcgaaaaaacgggccctgcatcggggatttatcacggagataatgcattagggcattatgtgagttatcaagcaatgaaaaaggcaatcgaattagcaaaaacatcagggatcggtgttgtcggtgttaaagaaatgggacacagcggtgctattggttattatgcacatcaagcagcattagaaggtatggcggcattaacagtatgtcaatctgatcccatggtcgtgccatttggcggcaccgaaccatactttggcaccaactcaattgcttttagtgcgcctagaaaagacggtagtccaatcctttttgatatggcaacaacggtacaagcctgggggaaaatcttagatgcaagaagtaaaaacaaatctatcccagactcatgggcagtggataaaaatggagcgccaacaacagacccgtttaaggtaaatgcattattaccaatggctgggcctaaaggatacgggttagcgatgatggttgatattttatcggggagtttgctcggcttgccatttggcaagcatgtcacttctatgtataaagatttatcggagtaccgtcgattagggcagcttcatctcgtaatcaatcctgaatactttggtgggaaggagcaattcctcgaaaaaatatctcaaatggttgaagaattacatgacaacccacctgctgaaggatttaacaaagtgtattatcccggtgaaattcaaatagatgtgatgaaacagtataaaaaaacaggtatcccagttacaaaggaaattttagattatttagagtcagacaaaatttactaatcatgtaatgaagggggaagcagatgcgcgtatctaagcaggagctgtttcatttaatcaaacagaagctgatcaaagctggattaaacgaaggagccgcacacgatgtttcagatgtattgacattcgccgatcatagagggatccattcccatggtgcagtacgtgtggaatactatgccgaacgaatcgcaaaaggcggtattacagcaaacccaaactacacatttgaacaaacaggacctgcatccgccgtctttagcggagataatggcccaggtcaccaagcagcaaaacaagcgatggaaaaagcaatcgaaatggcaaaaaattcaggtgttgctgttgtaggcatgaagaatatttcgcatagtggtgcattgggttactttgttgaaatggcagcagaacaggacatggttgctttaagcatgtgccaatcagatccaatggtcgtaccgtttggaggaacagaaccatactttggcaccaatccaattgcttttagcgcaccatcggctgatgaacgcatgatcacatttgatatggcgacaactgttcaggcatggggaaaagtattggatgcaagaagtaaaaatgaatcgatcccggaaacatgggcagtagatgcagccggtgcaccaacaacgaatgcaagagatgtccatgcacttgtgccaattgccggtccaaaaggttatggattgatgatgatggtggatgtcttatcaggcagccttcttggagtacctcatggcgtacatgtatcttccatgtatcaagacctgacaaaaggccgagatttagggcaaattcatattgtgatcaaccctgcatacttcacagatttaactgcttttaaacaacagatttcgacgatgcttgatgaattaaaagcacaaccggcagcagaaggctatggggaaatttattatccgggtgagcgcggtaaattaagaagtgcaaaatatgataaagaaggaattgaaattgtagacgatatttataactacctcgtttcaggcgatgttcattacaatcgttatcatggaaagaatagatttgcagaataacaaaatggaggatcattatgttatacacaattataaaagaaaacacctatcaagattctatcgtgttaatgcttttatcaaacaagttatctgcaatagatggtataaacaaagtttctatcatgatgggaacaccagctaacaaagacatttttaaatcttcgggtttgggcacagatgaattggaaaaagcaaacccaaatgatatcgtcatcgttatagatacaaaccaagaagaaaaggtatcggaagtgaaagaagaagtagaagcagctttaaaaggagactctgcttcacaagacagagctaaagaccaagaagcacataactggaagcgtgcaatggagcttgcgaacaaccctaatctggcattgatctccattcctggtcagtatgcagcaatggaagcggaaaatgcattgaatgaagggttacatgtatttctattcagcgacaatgtatctaaagaagatgaggttaagttgaaacaaaaggcgcatgaaaaaggattattagtcatgggaccagactgcggtactggaattattcacggcgtgccactggcatttacaaatatcgtgaataaaggagatattggcgttgtgggtgcatcaggtacagggattcaggaagtgacatgcatcattgaccgtcttggtaaaggtgtaacaaacgcaattggtacaggtggtcgggatttatcaacagaggttggtgctaccatggttttagatagtatcaaagcattaaatcaagatccacaagtaaaagtgattacagtaatttctaaaccgcctgcaaaggaagtgcagcaaaaagtattaaatgtgttaagaaatattgaaaaaccggttgttacgttatttttaggagataaaccaacttatcaggaagaaaatatttatcatgcgtatacacttgaagaagcagcggttgtatctgttcaattatccaatggcgacaaaccgaattttaaaccgacagtggctgaaaatgtaaacgtgtcgttaaaagattcacaagttggtattaaaggttattactcgggcggcaccttggcatctgaagcagctgtgttagtgaaagaggcattcaaagaagaagtacctgaagagaagaaaggtgcctatattctaaaaacaaaacatcatgaaattattgacttaggcgatgatatttatacccaggggaagccacacccgatgattgatcctgaaaaacgcatcgaaatgcttgaaacatctggaaacgatcctgaaacagcagtcatcatgattgataacgtcattggctatggcagtcatgatgatatggcaaatgaattagcaccagccattaaacgtattttagccaatgcacatcaggatggccgtgaacttgcagtgcttgtaacagttgtaggtacagataaagatcctcaaggttacgaaaagcaaattgaaaccttaaaagaaagtggtgcaatgatttgtgagacaaacgatcaaatggttcgtacagcgattaaactggcaggaggaaaagtggaacagccagtccttgacatacaaaaatttgaatatacccaagaagacttgacagtagacgaaaaaattatgtccttaatcaatacgaaaccaagtgtcatcaatattgggctgaaaagttttacagcagctgttcagaagagcggatcagagtgtgttcaatttaactggcggccaattgctggcggtgatgaaaagctaatgaaagtgcttcaatatctaaactactatgaaggagagacaatctaatggggtacaaaacaataaatgaagcgaacgaagctgttatccggaagatcatagcagctgaaccattcttgaccgatgttgtacctgccaagtctgtgattcctgaattagaagattatgtgttattacatgctgggcctccaattaaatatgaaaatatgacagatcctatgcaaggctcttgtgttggagcgattctttttgaaggatgggcagaagatgaagagggagcgcgtggtctgcttgaaaacaataagattacatttattccatgtcatcatgtgaatgcagttggaccaatgggaggcattacatcacctaatatgccggttcttgttgttatgaacaaagagagtggcaatgaggcgtactgtcaaatgaacgaaggcatcggtgcagtattacgcttcggtgcttatcatgagcaggtaatcaatcgcctgcactggatgaaagatgtgttgggtccagtgttaagtaaggccttaagaaaaattgatggaggcataaacgttaatgttttgatggctaaagctattgcaatgggggatgaatttcaccagcgcaatattgcagcatcattggtgtttttaaaagaagttgctccagtaattgtggcattagatgatgttgaaaacgaacaaagtgcagaagttatccaatttttagctgatacagaccaatttttcttaaacattgccatggcgactggaaaagcaataatggatgcagcgcgtacaatcaaacatggtacagtcgttactgcaatgtgccgaaacggtgaaaactttggcattcgtattgctggtatgggagatgagtggtttacagcacctgttaatacaccacaagggttatattttaccggctactcagcggaagatgcaaacacagatatcggtgattcagcgattacagaaacaatcggtgttggcggcgtagcaatgattgctgcccctgcagtaacgcgttttgttggaacaggcggatttaatgatgcgcttgaaacaagcaatcaaatggctgaaatctgtgttggagaaaatccgaactttgttattccgacgtgggacttcaaaggtgcgtgtttaggtattgatgcacgtaaagttgttgaaacaggcataacaccggtaatcaacacaggtattgcacataaaattgctggatatgggcaaattggtgctggtacagttcatcctccaatcgaatgttttgagaaagcaatcacagcatatgctgaaaaactaggttttcaaggatgattttacaggcaagtgcggttggttcaatcgcacttcagctattaattgagggaaaaacgtttactgtacacagcatttttgaaaaaggtttaaatattgttgatcggaatgatgaattgatatttatcggcacaaatgaaaatgggaccttcccatttggaatcttgcttgactcacaaacgaagcaaacattaaaagcagatcttgaagtgggagatacatttcacgttcgcaatagccatctttcccacaattgttttgaactcaattttaatgcggaaatacttccgttatatacagattttaaacatgcaaatataaataaattaaaagaaaacgtgaaacaaatttcatttaaatcgtatgaatctactgattttgaatcagctcgcgtgtcggacttgataaataaattacacgatccaactgaaaatttggaggaagagcttcgttactttatcggtcggggccaaggtttaacgccgacgggtgacgatatactggtcggtatattgtatggacacttcatcaactcttttatcgccgaaaaacaccttgaaacattgggaagtctaatcagagaacccttaacaacccttgtcagcacgcgctttttaacttgtgctatagaaggcttgtttagttcaaaaattacaaaattacaacatgattcatctttgaaaagtataaaaagtcttataaaagtaggttcttcttctgggatggatactttatatggaatttatatggctttaacaaaggagtgaaagaaatggggaaaagtgtagtaatcgcactaggaggtaatgcaattttacagccaaaacaagaagcaacttatgctaatcaattcaaaaatgtaatctctgcaacacgtcatatgattgaaattaaagaagcaggacataaaattgtgattacacacggcaatggtccgcaagttgggaatattattgctcaaaatgaagctgccaaaaatgtcgttgaaccgctgccgatctatgcttgtaacgcagaatcacagggattcattggttatatgctcgaaaaagctttaaaaaaccatattaaaaaacggggcattaccgcgaatgtagctacatttctaacaatggttgaagtggacaagtatgataaagcatttgaaaaaccaacgaaaccaataggagtattttattcagaggaagaagcgaagaaattggagaaaaaagggtttgctatgtcagaagatgcagggcgtggctatagacgagttgtgccttccccagaaccgaaagtgatccatgggatagaagagattcgacgtttaattgatgaaacgattgttatctcctcgggcggcggcggtatacctgtatatcgtgacgacagcggtctattacatggtcttgaagcagtaatagacaaagatcgttcaggattaaagctggcacaacaattaaatgctgatgttttcatgatgttgacagacgtaccaaatgtgtttatcaattttggcaaagaaaatgagcaaaaactaagccgaattacagtagaagaagcagaacaatatgtggcagaaggtcaatttcctgctggcagtatgctgccaaagatgcaagcggctatagaatttgcaaagttaggtaaagaggcaattatttgttcattgaaccaagcggcagctgcactagacggaaaagcggggacgcgcataacaaaataagacgatccgtgtatgttcataaggtggataaaaactaaaattcccaccttttcagatatgacgacatttgatctgtcattctgatcaaaaatttctgaacaatctttataatgggattctttatgctgcgcagacagatttcgaaaagaaacaatctatgaagtctaggatcgaaagtcaaaggattagtggaaaaagttgaaggaggaagtttgatgacaaaagaggcgggatcagttgaaggtaaaggaaaacaaccactggttccctattgggtaaaagttgttatcgtatttttcttcggttgggtggctctttatgcaacgcgaacaatattaaaccccattatgggggatattgaatcagcgttttcattaagcaaggcacaacttggcttaattatgagtatatttttcatcggttatgctggtatgaatgttcctgcaggaatattaggagataaaattgggaaaaaacgagtgttggttccaggtgttattctatttggctcgcttgcagcagttacagggatgatgcccacattctttctgtttatctctgcatggcttatggttggtatggctcagggggtatattatgggccgcaatatggaatatcatccgaaattatcccgaagaaccgtctaacattaggcagtgctgtgattaatgcagggatggcttttggtacttcaattggctattatatctccagttatgttgttggagaatggggattcggatggggaaccccattttttgccatcgcagtgccggttgtacttatcggcatcgcaatggcaattgtaattaaagacaaaccaaaaactgataaagaggttaaaaggagcgctgaaccgtttaagttttcatctttatttaatagaaacttaattttggcatatattattattttctgctctatttacggattctttatgattattacttggttgccatactatttagaaacagcacgcggtttaaccggaggaaatattgcctttgttgcatcacttgttccatgggcagcaattccaggttcattattttttagttggctgtcagataagttaggccggcgcaaaccagtattgctcatgatgttgccatttggtattttatcaacagctgcaattgtttactttgatagcttaccaattctgtatatgacactaattgtgtatggaattgtagggaaaattagcgttaaccccgttttaattgctgttgtagcaaataatgcaccaaagcaatcattaagtacagcatttggattctacaactttgttggaatgttaggttccattttagctccatatattactggctggctgacagacactacaggaagtatgaatataggattttattttgcagcagctctgttagtaatcgcgttgattgcaacatatttaatagacgaaagtaatttgccatctgttgataaagcagctaaacatcattagttagcaaaagcttatgacttctagtaaatgctcagtcagattaagtatgaagagactcattcactgcaattgcgcttcaagcggcacaacaaaggcgacagccagaggctgatagatgcaaataataaacaattcggaatcgtggtgttaaaattcagcagcgtctgcaaaacagcatgggctaaaatgacgctggacaaagcagtgtccttaggcttggaggcaaatgcatatttgaaaagaaacacagacggaaaagaactgagctgcagcccggctggaggaaaaggaaaagtgctcccggggcagacatcctgttatacaccgatggttgatttcgatccgcgttcttcatatgcgatgtagaaacattatcaatccattaacaggagctctcacttattcctatacaagttcgtattcatatttgaagaagtagtgtataaaagcaccctttcagcaagggtgctttttgctgtcttatcagtcacggtttcacagctattgaagagtcatttgacctaataaaagagtgggaaaagtgggggattcaggaaactgtgtaaaatgaactattactattaatttatacagggaggaaaatatagtatgatatgaataatgaataaaatacaaaaaaattgaatatcggaagaaaggagctccatatgaacaagatcgccgcggaagaagtcgccaacatccttaatacatggtaccgcgccatcagaagaaatgatgctgaacagtcgatccgaatatttgaagaagtcaaaccgatgctggcagagatggaggaagaccaagaggttttaatctactattctctgctggaactgcggcataaaatcatgctgtatgatacgcggggaaaaaagatagaacagcaagaggagttaacgaacggcggcagtgctgcatcacatatgacatcctattactactacctgttttcaggagcttatgaagtgtataaaaagaattatgagcaggcgatcagcttctataaaattgccgagaagaagcttgctcatgtacatgatgaaattgaggtggcgcaatttcacgataaagtcggaaagctctactattacttgggccagaatatcgtctctttaaaccatacccggcaggcgatggaaattttcaaggggcatggcgaccatgatatgaaccttgtttccacttatattacgatggccggaaattatacagagatggggaaatatacagaggcggaagaatatttaacagaagccatccatacggtaagaaaagccggcgactgttttaaagaaatgcagctccttcataattttgccttgctttatgcggcgatggacaattcggaaaaaagcattcagtttttagaaatcgttttggatgatcaagcatatgctgcatcagattattatttcaatgctgtgtttttaatgatcaaagagctgtttaaagtcggagaccataaacgcgctgcagccttttacaaagaagggaaggaaaggtcgaaatccgcggcgaataaaatatttgacgccaaaatcgatattttatatgcggcttatgcaggagatggtgaacaggcggttaaagactgcaaagacaacattgaaatcctgtttcaaacaaagcaatacgacagcgccagagaactttcgctcttaacggccaatgtttacagatcaaagtcactttataaagaagccgcacatttctttttggaagcgattaaagcggaagaaaaaatgaaaaaagtggagggaatgtgatgaaaaaactgttcattgttgctgcgattgctgccgtcgtatgttcgggatggtttgcggcagaaactcactgggcatccggcgacatgcaggttgctgaaaagatggtcggttaaatcgaatactcggaacaaatatgaacatccgctcctgagcatcagggcggatttttttgggaaggtaaagtaaattaaggcataagaaacgcggttagacaatgaacacttcttcaccactatttagggtggtcaacctaaacaaaggtacgaaacctgtgctgactacttttactccgatgtcctttcagctattcttgtcagtaagatcattccccatctcttcaacgcctcaggcatcacctattaaaaaaatcataattgaaacttgtcagcaaatatgttgcataacacgaggatgtttccacaataattaaacattaagacttttttgacttccagaaggaagaacaagatatttatgtaaaatcactcttttattcaaaatcaagatctctttcttgagggttttgcttttgagtgaaaatcccattctaaatttgtccatttaatggtattatttacttatataataaagaaagtgggaaacaaaacgttgatgttaattgcttttgaattttaccgaactatactcccagcatgaagtatttgttattttcaatttctttagtgtgataggtgcatttgttggatatttaaagagcaacggaagtattcaaatgcccctcttaatgattgattataaaagaaagtgggaacacaaaaatgtaagccactttaaaaatcattaaagttttcacggattgttattgagttattcctttttttattgggattagatatggaagaaacaaaagaaatgatgaaactatgtttgaggtcatttcttttgatatcctattatcaaaattacataatcaaagtaaagagcagaccagcggcctgctctacttttatacgagccataagatgatttccgcaagggaatctgctgtttttttaggaactccggctttcactaaggcttttacaagagcgccttttgaagcactatttaatctttctgtggcatatgcaattttacgtgcatatttgtcgacgagtctcgctttagaaggagagagtggtctaatcgcccatttaagagtttttcccccaactctgcaaacccatccaaatgcttttatggcttttagagatccaccaataaggcctgcagtatgtacttgtccatcctgatttaactgattgtaagtttgaaattctggagtttgtgatgcaaattggatgaatgctttggaatcttctagagtagtaggctcttgatgtgtttccatatattcttgaagagaagctggcaatgtgacatacgtcgtttcggtaattgatgtggttgactgttcttgttcagcggctgagacagatgatgcgaacccactaaatcctgaaatgataagggttgtggccgtaagtgttatcacaccttgagaaaatctttttttctttgattacatttcaaattcccccaattatttgatattcttaacaagtaatataataccacaaaaagagaggaataggtataaatgggtgaaaaaaccaaagaaaaaaactactctattggggatcatatttttgcaatattggttgttcttcttatgtgtttatttcttatttcttccccttttctgatattcttcggagtctttaaattggtcgctttggcaccagatgtgtcaatcaatacaaaaggtacttttgattctgtgatcgttttattcaagttttttgttctcactgtggtagtcgtagggattgtagacgtagtgttttctcagattttattgaaaaaacgggggtttctcaattttgttattgaagctttgttgatgttttgtgttttttatctatatgtattgatttattcaatgcattctcaggagattgttatacggaataatggtgtattcttagtatctttatttttgtttattttgtatttgctaataaatgtagcatatatcgtttcacggcggttatataaggcaactatgaaaaacatacagaaaaagaacaactaaaagagcaggcagctgtctgctcttttaaaatttcaatcgccaaaagttccgtgtcttaatattgaaaccataaattgaatagactcttaatccgatttataagcacttcaggaacagcagccggatctagagaagtccaaaaagatcgcgattgaaaaaacttattttttttaatattgaaaacttttaccttgtttgttatgatttttttagtaaagtttagtgaatacggattccaaagacaggacgggatgaaaatggcgacgattaaagagattgcgcttcaggctaaagtatcaagcacaacggtttcaagggttctgaaccatgaccagtcattatcagtagcgcctgaaacaaggcagcggattttggatatagcagcccggctcggctataaaagcacgcgcaggcgccgcgaggtatatgcctcaggaagcggggaaagcccgcgcatcggcattgttgtctgccaatcacaggaagaagagctgaacgatccgtacttttattccatcaggcagggaattgaaagtgagtgttttgaaagaggagcgtttattacgaaatttattcagctgagcagcatccgctcgaatcagcctgtaggcgatgtcgacggcttaatcgtcatcggaaggatcaactttgccggtttgcagcagtgcatgggcgcgctcaacaacgtcgtgtacatcaaccatacagacaatgaagagctgcgcgactcggttgtcgtagattttgagaaggctacggggagggcgctgaaccatttgaaatcgctcggctatacaaggatcggttatatcggcggaagagaaaaagagcactttcgaatcagcgatcaggagacaagcgccattgaaatcgaagacaaacgtctgactgcgtttctggagatggccggttcggataacgcaaagcacatttatatcggcgagtattcgatgcagcaaggctatgaactgatgaaaaaagcgcttttagagaaaaacgttcccgaagctttttttatcgccagcgattcaatggccatcggcgcgctccgggcgcttcgagaatcgggactcaaggttcccgaagatgttgcaatcgtcagcttcaacggcattgaagcgtccgaatttgctaatccgccattgacaaccgtaaaggttcatacagaagagatgggccggacgggtgtgaagctgctgctcgacagactgaaaggaagggaactgccgctgaaagtgaccgtaccttcagagctgattattcgggaaagctgcggattcagcaaacggagctaatggtagaataaggcgctttccaaggaggtgacgcaaatggatttactaaattccagtaaaaaatgaaagcgctttttattcaccattaaaatatcataattggagtgaaattgatgaaaaaaatcattttctcttttgttctcctgatcattttgtctgcaatacttgcgggctgctccggaaagaatgccggaaagagcggagatgtcacgctcacaatgttttcgacaatgacaaacgacagtgaaaaaaacacgctcagaagcatcgcagatgattttgaaaaagaaaatgaaggcatcaagatcgatatcagctttcccggcccggactatgaaaatatgctgcgcgtcaaaatggcggcaaatgacatgcctgatttgttcgatacgcacggctgggcgaagatccgctacggggaatacactgctgatttaaaagacatggattgggtgaagcatctcgatccaaacctcgatccgattttgaaggatgaaaaaggcaaagtatatgcctaccctttcaatcaggcaaaagacgggatcgtctacaatgccggtctcttgaagaaatacggtctcaagcctccgcagacgttggacgaactgatgcatgcgctggaaacgatcaaagaaaaaagcaacgggagcgtcattcctttttggtttgccggttcagataaaggcgctttagctcagttttatgatcagcttgccaccccgctgctcatcacagatgatcgccgcaatgaaaaaaaagctttggaaaacggcacattcgactggtccgactacacacttctcgcagaaacctttaaagagatgcaggaaaagcaattgatcaataaagatatcctgacggcaaaaccgtcgcaattggtcgaattgatggcgcaggaaaaaatcggttttaccctctcagtcacgtcgatcggccctgatacgagggaagtcaatccagatatccagttaggcgtgatgccgacgcctgccgtttatgaaggcgacaaaccgagctggattggaggagagcgccataccgttgctgtctggaaagactcagaacacctcgaagaagcaaagcggtttatcgaattcgccgcacagcccaaatacgtgaaaaagatcgccgaagccacctcatttcctcaggcattaaccaacacagaagctgaaaactactattctaagttttatgatcaatatgaagaaatcaaaatcgaaccgtactttgaccgcgtctatctcccgagcggaatgtgggacgtcatgggaacgacgggacaggaactattggccggtacgttaacgccgaagcaggtatcggaaaaaatgaaacaggaatacagcagattacaagaacaatagaaaggatcgttatcatcatgataaaaaaagaagggtgaaatgatgagcgaattagctaaagaaaaaagtctgactattgtgaaaagtaaaaggagatatgtgaggaaaaatggatcgctctggtggatgtatcttcccgccttggcgcttgtatccgtctttatgatttatccgtttgcgagcggcattaaaatcacgttcacgaactggaacggtttctcacagtcgtatgactggatcggctttgcccaatataaacggatgctggccgacccggcgacatggcttgtcgtcaaaaacaccctcctgtacggattgggcagtacggttttccagaatgtcatcggtcttctctatgccctcctgctgtttaaaagcatcaaaatgaaagcgctgacaagaacggttgtctatttgcccgtcatcatcagcccgctgatcatggggtatatctggtacttcttcttctcctatgaaggaggcgccttgaacgatttgctgaaactatttggagcaggtcctgtcaacgccttgagcagcccggaaatcaatccgtggatcatcgtatttgtcaattcctatcagtttgtcggtatagcgatggtcatttatttagcaggtctcggaagcgttccgaaagatttttatgaagcggcgcaaatcgacggagcaagcggttttcagcaattttggaagattacgctgccgctgttgatgccttctgtcacgatcaacatggtaatcaatatcatcggcggactgaagctgtttgatgtcattttagcgctgacaggcggcggtccgggaaatgcttcgcaatcgatgtcgacttttatgtacgatctgtattttaagaggcaggatgccggctatgcagccgctcagggggttttcatggcggtgttgatactgctaatcagctttacggctctcatctattttaagcgcaaggaggtcgaagcctagatgaatcgccaagagaaaaagaaacgggcgctgtggactttgctggctgcatggattaccgtttttcacctgattccgttttatattttgctgacgacggcgctgaaagcaaagggagatttcagttcaaaatggaagttcccggacgaaatcagcctcggtaattttgcagaagcatgggataaagcaggtctggccggctcgtttttcaatactgctgtgatcacttttgcttcggcggctctgctcattgtgatcggctctctggcggcatatccgctcgccaggcgcagaacaaagctcaatcaagccgtttacttcctgtttatcggcattatgatcattccgccgctgacatccatggttcctttatacaaaatggtggtggagcttggcatgctgaatacgcttgaaatcgcgatattgaataatacggcggcttatatgcccttgacgatttttttgtatgccggatttatccggtcgacgattccgaaagagcttgaagaggctgcgagaatcgacggggcgagcacggcggggattttcttcagaatcgtctttcctttattaaagccggtgactgcgacgatttgcattattgcctgcgtattcatctggaacgactatcagttttcgatctttttccttcaagacaaaagtgtgcagactttgactgtagcgattgccggcttctttgggcaaaatgcgaacaacctgcacttggtggccgcggcttcgctgatggcgatgctgccgatgacgattctatttttattcctgcaaaagtactttataaaaggattatcagcaggagcgctaaaaggctagcgaaaatttcacggggaaaggaagatatgaatgactaaaattgcttttatcggagctggaagcacaatttttgcgaaaaatgtgctgggggactgtctgatggttccggcggtcaacggatttgaatttgctttgtatgatatcgatccgaagcgcctcaaagaatctaaagatatgcttgagcatttaaaaaaccgctataatgacacggtatcgatccgcgcctatgacgacagaaaggaagctttggcgggagcgaaatacgtgatcaatgccattcaggtcggcggctataaaccgggcacagtcatcgattttgagattccgaaaaaatacggcctcaagcagacgattgccgatacggtcggaatcggcgggatattcagggcgctgcggacgattcccgttttattggatatggcaaaagacatcgaaagcgcggcgcccgacgcctggctcttaaattacacaaacccgatggcttctttaaccggtgcgcttctccgctacacggacgtgaaaacggtcggtctctgccacagcgttcaagtatgcacaaaagatcttttcaaatccctcggcatgaagcatgaacgaatcgaagaaaaaatcgccggcatcaatcatatggcctggcttcttgaagtcaagcaagacggaagagacttgtatccagaaattaaaaagcgggcaaaagaaaaacagaaaacgaaacatggtgacatggtcaggtttgaactgatggataaattcggctactatgtgaccgaatcgtccgaacataacgcggagtaccacccttattttattaaaagccgttatcccgaactgattgaagaactgaatatcccgattgacgaatatttgagaaggtgcgagaagcagattcaaaattgggaaaagatgcgcggcgaaatcgtcggcaatcggcatttaacccacgagcggtcaaacgaatacggctcaagaatcatagaagcgatggaaaccggccagccgtttacattcggcggtaatgtcttgaataaaggattgattacaaatcttccggaaaaagccgtcgtcgaagtgacgtgcgtcgctgagcggaaccggatcactccgtgctacgcgggcgagctgccagaacagctggctgctttaaatcgcaccaatatcaatacacagctgttaacgattgaagcggcaacaacaaaaagaaaagagcacatttaccatgctgcattgcttgatccgcatacggctgcggaattatcgatggatgatatcgtaagcatgtgcgatgaattgatcgaagcacacggcgactggctgccggaatttgaataaaaaaataaagcctgagcgaagggatcagccttcaactctggcttttttcacgcgagggtgtgtatatttttccgatttttgatgaagcaatcggaagaatggaggaagcattgcgatcacgagcaccaccctcaacacttggacagcgacgacgaacgtagagtcggcgtgaagcgtgacagacgttgtcgccatttctgcgattcctcccggagcaaacgccaatatggccgttgtcagcgaaatgcctgccgctttggcggtgacggcggcgcttaaaatcattgcaatgatcagtccgacggagctggcaagtgcgacgatcagcgtttttctgacgccgataaacatatctttgctgatctttgaaccgatcgttgcgccgagacaaatttgcgacagcactgaaaagccgtggggccaccaggcggttgtgctgagtccggtcattgaggcgcccgcgatttgcagaacggccgcgccggtcatgcttccgagcagccatggcgcaggaaaccgcagtgctttcatagctttgcataccccgaatccgcccagcacgatcaacgcagtccatgcgatatgaggcgcttcaaatgccgatgttcccgcggccatcacttggctgccggcagcatgggcgtcgggatgcttcgcatttatgaaaaaaacgaaaaagggaatggtcatgacgacgagaagaacacgtatcatctgcacgagactgacgattgccgtgttcgctccgacttcctgagcgatgcccggcatcgcggaaagcccgccgggagccgttcccacaaagctcgtcagcatatctgtcttgctgaatctccacaagacaaagcccgacagcatggcgaacacgacggaaaggagaagcatgacgccgacaatcagccaattttccttaaagatcgaaatcacagacatgttgattttttggccaagctcaattcccaatagcatttggccgaactgaagccatccatggtggatgccgttttgtctgaccgccgctttcaacggtgacgggcgaaacagcgacagacaagcggcggcggtcattgttccgaccatccagccgattgtcatgccggtcaatgagagaagaaatcccccaaaactgctgatcaatatcaataatatatcccgaaggaaatctcttttttccctcaaatgaaaaaccttcttcctgtttactgcggaatcattttgttcactaagtaaagtatttctatatattactatataataattttagtgattggtaaaatacgaatttatttaaaagattaataagaaaaactaatcgtttatttttgaacataacagatcgaatatatgaatacattaaattagattgatcataaatagaggtgaaccgatatgaaacatcccaaggaatcattcaccaaagtcaaatcgtatcgcccgtttcacagcgcctttgatccgtgtccgccgatcggcaaaagatactacagaacccctccaaatctatatctaggttttcagccccgcggccttccgcagttttccccgatggaggcgctgcaaaaagggacgctttggcccgtattttacgatcattatgaaaatccgtatgaagatgggaggtaaggagggtgacgaactctttaccgcaagactattataaaaggcttcatgaaattcaggctgttgattttgtcatcgttgagctgatgctataccttgacacacatcccgatgataccgatgccatcaaacaatacaaccagtatgccggattttccagaaaactgaaagcgaagtttgaatcaaaatacggccctttgattcaaggaagcccggatcagacggaatcctattggagctggaaaagaagtccttggccatggcaagtttaatagaggaagggagtcaggttcatgtggctttatgagaaaaaactgcagtatcctgttagggtgagagaatgcaatccgagacttgccaaatttttgattgagcaatacggcggagcggacggcgaattggctgcggcgcttcgctatttgaaccagcgctacagcatacccgataaagtcgtcggactgctgacggacatcggtacggaagagtttgctcaccttgaaatgattgccacgatggtatataaattaacaaaagacgcgacgcccgagcagatgaaggaagccgggctcggcgatcattacgcagaccatgacaaagccctgttttatcataacgctgccggcgttccgttcaccgctacatacatccaggcaaaaggcgatccgattgccgatttatatgaagatatagcggctgaagaaaaagcgagggctacgtatcaatggctgattgacatgtcggatgatccggatttaaatgacgggctggcgtttttacgggaaagggaaatcgttcattcacagcgcttccgcgaagctgtcgaaattttgaaggaagagcgcgaccgtaaaaaagtgttttaaacagcaaaaagccgaaaatacgaccgtattttcggctttttatttactgcaccgggctcgcaagcagttctgctgcgcggtcgcgcagcacatatttttgaacttttccggatgcggtcagcgggtattcgtcgatcagaaatacgtactccggaattttataatacgaaagctgtcctttgcaaaaatctctgacgtcttcgagcgtcagctttttgcccggcctgcatttaataaaggcagccgttttttccccgtacttttcatccggaacgccgacaacctgtacatcgacaatatcctcatgttcataaaggaattcctctatttcacgcgggtaaatgttttccccgccgcggacgatcatatcttttaagcgcccggtaatcctcacgtatccgtcccggtccatttctgccaaatctccggtatggagccagccgtcttcatcgatggccttttttgtggcttcatccattttatagtagcctttcatgacgaggtatcctcttgtgcacagttcgccctgctcatccgggccgagcgtttccccggtgtcaggatcgacgattttcatttctacatgcggatgcacttttccgacggtctcgacgcggcgttcgatcgtgtcggtgacggttgtctgcgtaatcacgggtgaagactccgtctgtccgtatgcgattgtgatatccgtcatattcatttgcttcatcacttttttcatgacttctctagggcacggggagcctgccatgatcccggtccgcagagaagagaggtcatagtttgcgaaatcggggtgggtgagctcggcgataaacattgtcggtacaccctgcagccctgtacatctttctttttcgaccgtttgcaggacgatgtccggcttgaattcgatgattggcagcatggccgcgcctgacgcgacgcaggcaagcgtgcttaacacacagccgaagcaatgaaaaagaggaaccgggatgcacagcctgtcttcgctcgtcagccccattctgtcggcaacgatcgccgcattgttgacgatattgtagtgagtcagcataacaccttttggaaagccggtcgttcccgacgtatactgcatattaatcacatcatcgtgtgtgagtgactgctctcgttcaaaaaggtcggcatcagagaccgtttcgcccattttagcgatctcggcaaaagccgtcatatgttcaggggtctcgttcttgccaaggtagacgagatttttcagcttcggcagcttttcaggatttttcatgatctcatcgatcatattgatataggatgttcctttgtagccgtccatcagaaagagggtggtggaatcggaatgttccaataagtactcgagttctctcgcctgatagctcgtattgacggtgacgagcacagcgccgattcttgccgtagcaaactggagcagaatccattccggaatattggatgcccagatggcgacatgctcccctttttgaatgccgagcgcgagcagcccttttgcaattttagaagtttcttcaacaagctcctgatacgagtatcttaaatcgagctcagaatatacaaccgcttcatgattcggaaaccggccggcggttgattttaaaagcccgccgatcgtttgtttttttaatgtaaccatagtgcctccttgcctcccgaataaaatctgtttccattatagcactttgttctagtaccaggtactataaaggactagtttttttaaccgggacactgctcgatattgtgcaatccccccgagagccatgatccctgcaatggcaagaaaaagcgctgccccgccgaacttgatgaagatcatcccgcctaaaaaaggtccaattgtccgggaaatatcccaatgcgggccgaaaaatgcaaaatatccgccccgtatatgattgggagcaaggcgcgagacaaaggtttgcatgtgattcagaagcatgctttctgccgccgtaaataaaaccgcagtcgaaagcagccaaaagatcgatgaagaaaaagcgaaaccaatcgctgccacagcgtagcatacgtatgatatggaaacgatcgttttgatgttcagtccttccgtccatttgacgagcggaatttgcatcgtaatgctaagaagggcgcggcacactgtataaacagtcaaggtgaataggaaatcgtcaaaaagagtttcgagataaaggcggtagttggactccagctgagcatagaacaggctgacgggaaccgacaagaacatcaagggcagaacaggacggtgttgaagtaataccttttttgcggaaagaagattttccctctcgaaaagctcctattgcttttttgactgccagttccgctctatcaaaacaatatacgcgtcaaagcgggggtagctattcaaggcattgtgctgaatgaagaagggtggattctttttacggcgtctggtacaaaaaagaggctctactttaagagcccctccattgtgtctcttaatgaccggaatgtcctccatccgcagacttaatttccaatatgccatcaagaatgccttgtgtccgaaatgaaatctcattttctgacccgagaatgaatgcatggttgtatgggccgtcttgcggcctgtcatgaaatgaaggctcgatctcggacagatagctgtatagtgtgctgtctgcctgtccatttttgagtaaaagcaggggagcgtgttttcccaaatgggaaaatggcgctccggcaagcgcaagctcgggcgcagcggttgatgcaaaggatagtccgtgtcccggatctgtgatgccccagccaaagccggtgttcttatccctgaatttcgcaaatgcaatcgaatttgcgacaggagtgtctccggaaattcttttgactgttccgtattcctttaatgcattctccgttttttccgaaaccgcttttttagggccgagaatatagatgtttgctttggcgtcccttttctttaatgcttcagccgtctcttcgggaatgccttttttgttcacgtacaggatcggctcaggcatgtgggcgatccagtttacagccgggagcgaataaagttctgcatcatcctcggatgatccgatgatgacgcttttcggatattcaccggctgcctccgcgtattctttgtcaatctcttttgccagatcagccgcgttcttccctttgagctcttttattttaaaagtgttcaaagcttgaagcgcttttgaatcaaattctccgacagccatgatttgcgtcccgtctgaagtgcccgtcgggttcaagcgtttgatttcattctgaatttgcccggagattttccctttttccgcgattaaaacaggcccgttatttggatgatggatcaaatctgctgatgcaagagctgtctgccatgatccgcccgaaactagaatcactgcgcccggcctgttttgtttatgagtggccggccatatcgtttgagaggttttgatgctcatgtcttctggtgtattcgcgtcaagccttgtcgagttctttgtgtttttcaccaggagcccctcttcggcccgcttattgaaatcactcggaagagaatcagcgtctttttctttcatctccgaatgatcctttgtatgatgctcctcatgtccgccagtgtttcccgagccggaattttggcatgccgcaagcggaagcgcgaaaacaagcatgacaaaaagtaaaccgaatctcaatttcattgtgttttccccctttttggttcagattactgagtagtatacccgggaaatgtgcaaaactggtgcagacatctcgacattgttacacatcggaaggcagcgtgatgataaattcgcttcctttcggggttctgtttttcgctgcaatctgaccgccatgaagctcgacgatttctttcacgatggccagacccagcccggtaccgccggtttgtctggacctcgatttatcgatccggtaaaagcgctcaaatatataatcccgttcttcttccggaatgccgcagccttcatccgctaccgtaatcttgacctggtcctccaattttgatgcggtgacggccgctgttgattcaggatcggagtattggcgggcgttgttcagcaaatttgagatcacttgtgaaaagcggacctcgtcgactgtgacataaagatccgtcgggatgtcgaacgaaacgctgattcgcttttccgaaaaagcgaccgccgctttctgaatttcttttttcacgaatgtgtaaaggtgaacctgtttcttattgatttgaaatccgggctgtttcagttttgtcagcaaaaataaatcgtcaacaagggtgtttaaattgtccgcttcctctttgatgatcgacaagtactgatttctggcttgcggttcgagcttatctctcatcgcgacatctgtgtagccttttatatatgtgatcggagtccgcagctcatgggcgacgcttgacagaaaatcgtttcgctctttttgaagcctgctgagatttgaggaaaggctttcgattgatgcggcgagctctccgagttcatcattccttttgatatcaagcggaatcgaagcttgaccgtttttgatgctttcggttgcctccttcagtttaataatcggcttcgctaaaacacggctgaaccaaagaatagctgcgaccgttaagacgccggttaagccgaagctgaggaaaaaccgcttcgtaatgcttgccaccaaggcttttatcgaggaggtctccaaatacatgaagacgtagccggccgtttcccgtccgttcatgatcggactgatcgtacaaatgtactttgatgtattccaatgggaagataaagcggtcccgttcctcgggatgttctgttcttcgaaatgaaggtgttccgtcatgtctcccggggcagactgcgccaatacgcgtctgttttggtccgtgatgatcacgtttgtccgggcttcagtctccatcagggtgacgtggtctatcgtccttttgtcaaaatgcttttcgaggacgtctctgtggctgttgcctcttagttgaagcgcgcttatttcttcgtttattctcgtgttgacaatcgttgtatacagcgcggcaaaaaggacggcttcgatgaaaaggattaaaacgaaaaatgaacctgcgagctcaaatgaaatctttttcatgctccggttcctttgcttgtccatttgtagccgacgccgtagacggtccggagatggtcttcaaccggaaagcccgcttttttcaatcggtgccgcaaatttctcatgtgcgaatcgatggtgcggggctcgatatcagagttgaatccccagatgttctcaatcaattggtctctcgaaagcacttgatccatatggtctaagagtgttccaagcagatcgaattcacttggcgtaatgctgatttcacggtgattgacatgcagggtatgatgctgtttattccagattaaaccgcggaacctgatttcatgaaatcggcgggttctgcgcaggacggcttctattttggcaagcagcactttttcgctgaacggctttgttaaataatcgtctgcaccgcagttcaggcctcgtacaatatcatcctgcccgttttttgccgtcagcatgataaccggaatgcttgtcaatcttcggatctctttgcaaaccgtccatccgtccatttcaggcatcatgatatcgaggatgacaagatcgaaattgcgcatttttattaagtccagggcttcttttccggtggcggcttttgtgcacgaataatgctctaaataaagctccagcagatcgagcatccggttttcatcatcgacaagcagcacgttcaatgtctagcacctctttagtcaaaatataagtccgctattttaaaaatataccctataagggtatattgatcaaggcggaacgaactgaatcacctctttgacaagaagtataaaaaccagactgcatggttttgttcgtcagctgccgcccgcttgaacgcatcccgtatcgcccggtctttgacatagtctgcgatgtccaaataaaaatcaaccgtttcctgctcgtcttttaatgcggactccagcgcgttccaatactgttccggacaaggctccgtaatggaaatgtcaggctttcggccggcaagagacgtataaaatgccaggaacgcattaaagtggcggatttcgtcctgtctgatttctaaaatttgctgttttgcctcagcatccggggccttttgtgcgattttttggtagcagacgaccgcactgtgctctccgtttaccgctttttctagatctttgatcagcctgttgttttgcctggcgggataggcgggatgatacggctgaacataccacatgtttttcacctcaatatcttatattttgccgtcctgtcattatatgtaagtcgaagcttgcatgtgcctactggaagggcgcatctcggacatgtggcaaaatggtgtggggagagcgcaatctattttaaaaaaatgaagtttgacgtaaaatggttgttagtgccgaatggtgacatacatatcaaaatggagtgagactattgaaaaaggcaatattgacggtcatagctgtattgacgtcggttgttttgttcgccggctgccaagcggaaaaagggggatcagccaaggggcagtctgaaaaagttcaaattacggtttccgcggctgcgagtctcaaggatgttttaacagaactttcctccgtctatgagaaagaccatccgaatgtctctataaagtttaattttggttcatcgggtgcattgcagcagcagatcgaacagggcgctccggctgatttgtttttttctgccgctgaagacaaatttaatagagtagttgatcaagggttaattgacaaaaaagactctgtcaagctggtcgaaaacagtctggtgctgatcgtgccgaaaggaaaaagtcagcatgtcaacagcttcaaggatttggcggatgacaaagtcgaaaaaattgcgatcggcaaacctgaatcagtgccagccggaaaatacgcaaaagaaacgttgacgaaccttgacgtatggtctaaagtgcaatctaaagtcgtctacagcaaagatgtaaggcaggtcctttcttatatcgaaacaggcaacgcggatgccggaatcgtttaccggacggacgccctttcatcagatcaggtcgagaccgtagagacggcgaaaagcgatctgcatacaccgattgtctatccgctcggaattgtgaaaaatacaaagcacagggaacagtctgaggaattttatcaattcctgcaaagcgaccaagccgtcaaggcgatggaaaagtacggatttaagaagggctgaccgccgttatgcttgaggagttcttatccccaattgaaatttccatccaagtatcagccgcagcgggcatcatcgccgttttgcttggaactgctgcagcgaggctcctggcgaacagaaactttaaaggcaagtccattatcgagacggtgatgatgctgccgctcgttctgccgccgaccgttgtcggattttttttaattgtgatcttcggaaggcagagcgtgatcggacgcttgattgaaaacgtgtttcaagcgccggttatttttacctggtgggcagctgtgatcgccgcggcggttgtcgcgttcccgttaatgtatcagtctgcaaaatccggatttctggctgtcgaccgcgacatcgaggatgcagcgagggttgacggagcaaacgaatggagggtgttcctctttgtcaccgttccccttgcatccaatggaatcatgacggggattgtgctcagctttgcgagggcgcttggcgagtttggcgcaacgctgatgtttgcgggcattatcccgggggtgacgcagacggtgccgacggcgatatacttggcgatcgattcgggcaatatgacgctggcatggatgtgggtcgcctctatcgcgatcatctcgtttttgatgctgttttttgtgcagttcaagcaaaaatagccgtatggggtgcaagtgctcatacggttttttcccagttttggagaatggttattttgcggatgtttcgatagaataaagagtaagaaacagaaaggagacgggcttagtgggagcagtatttttatcaggcagatccgggagtgggaaaacgacctttatcctgaatgaaatcagagaaaaacttcgcgatgaaccgctcggaaaaccgatcatttttctagtcccggatcaaatgacgtttttaatggaatacgagcttagcaaaacaccagatttgggcggcaccatccgcgcccaagtgtacagtttttcacggcttgcctggcgagtgctccaacacaccggaggcatgaaccggccgttcttgacgggaacgggcattcagatgctgctgcggagactgattgaagagcataagggcgagtttaaagtctatcaaaacgcaagcgataaaagcggatttacggagcaggtggaacggatgctgaccgaatttaaacggcactgtctgccgcctcaaagcatccgggatatgatggaagggacaggcaagtcggaatacgaagatgaacggattctttccgataaattgcacgacttatatattttgtacagcaagcttgaggaaaatctggagaatcaatatgttcaatctgaagattatttgacccttttagccgaacagattccgtatgcggaagagattagaaacgctgccgtttacgttgacggatttcaccaattcacgcctcaggagatgagcgtactagaacagctgatggtacatgccgaagagatcacgttttcgctgacggcggataagccgtttacggcaaacagcccgaatgatctccatctgttcaggatgaccgggaaggcgtactatgacctttaccaaaaggcgaaggaactcggccttgatccgtctgaagtgcggctggaagaaacgaaacggcaccggcatcatccggagcttcagcatcttgaacgctattttgatgaacgtcctgcaaaaccgtatcccggacagacggaatcgctccgcatcatgcaggcgtcgaacagaagaaccgagattgaaggaattgcgcgcgagattcattctttaatccgccagggccggttccggcttagggatattgctgtcatcgcccgcaatgttgaagattataaagatacgataaaagaagtttttaaagactgcgaacttccttttttcatagacggcaaggaatcgatgcaaaatcatccgcttattgagctgatccgttcgacgcttgatatcattaaaggaaattggcggtatgaagccgtgttccgctgtgtcaaaacggagcttttattcccggaaggacagccgaaggaacggctgcgcgaacagattgaccagcttgaaaactactgtattgcttatggcattaaaggagacagatggacaagcaaagatccgtttgtttacagaagatacgcttcactggatgaggattttgccaagacagacaaagagattgaaacggaaaatatgctcaatgaactaaagggctggatcgttccgccgattcacaggctgcagaagcgcttgaaaaaagctgaaacagtaagggaaatggccgaagccgtctacctttatcttgaagaagccgatgttccgatgaagcttgaacaggaaaggcggctagccgaagaaggcggaaggattgccgagtcgcgccagcatgagcaagtatgggatgccgttattcaactgttggacgagtttgttgaaatgatgggcacagagcggatttcgtttgcgttatttcagcaaatgatcgaaaccggattggagtctttgaaattcgcgctgattccgcccgcacttgatcaagtgtttatcggcaatatggacctttcaaggatgtacggcacgaaatgtacatttctcatcggtgtaaacgacggcatacttccggcgaggcctgcggatgacggcgtgctttcagacgaggacagggagtggctgaaacgaaacggcgcacagctggcggcaacagggcgagagcagctattggacgagaattttctgatctatatgacgctttcaagcccgtctgaaaagctttatgtctcctatccgatcgctgattcggaagggaagacgctgcttccttcaacagtggtgaaacggctgaatgaactgttcccggacagcgaagaaaagatgctgattcatgaacccgagcagctggacgatgaagcccagcttgaatttctcgtgaataaaggcatcgccttgagccatttggcagggcagctcggcatctggacgaggcagtatgcgatcagcgatgtatggtggagtacatacaactttttaatgaatgagcctgaccgcatcttttctcaaaacatcctgtccagcctgtttttcagaaacaaggtcgaaaacctaaaccggcatgtgagccgcgatttatacggggagcacattcagggaagcgtgtcgcggatggagacgttcaaggcctgtccgttttcccattttgcttcgcacggcttaaagctgaaggaacgccaatttttcaagcttgaagctccggatatcggtcagctgttccactctgcgctgaagctgatttcagaccggcttcacgagcttaaactggattggcgcgacttaacgaaagcccagtgcgagactttgtcaagcgatgcagttgaacggcttgcgcctaaactgcaaaaggagattctgctcagttcgaaccgtcatcattatgtgaagcagaagctgcaaaaaatcattgccagggtatcgggcattttaagtgagcatgcaaaagcaagcggctttgcccccgtcggcatagagctcggattcggagggaaaggtccgcttcctccaatgcgtttcaccttgaagaacggttgcacgatggagcttgtcggccggatcgacagagtggataaagcggagagctcaaaagggttgctgcttaggattgttgattataaatcaagcgataaaggcctcgatttggccgaggtgtattacgggcttgccctgcaaatgctgacatatctcgatttgtcgatcacgcattcaaccgattggctcggcatgaaagcatccccggcaggcgtgctctattttcatgtgcacgatccaatgatccaggcttcagtgccgctcggccttgatgaaatagaaaaagagattttcaaaaagttcaagatgaaagggctgctcctgggagaccaggaagcggtcaagctgatggacaccaccctggaacaaggcaggtcgaatattatcagcgccggtttgaaaaaagacggctcgctccgttcggattctgacgttgttgcagaagaggattttcatgtattgaggcgtcatatccgccggacatttcagcaggccggcgaggagatcacagacggcaaagtgtcgatcgagccttacaagctaaaagaccggacaccgtgcacatattgttcataccggtcattctgccagtttgacgaatcgcttgaggaaaacgaataccgaatattaaaacctgaaaaagacagcgtgatattggagcggctgaaaaaggaggatgaggcagatggagatttctaaaccgaagggcagcacctggactgatgaccaatggaaggcgattgtctcatccggccgggacattttagttgcggcagcggccggttccggaaaaacggccgtgctggttgaacggatcattcggaaaataacggatcaggaacgaccggtagatgtcgacaggctgctcgtcgtcacctttacaaatgcatctgcggctgaaatgaagcacaggatcggcgaagcgctcgaaaaagagcttgccgaaaatccgggatcgcttcatttgcgccgacagcttgctttattaaacaaagcgagcatatcaacattgcattcattctgtcttcaagtcatccgcaaatattactatttgatcgatgtcgatccggctttccggatcgccgatcagacggaaggcgagctgctcggcgatgaggtgctggatgaactgtttgaagaagaatacaaaaaaggcaatcctgccttttttgaacttgtagacagatatacgacagaccgtcatgacctcgacctgcagcatcttgtcaagcgggtctacgaattttcccgttcgcatcccgatccggagggctggcttcactcattggctgaactgtatgacgcggcttcggatacgaaggttgaggctctgccgttttattcttacattaaagaagacatcgcactcgttctggaaggtatgcggcaaaagctgacgcgcgcgcttgatttgacgaagcagcccggggggcctgctccgcgcgccgaaaattttctcgatgatttagcgcagatcgacaggctgattcagcagcaggatgatttttcggccctgcatgagcttgtaccgaccgtttcgtttcaacgattgaagccatgcaaaggtgatgagtacgatcccagattggttgatgaggcggcagacctccgcaacagtgcgaaaaagcagcttgaaaagctgaaaagcgattatttttcgcgaactccggagcagcaccttgagagcctgagggaaatgaagcctgtcattcagacgcttgtccagctcgtgctggagtatggcaggcggtttgcggaagcgaaaaaggaaaaggcgatcgtcgatttttcagaccttgaacacgactgccttgcgattttatccgtgaaaaatccggcgggcgaggccgtgccgagcgaagcggcgaagttttaccgccatcagttccacgaagtgcttgttgatgaataccaggatacgaacctggtccaggaagcgattttaaagctcgtcgccaaagaggagcatgaggggaacctgtttatggtgggcgatgtcaagcagtcgatttaccggttccgcctggctgagccgcttttgttcctctcgaaatataaacgctttacagacgatggctcgggttccggccagaaaatcgatttaaataaaaacttcagaagccgttcagatattttggacagcacgaactttttattcaaacagctcatgggagaaaaagtcggggaagtcgagtatgacgaacaagccgaattgaagctcggcgcctcttatccgccgaacgaagcgacaaaaacggagcttctgctcatcgaaaccccgagcggcgcgccgggtgaagaggctgaagagcttgaggcggtccagcttgaagcaagagcgatggccgggcagatccgcaggctgattacagaaaaatttcaagtatatgatgccaaagcgaaagcgtcgcgaaacatccagtaccgtgatatcgtggtgcttttgcggtcgatgccttgggcgcctcaaattatggacgagtttaaacagcagggaatacccgtatacgcgaacctctcaactggttattttgaggcgacagaagtatcggtcacactgtctttattaaaaatcatcgataatgcctatcaggacatcccgcttgcgtccgttctcagatcgcctgttgtgggtcttgatgagaatgagctttccttgatcagaatcaaagataaaaaagcgccgttttacgaagccatgaaagcgtaccttgctgcagcagacggcgatgagaggctcagcgaaaagcttcgccgctttgacggtctgctcaagaagtggagagcttatgcgaaaaaccactctgtagcagagctgatctgggaaatctaccgggatacgaagtatttggattatgtcggcggaatgccgggcggaaaacagcggcaggccaatttgcgcgcgctttacgacagggcgagatcctatgaagcgacatcattccgcggcttgttccgctttttaagatttattgagcggatgcaggagcggggcgatgacctcggaacggcaagggctctaagcgaacaggaagacgttgttcggctgatgacgatccactcaagcaaagggcttgaatttcctgtcgtatttaccgccggtctcggacggaattttaatatgatggacttgaacaaatcttatctgctggataaagagctcggttttggaacgaagtttatccatccgaagtggcggatcagctatccgacgctgccgcttatcgcgatgaagaaaaaactccgccgcgagcttttatcagaggagctgcgcgtcttgtatgtcgcccttacccgggccaaggaaaagctgtacctggtcgggacggcgaaggataaagaaaagctgcttgccgactggcggacacaagcggccgggtccgagtggctgctcccggattatgaacggtttcaggcaaaatcatatctggatttcatcggacctgctttgatgaggcacagagatatggatgaatccggggcgccgcctgtgattgatgagatccgcgaacatccggcgcgctttcaggtcagctggctgtccgccgcggatctacaagctgaggctgtcgatcaggccggtgaagaaagacacgaccggctcgtccaaattcaaatgggccatgcgattgaaggcgcctttgaatatgagcagcaagtcagagaacgactggcatggtcatatccatacaaggacgccgccaaagtcagaacaaaacaatctgtctcagaaatgaaacggcagaaggaatacgaggatgaatacggcgaccgctcgcttattcgtccatcacaggaggctctcctgtttaaacggccgtcctttatgatggcaaaaggcctgaccgcagccgaacgggggacggcgatgcacaccgtcatgcagcatattccgctgacccgtacgcctgaaaagaatgagctcagccgccttctagacaggcttgttgagaaagagctgttaacagaagaccagcgggcagcgattgaagaagacgacattcttgcattctttgatacggaaatcggacaaaagcttttcggcgcccgccgcgtcgaacgggaggttccctttaacatgacgctgtccgctaaagaggtttatccggatcttgagtcagccgatgaacctgttttgatacagggaattatcgactgcctattcgagacggaggacggtttttaccttctagattacaaaaccgaccggatacacggaaagtaccggaacggcttcgaaggggccgagccgattttaagaaaacgttacgaaacacaaattcagctttacgcacgagccgttgaaacgatgattaaaatgccgctcaaagggcgcgcgctgtacttttttgacggaggacacgtgctcttattttaatatgaagcagcttccccctgacgatttcggggggagctttaatgaaaagagaggtgaggcgcacatgcgaattttacatacagcggactggcatttgggaaaaacgcttgaagggagaagccgactgaaagaacaggaggattttcttgaagagctcgcaaggatcgtaaaagatgaaaagatcgacgctgttatcatggccggagacgcttttgacacagtgaacccgcctgcactggctgaacagcttttttatgaaagcctctcagccttgtctgacaaaggaaaccgtccggtcgtcgtgattgccggcaatcatgacaatccggaccgcctttccgcggcctctccgttaacgacagaccacggcatccacttgatcgggtacccgaggactgcgccggttgacatagaagtcgcttctagtggggagatcttgtcagtcgcggcgctcgcctatccttccgagtccagactgaatgaagtgctgtcggagacatttgatgaaaagctgctgcgcgaccagtatgatgagaaaatcaagcagacctttcagcgtatgtgcagcaaggcgagaaaggacgcggtgcagattgcggcaagccatatctatgtggccggcggcagccagacggattccgagcggccgatcgaagtcggaggcgcatatacggtcgctgcggaaagcctgccggaaaacgccgcatatgtggcgctcgggcatcttcatcgcccgcagacgatcaaaagggcccgcacgcttgccagatattcaggctcaccgcttgcctacagcttttccgaagcgggatacgcaaaatcagtcaccattgtcgaagccgcacccggtcaaacggcatcatgggaagaggtccatttgacgagtggaaaaccgctcgtcaaatggaaggcggaaaaagggatgtcccaagtgtacagctggctggaggaagagcgggataaaaacgcgtggatcgatcttgaaatccatctgacagaccagctgtcgattgaagagattcaccgattgagaaaagcgcgtcaaggcatcatccatatacgtccggtttttgaggaagccgcatcggctgaagagaagtcccggtccagaaacgttccgattgaagaacggtttaaagcgttttatgaaagacaaaccggcggagcggttcccgatgaggaaaccgtcaagctgtttctggaactcgcctcaggatcggaacaggaagagggggatgaaacatgaagccgatttctctgtctattaagggcctgcacagtttcaggcaggagcaggtgatcgattttgagcgcctgtgcgatgccggtgtattcggcatcttcgggccgaccggaagcggcaagtcgtcgattcttgatgcgatgactcttgctttgtacgggaaagtggagcgggccgccaataatacgcacggcattttgaaccatgccgaagatgagcttgccgtatcgtttacgtttaagctgcagacaggccatgagacggcttataaagtggaacgggtctttaagcggacagacgccgtcaaggtcaaaacgtcgatatgccgctttattgaaatgaaagaggaacaaatcgtcctggccgataaagcgaatgaagtaaaccgaaaaatcgaagagctgctgggcttgacgatcgacgattttacaagggcagtcgtcctgccgcaaggaaaattcgccgaatttctttccttgaaaggagcggagcgaaggcagatgcttcagcgcctgttcaaccttgaacaatacggggacaggctcgtcaaaaaactaaagaaacaggcgcaaacagctcagtccagaaaaaacgagatgcttgccgagcaggctggattgggcgatgcgggggaagaggcgctgaagctggcggaacagcatctcgaagaagccgaaacccttttgcaaagcaagaggcgcgaacgagatgcggaagcgcagcgctttgcggagtaccaggaaatttggaatctgcagcaagaaaaagaaagctatctaaaaaaagaggcggagcttttaaagaaaaaggaacagatccgggaaaaagaaagccgcctgcatctcgctgaaacggcaaatacgctcaagccttatgcagacgcctttctggcagcgcgggaagatgccgagcgcgcacttcgggaagaaaaacaagcgcgggaacaattagaacaatacgaagagcttcataaaaaaacagagtgcgagtacgagaatttcaggcgtcataaaaatgaaaaagaaccggagcttctcaagcaagaagaacagctcaccgctttgaaggaaattgaaaacaagcggcttgccgcacaggcagaagctgagaaaaagcagcgggaacagcgcttgaaagaagaggaaatcaagcatgcggcagacgaactggccaaggtgaaaagcctgcttgaacgcgggacagccaagcaaaatcagctgaaagcggagctgaaatctgtccaggtatccagcgaagagcgcaaaaactgccggaaggccaatcagcttgcttttcacattcagcagcttaacagcgatgccgctttagaaaaaaaacggctcgatcagcaggaggcgctgatcaaagagctccggcaagaacagcaagcggtggatcagaaggtgaaggatgaaaccgaacgcatccaggcattgtttgccgctgtcgaacgagcgtatgcgctcgtttgcgaaacggacagatcgctctctgagaccgtccgtctcgcgactcaaaagaaagaagagattgtcgcaaaacggaaacaggcaaaccgtgatcagctggcaatcgaactggcaaagcagctcaaagagggtgagccttgtccggtctgcgggtctgtacatcatgaaatgcccgcgggtgtcggtacggaaagcccgtcctttaaagagacggaatccgaactggagaaaacggaagccatcatcgcagaagccggcgcgctggctcaggagtttctctcagccaaagtggcgctcgaacagcagtccggccacctgatgagcgaatgcccgtttttagtcaaaagcaaacacgaactgcctgaaactgctgcatcgctagaagaaggcaccattcccgaacggttcagccgcatcagctttgaatggaaaggaatcagacaggatctcgccgagacaaaaagccggatgtcaaagctccttcacacatataaagagctctgcaaaaaacgcgaccaaatcagcgaacgcctcagccatgaagaaaaagagcaaaacaggcttcaaaaccgcgtccgcgaattgaatgacgagttaaatgaacgccaaaaaagcttcggcgaacaattcggcggcctctcttatgaacaggctgaaaaatggcaaaaaacgattgaagaaaaagatctggccgcagaggaattcgaaaagcgaatcgaaacgagcgtcgaatttctcacggaacatgaacagcaaaaagagaagctcaccgagcgcttgtttgcgcttgataaagaaaagcttgaccttcattatgcggtcgaaagcctcaaaaaagacataaacgattatcaaaaagagctgacgggctatcccgatacagctgcgatcgacgaaaagcttcaagacgtgaaaacgcagttggccaagctgcatgagcaggaacagacgctttacggacggctcaaggagaccgaatccgaagtcagccgtttaagaggacagactaaagggtgtgagctcgctttgcgcgaagcggaagcaaggcttgcgaaagcggcggacatctggcaggaaaaagccggaggcacaccgttcgaaaaggcctctgaagtgaaagcgagcattttggaccgcgatgagctttcccggctgaaagaagacattcaactgtattgggatcacacaaagcagtgcgagtccaatatcaagcgaattacggaaaagcttgacggcagatctgtttctgaagagaattgggaaaaagccgcagtcacgaaggaccaggcggaggaggcattcagcaaagctctagaggaaaggggagcggccggcaaagctctcgccgtcatccgcgagaaccataaaaggtttaaggagcttgaaacatcgttggctgaatggcagacatacatcgaccgccttgataagctccaagccgtctttaaaggaaacagctttgttgaatacttggcagaagagcagcttgaaagcgtcacaagagacgcatctgcaagactcggagaactgacaaggcagcggtatgcaattgaagtcgactcagaaggcggctttgtgatgagggacgatgccaacggcggagtcaagcgccctgttacgagtctgtcaggcggggagacatttctgacttcgcttgcgctggcgcttgcactctcggcgcagattcagcttcgcggagagtatccgctccaattcttctttttggacgaaggatttggcacgctggatcaggatttgctggatacggtcgtgactgcgttggagaagcttcagtctgacaatctgtcggtcggtgtgatcagccatgttcaggaacttcgggcaaggctgccgaaaaagctgattgtgcatccggctgaaccaagcggcaaaggtacagccgtatcgcttgaaatgatttaatcttataaccaaaaagcagcctgcttctaaggaagaggctgctttatgcatttccgacaacattctggtcgcttacatccgggtctatataatttgtcgcgtttataccattattgacgataaggaaatctccagtgttaccagcaccagaaccgagcgcagactttgaagtgctttttggagatagataaaaagaatcgccgaaattcactactcctcctgagatttcattgattttaatgggtccgacaatggctggcatgattgatcgacatcctttgtagaagtctctgaaccagtatatgtcggccgggctgctattgtgagttccttgcgggaggaagctttctgatatgtttgactctcgagtcggcattgatgcggcgcgttgagccgacctgagcaacggaggatgatgatacaccgttgattttaatcgcccttacacggatgaaggggatctcatggaaaaaagccgagcatacgccggtttctgggagaagttgcgggatcggctgcctgaaaagctgaaaatcatcctgtttaaatgacccttcatttccgtaaaaaagagaaaggtatctttgaacggcgagaacttttgacttgagaaactgctcttccgtgtctccgatttgcagcgtgctgcttattccgacagagtgtacttttaaaaacttcactttggacgttctgagaatcatgattccggcgccagcgggacaaacggcccgacaatgagagattcaggcggtgtatcaaaaatcgatgacagagaaatgcaatccgtatcaccgaccagaaaaacagaagaagtggacacaccggtgatcacaatattgcctacatcaaaacagcggttcacaacggtaaaattcattcgttttcatttcctttcatttcgtcaggtattgatttgagaaagtgctcgattgcccgtgcgatatctcgtttgacatagtcggccagccgttctgcatgctcgcggggctggatgtttccgtcaggctttacatgtttgacgtagtagcggatacggctgtcgatttgctttctgatgtcttcgataatgtggtggcggtttgtatcgtccagtttgctgtcataccggtcttcaagctgttccagcaaacgaggggtctcttcgtttaaataggcatcgacaagctgtctcgtttgctgcatcagctggctgtcaagctcctgctgaagcattccgatacccggcggctgttggctgatttcaaagttttcgacattatccgggtccgcaggattgagtccgatatttagcgttccgtccaagcgttcaatttttagttgatcaaatttgtattcgatccggtcgatccgggtgccgggattttctttcagctggttcaactccgaatgcaatacggcaatctgactttcgagcctctggatttgcgcagcctgctgctgcaaatacacataccagttctgtggattgctttgtttcatgagattacacccccgtatatctatggtactgtaacagaaggagcgtgaagaggaacgagagtcggttgagtcccatctccaaaagcgtcgtcaaagacttcgccggttaccggaggtgcgggttctgtgtagcttccggtattgtacaggttggcaagtgttttgattgaaccggcgcttccaatctgcaatacggaagagttgctgattccttcaactcttaaataattgatttgtattgtttgattgatataaaagttcatgccttcactccctacaggttgcctgcgaccggctgatcgattacatcgttgtcatatgtgttggtgatgctgttctggttgtatactctgagtccgtctccggtattgaagctgccggcacccgcaaatgttttaacttctgcataaggagaaatcgtgatgcagtctccgacatgaacaacgccgctcgtaccgacggcatttactttaaaagctccgacaatagctggcatgatggcacaccctttaattgatcaaacatttttttatgggctatacaccatatcctatgttgattaggcgcttttgtgattaaaaatgaggttcttccgtgagtgcagatcacatactggtgaaactaataagatgagaaaacgtatgaagaaggaaaacgtgcgataaggggagagacgtatgtattttcaattgaatccgatatcaatcgctgcagccctgctgttctttgcggccgcatatgcagtcggaataaaaaagcaaacctggatattgcgggggtttcgccgggaaagggtaagggatcaggttaagctggcgaaaatcgctgggtatttctttttgaacagcggatttttgttatttttaaatggggttgtttacatcccgtatcaagagtcttttacaccttcagccattcttgcctacggtatttgcacgatgatttatgttcaaaaaacaatggccgaatagcccaagctgcgacccgaaatcaacggatgatgaaatggaggaggaaggaggccggcatcaggcgcagcttgcagtcggaggtcatgacgtgtggcggccttttctttcttccgcatgcacgcagttatcatccttttgcattctttgattcagcaagttgtccaattcctgactgcatcgaatggcctctttggagttgatgccgaacttttcggcagcttcaaataaggccagtctttttgcttcaattttattgttcatcatggcagtctccaactttcgatttgtattttgagtcggtaatttcaggtattcagcgcattgatgtccttgatattgctagtataccttattttgtgtaaaagggatttttttcgccaatatgacaaaaaatgtgacatttttttcggaggacagcgacagtctattatcgggaaagctcgaaaagcaggaaccgcttcctctgatcgatgaaatgaaaaatttgtttttgctcatcttcgagccggctgtatgtgacggttgtataaggatcatgttcaagaaaaggcgcgattgtctcgtgccagtttaccgcataccgcgaaagccggctgattgtaaattggcggtgcaagacatttttcattaaattaaagtattgggattgaaaagccgggatgtcgagcagccttgcagacagcgtattatagcctttcgccggaatccggttgtgctccatttcttccccgtgaatattccgtccccatgtcgcgtcataatcccatggaatgatttgaaacgtttttgtgcgaccgtttaaataaagcgcgtaattatggacaaagccgtcgaaattttgggtgcagacggcgccgatgagccacagcaaatattgtttgacatcgagatagcgtttgatttctttttcaaatatgtcgtctttggcggtattgataaagtagataaactcatggaggtagtcatcgtggcggcttgaacccgtttttctttcgtatccctgcatgagattttgcttagcctttttattgaaggaactcagcagagaaaaattagcatcgtcatcaacggcataataaatggcccccctttctaaatttctcctctttaagaaatgatcgtcaacagattcgatttttaaatagatgccttcttttttttcattgatataaaggaaaacgtgtgatgctgctggcgcaaggacgccgatttgttcaaaaaaatgaaaggaaagcctgtttctgatgaaagacggatcatgatattccgcgttcaaatgaaacgcagccttttctttattgtccggatattgaatgaaataggattttttcgtcagtttgcgggtgtgggcccctctgtatgacactgcgacaggcgtctttgctgaaccggtcaagagcatgccgggaacggcttcatcactccagacgtcttttttcaactcaagcagatgcttcggatgaatgtgcagcctaaaggccggcaaggcagtggcactcatcatcatttcctcctttttcagctgacatatcatatgtgaaaaaaacctgtcccggaagcagaccgcctaagtttgaacaaaaacagtcatttgcctcagtacacttgtctttacggcgcgtatgataaatcaggacataaaaaaggaagaacaggaggttacaagatgagtggtgtccatgatcatgacattaaaaaggcagtagaccagctgaagagcgaaggcagagaccattatttagaccgggaacccgaagaatacgccggctctggaaaagagcggcgtccgcataacatttgggatctttgggggggaataaagccggacagaagcaaaaaacatcataaaagcaagaagcatgacgactatgaaaagccggataaaagcaaaaagcccgacaaaagcaagaaacccgatgactgcaaaaagcctgacaaaagcaagaaacccgatgactgcaaaaagcctgacaaaagcaagaaaccagacgactgtaagaagcctgacaaaagcaaaaaacatcacgactgcaaaaaacgcgacaaatgcggccgcaaacgccccgaccatcatcgctgcaagaagactcaccatcataaaagaggcggctatgaaaccattacaaaatggtctgacggaaatctgaccgaggtcatctaccggaaaaaataagaaaagcggcttgctgcatggtgagccgccattttcttttccgggaaggaacgcccgggactttagaagcggttttctgaaagaggaaaggaattttcgtttttttagagaatatgtagaatagctttaaatcatactgcgggggaatatttatgaagtttgcgacagcaaagctgcacagccgtacatttgtagggcttgtcatggatgagaagataatggatttgcaaaaggcggaaaaaaagctgtttgagcttgaaacgatacctgaaacgcttatcgaatgcgtaagcgagggagagaagtttgtccgccatgtcgaacagctagtggaatggtcaaagaagaaaaacagcgaagagagcggttcgtatatttatccgctgtcagacgtcgatttgcttgcaccgattcccgaaccgcggaaaaatgtgatctgcatcggaaaaaattatcgggatcatgcgattgaaatgggaagtgaagcagatattcccgaacatatcatggtgtttacaaaagcgccgacttcggtcatcggccacatggaagggattgatgcccacgaaggcgtgacagaggcgctcgattatgaaggcgagctcgcggttgtcatcggcaaaacgggaaaaaacatcccgaaagctgaagcgctcgactatgtgttcggctatacgatcattaacgatgtgacggcgcgcgatctgcaaaagaggcacaagcagttttttatcggcaaaagccttgatgcgacctgcccgatggggccgtttcttgtacataaatcaatgattgaagaccccggtgacctgaaggtggagacgagagtgaacggcgaactccgccagtcggggagcacaaaggacatgatttttccgattgcggaaatgatcgaaacgctgtccaaaggaatgacgcttgaagcgggggatattatcgcaaccggtacgccgtcaggagtcggcaaaggctttaatccgccgaagttcctccgaaaaggcgatcaggtcgacattacgatcgaaccgatcggaacgctttccaatccagttaaataaaggattgtcaaaaggatggctttagcatataatgaagctgtcaaattttttagaaatgagggatgtgtgatgagaatggatattgtcttttttgcccaacaaacgatcattgcacagcccatgtaatatttcgactggtattcttcaaatggatctggtgatatttccatgggctgtgaaccggctcatggagtgtttatatgttgaaagagccgtgtatttgcggctctttttttaatcaatcatcagatctttaggaggaaaccgaattgaatttatcagcattaggcatcaaatatatcatggaagctttaaaggatgaggaaggtctggttttgggaaggatcgcccttgagcataaaaggttgtaccgggtatggacggaagaaggtcagtggcttgccgaaatctccggcaggctgcggtttgaagtggaaagccgcggagactaccccgctgtcggcgattgggtgtatatgcgcccacgcggcggcgaaaagaagggaatcatcacggaggtcgttccccgattcagcaaattttcgcgcaaagcggcgggtgagccggcggaggaacagatcaccgcagcaaacgtcaatacgatctttctcgtcaatgcgctcggtctggattttaatgtgagaagaatcgaacgctacttgctgctggcatgggaaagcggagccaatcccgtcatcgtcttaagcaaagcggacattgctgaccggattgaagaaaaggtgcgccaggcggagtccgtggcattcggggtgccgattcacgtcatcagcgctcatgaaggcagtgggatggatgagctgaaagcgtatgtgaaacaaggggaaaccgtcgcccttttagggtcgtcaggcgtcggaaaatcaacgatcatcaacttttttctgaaggaagacaggcaagccgtccaatccgttcgtgaagatgatgacaaagggcggcatacgacgacgcacagggagatgtttatgctgcctgaaggcgggcttttaatcgatacgccggggatgcgggccttagagctttgggaatcggaagaaggattcaagcagagtttcagcgatattgaccagcttgcacaaaactgccgattttcagactgcctgcatcaaacagaacccggctgctccgtgcgggaggcgctggctgacgggaggctggatgccggccggttccaaagctacctgaaattaaaaaaagagctcgaatacctcgaaagaaaaacggataaacgggcgatgcagcaggaaaaaaagcggtggaaacagataacgaaaagcatgaaaaagaacaaaaacaaataaatgaaaaaggcgctgataaatggcttcagcgtctttttgctgcggaaatgacagcgttcacattgttttgtttaatggaccggttcatgataagataagaacgatacctgatttgatagggggaaaaatgaatatgacgcatatgcatatcacgtcttgggtgatcgcgctcattttagtgttcgttgcttacgggctttactcatctggaaacagcaaaggcgcaaaaattacacatatgattctccgcttattctatattatcgttatcattaccggggcgcagctttttttaaagttcacggcatggaacggagaatacatagcgaaggccttgctcggcctcatcaccatcggattcatggaaatgcttttaatccgcaggaaaaacggaaaagcggccactgggatctggatcggctttattgtcgttctgctcttgacggttgtgcttggactccggcttccgctgggctttaaagtgttttaattaaatgacatcggttctttatgaggactggtgtcttttttatgtcggcggcttgaatgttgaaatcataacgattcgttccccatctgaagcggtccattcaaatctgtccttccactcctcttttctttcgtaatgatgctgcagggcgcattgtttcatatcatgagaaaactgataaaacgaaacgcccttgacatcctttttctcgggccaaaagctcaggccgttataggcgaagacgcagtcaaagacggaaaagccgaggctgttcagctgatccaaaaaagaatagaactgtccgtcttccagatcgttcaaaaattcgaggaatgcctgttttaccgttttcagataacggatcggttctcctcctgtcagcttcacggtctccggtttttccgttacggcgaattgatcaaacagttcggctttttgccattctccgtctatgctgatgaaaactccggggctgttcaggctttcaaccaaaagcaaatctccttcttcattttcaatcaggcagatcccgtcttccattaaaattttgccgtaaatccatttgcgcttttcggcataaagtcgtttctggcgttcggtgtccatgggcggtctcctttcttatttcgttttttccaaaacgggcttgtctcatacaagactctgttggacaattcaactattattttaaggtgcataaaataggtaaagtgacaaaggaagtgaagcctaaagcagaggaagtacattagaattggagctgatcgacaatgtgtggaataacggggtgggtcgattttaagaagccgcttgtccgagagcagtcaatcatggagaagatgactgatacgctttcgaaaagaggacctgatgatacgaatatttggggaaagcgccatgttttattcggacataaacgcttggcagttgtggatctggaaggcggcagacagccgatgacccgcacacatcaaggatatgattatacgatttgctataatggcgagctctataatacggaggatttgcgaaaagagcttaggcggcgggggcatcaattcaagagccactcagatacagaggttttgcttcattcatacatggaatggaaagaggaatgcatcgacaggctgaacggaatttttgcatttgcggtatgggatgaaaagcgggatcttctttttgcggcacgcgaccggcttggtgttaaaccgttcttttacaccgaacagggctcatcatttttgttcggatctgaaatcaaagccatcctcgctcatcctgaagtgaaagcaaaggtagaccgttcagggctggcagaaattttcggcctcggcccgtcacgatcgccggggagcggtgtttttaaaggagtaaaggagatccgcccggggcatgcgatgattttctcaaaagacggtttaacggtttggcgctactggaatgtgaaaagcgagaagcatacggacagctttgacgaaacggtggaaaatgtgcggtcgctgtttcaggacgccgttacaaggcagcttgtgtctgatgtgccggtatgtacgtttttatctggaggggtcgattcgagcgccattaccgcaacggccgccaagcatttcgagagagaagggaaggcgccccttcatacgttttcgatcgattatgaagacaatgagcaatattttacgtcaagctcatttcagccaaacgccgacggcccgtggattaaaaaaatgtccgatgcattcggaacggttcatcacaattgcgtgatatcccaggaggagctggctgcctatttggaagaagccgtactggttcgggatttgccggggatggctgatgtcgattcttccctgctatggttctgccgcgagattaaaaaagactttgtcgtgagcctttcaggggaatgcgcggacgaaattttcggcggctatccttggttccattcggcagaagatgtgaaaggtttcccatggatgagatcaatggaagaacggatcggacttctgcaggacggctggcagaaaaagctgaacctcagcgaatatgtgaaggcaaaatatgaggaaacagttaaagaaacaccgctgctggaaggagaaacgggtgcggagaaacgaaggagagagctgttttacttaaatatgctctggtttatgacaacgctcttggatcgaaaagacagaatgagcatgggtgcgagcctcgaggtcagggttccgtttgcagatcacaggcttgtcgagtatgtctggaatattccatgggatgtcaaaatgcatggcagccgtgaaaaaggcatcttccgcaaggcgctggaaggcattttgcctgatgaagtgctgtaccgcaaaaaaagcccatatccgaaaacgcaccacccggcctatacgaaagccgtgatacgctggctggagtcattgctggagcaaaaagactcggcgctctatgctttcttagaaaagaaaaaactggagcggctgattgagacggaaggtgcatcatttcaagttccgtggtacggacaattgatgaagggaccgcagctgatcgcccaccttgcccaaatccatacttggtttgaaagttatcgaattgatatcgaggaataacataaaacacccggcatatgccgggtgttctgcgttttggcagctaagctataaagaaacggcggcgtttattttgaacaccgccgatttctatgatcagcaagccggcctgagagccggatgcatgagagtcacacctgttcagttttggaagaaggtccaggctttaaattgttgagccgtgagacaagatccgttccgaaagcggagcttacgtcaacatcgtcctgatcgatgtagctttctttatactcgtacgcggaagaaccgtgttcggcataatctagtccggaaatttcctcctcttttgataccctgatcggagcgagggctttcattgccgcggcgacagcgtatgtggcagcgagggtccaggccgcgatcgacaaaatgccgacggcttgaatgccaagctgtgcggctcctcctccgtaaaagagaccgctcgatgtattgaaaagcccgactgcaagcgtcccccaaacaccgcaaataccgtgaacggcaagggcgccgacgggatcgtcaagcttcagcacctggtcgataaactgaacgccgacaactaaaatgacaccggcgatgaatccgatcaatatcgagcctgtaaatgaaacgccgtccgcgcccgcggtaattccgacaaggccgcctagcgcgccgttcagcgtcagggaaggatcgatcctgccgtagcggaaataagtgaacagcgccgagctgacgactccgcccgatgccgctaaaagggttgtggtgatgacgtgcgggacggcggcgggatcagccgcaagcgtgcttccgccgttgaacccaaaccagccgaaccacaggataaagacgccgagagcgcccagcggaatgctgtgccctggaatggcgttgaccttgccgtttgtatattttccgatccgcggcccgagaaacatgacagccgcaactgcgcccgcagcgcctgtcaagtgaacgattgaagatccggcaaaatcgacaaatccgaggtcgtacagccagccttccccccaagtccaatggccgacaaccggatagatgagaccggtcataaacagcgtcaagatcatgtagctgccaagcttcatccgttcagcgacagcgccggaaataatggtggcgcacgtagcggcaaacacggcctgaaagacgaaaaatccgacatcctgatcacccgctagagcaaaaccgcttgtgccgatgaacccgccggcgctgtccccgaacatgaacgcgtatccggcgaagaaataaaggatggagccgatagagatcgtcaggaagtttttcattaaaatgtttaacgtgtttttagctcttgtaaagcctgattcaaccatcgcaaaaccggcgtgcataaaaaagacgagcagagtgccgatggctacccatgtcatgttgaccgagtcattgaccgattgcaccgtcggttcggcggccagagctgatgctgcgaggaaaaaactgaggaacaggacggcagataccttgttttcataagaatcaccctttcttaaagtatcgactaaaagagagcaggagggaatcggtcgttttagacaatcgcttcctttcctgattcccctgtccggattcggatcgcgttttcaattggaaggacaaagatttttccgtcgccgaccgtatttgtcgaacatgtgctttcgatttgataatttcatcaacgctctccgattcaatcaccatttcgactttcactttaggcagcagcttgatttcgtaggaggtgccgcgaaacagagcctgcttcccccgctgctggccgcagccggcaacctctgagacggttaatccgtttatgccaacctcttcaagctttttgcggaggcgggggaactgttcggggcgtataatcgtttcgatttttttcacaatgcaaatcctccttttggtgtaaggttatattacgtttgttgttatgtttcttatcatacgtaaaagtaaattgaaaatcaatacgaattttcaaaaaaattaatctattagacctattctttgagaggtctgtgttcatagaatggcagtctcgttaagttttataacatgaaaaaacctgctttcaactgaaagcaggttatgctgcaaatcctttttgaagccacattttagatctccatcttctgtacattaaaattcccctgacccattcgtcggcgatgaaggaaaaccaaattcccgccaggccgaatccgagctgaatgccgaaaatgtaagcgatcggaagtccgattccccacatcgagacaatcgccatataaaccggatatttcgcgtctcccgcagctctgagagaattaatgatgaccacgttaaacgagcggccgggctccaagataatcgtcaaaaggatcagtatactggccgttgcgataatatcgggattgctgctgaaaatgccgatcagctgttttgaaaacacagcgaagagaacggaagtaaatgttgtaatggccagagcccaccacaggcttttcaggcagcggctgtatgcttcatcaaattgcttcgcgccgatatggcgtccgattaagatttgcgttccctggctgatcgctgtgccgaaaagcatgataaacatcatcaaattttgggtatagacttttgttgtcagcgcctgcgcgcccatcagcgtgataaaataggtgacaatcatctgtgacgcgttatatgacagctgctcccctgctgaaggaatcccgattttcagcagttttttcaggtgacttttctttaagacaaacagccgtttggacaacagcggcatgccgacgcgctttttgacgagcagagcgatcgccaaaaggccgatgatgcgcgcgattgaagtggacattgccacgccggccacgcctaaaaccggaaagccgaacggtccgaatatgacaagatagttgccggcgatgttcaggatattcatgccgatggttacaaccattgtgtcctttgtatacccgtagcttttcaaaatggcgctgaacgtcataatgagcgcttggacaaaggacagtccgccgacgatctggagaaagatgccggcttcagcaagcaggttggcggaaaggcccatcatcaataaaagcggtttggcaaatatataaatcgccgcactgatgaatagactgatgataaaattggcgctgatggaaacatagccgacttccattgcttcggctttttgccgcgcccctaaaaattgagaaataatgacggttgttcctgttgcgataaaaccgaacatcacaatgatcaagttcagcatttggttgctgacgccgacggctgccacgctgtcgtcggaatattggctgagcatcagggtatctgcgttgcccattaacatatataatgaaacctcgataaagataggccaagtcaatgcgaataaagagaggttttgaggtgctgtttttttcatggcgtttgacccctttcttttaaaattccgttttatagtgtaacgccattttcttataataagaagagacgaaaccgatacttcttggagaaatccgacttgatgaaaaaggggagagaacatggaacatatcatctttacaattccgccgctccctgtgttgattaccggcggagaagggctgttcaaaagaggggaaaagcatgtgaggcgtgaatattccgtgtttgatctcttatatgtgatacagggggaactatttttgactgaggacggcgagccccatcagatccgggaaggggaatacatcatccttattccggggctcgagcattatggccaccgcggctgtcaagacgatacccgctatttttggctgcactttcaggagccgtcctatggcttcgcgcagcagggaggtgagaactggactgaactcaagctgaggaaggggacatttgaaacgccgacattgtatcatttaaagattccgagaaagggaaagatcgaccaaaaagcgtttatcgaacagcagtttaggcgtttgattgacgattccgcccaaaattccgacctgccgcttcgcaggcagctcttgttcgaagagctgctgattcacttgcagaaggaggcgttccatattccttcggcgagtgagcgtgtagcatccgaagcacagcattacatcgaccgccattataaggagaagctcagcatggagcagctctcggctgcccttcattatcaccaggactacattacccgctgcatgcaaaaggtgtttggcatcacaccgggccaatatgccaataaggcgaaagtttttgaagcgaagcggctcctctcttctacaaacgacaaaatgtcatcgattgccgaacaagtcggaatcgatgatccgacctatttctcaaagctgtttaaacaaatagaagggatttcgcccgttgaatacagaaagatgatgaagcgaaatattgagtgatattttcaaagcataggaggagataagtttggcatccatcaatggtgaaaaagtgaaattgcgtacgatcacaatggatgacctgcccggattatggagaatgatttacggaactaaaaaccctgaatggaaaaaatgggatgccccttattttccgcttcagcccgaaccgtttcaatactttatcgattcttttgtgccggctttaaaagaaaaaccgccgcgctatttggcgatagagatcggcggagagctgaaaggaaccgtttcttactattgggaatcccggccgacacgctggctggaatgcgggatcggcatctatgatccgcggttttggaacgggggatacggtacggaagccgtagaattatggatcggcttcctgtttgaaaacgtcgatgtgccgagaatcggaatgacgacgtggtcaggcaacaggcggatgatgaggtgcgccgaaaaagccggatttaagatggaaggccggattcgcaaagtcagatattatgacggagtctattacgattcaatcagatacggaatcctgcgggaggagtgggagctgatttgccgcggaagctgacacgctctataatataatattagaaatctttcatcagcggactagaggggaccaatatgaaaaaaaccatttatgatgtagcggaagcggccggcgtttcgatttccacggtttcccgggtgatcaacaataccgggaggatcagcaggtcgacaaggcaaagagtgcatgccgtcatgaaagagctcgattaccagccgaatgttcacgcttctgcgcttaccggaaagcgcacgaacattatcggcctgttgacgcccgatattgcaaacccgtttttcggcgagcttgccaaaagtgttgaagagcgggcgggcgagctcggcttcagcattatgatgtgcagtaccgaccgcgatccgaaaaaggagacaacgtatttctcggtcctcaagcaaaaaagcgtcgacggcatcatttttgcgacaggcatcgaaaatcaggagacgatggatgcgctcgaggatattgccaaagagggcataccgctcgtgatgatttcccaggatcgcgcccttgttccgatggatgtcgtggtcatcgatgattttatgggcggatatttagcgacgcggcatttaatttcgctcggtcataagacaatcgcctgcatcgccggcgacggatcgacaaccggagaaaaagacaggctgaaaggcttcaaaaaagcgatggatgaagcaggcatcaaagcggatgaaacgctcatcgccggatccggtttttccctggaatgcggcaaaaaagcggccgctcagattttcaaaagcaatattccgaccgccgtttttgccatgaatgatgtgctcgcgtgcggagtcattcagactgcaagggaatgggggctccatgttccaacggatttatcggtcatcggctttgataatacgtttttagccgaaatgaccgatccgccgcttacgacagtgtctcagccgattgaagaaatgggccgccgcgcggccgagctgcttgccgaagaaatcagcggcaagaaaagctcgaaaagcaaaatcattctcacgcctgaacttgtcgtcagacagtcgacggcccctccatttaaaaaagaagcacatgccgaaaagagcgggttttgatagaaaaacgctcttttttcgtttctaaagagcaagcgcttgaccaaattaattcctaaaaaacaattgcggataaaataaatacagggtaaaatcagaattgaaatgagcaagcgctttctctaattaataaagcgctttcatgaaacgcaaaggaggagaagaaaatgacagaagttgtgagatgcgccgtattggggcttggaaggctcggctattaccatgcgaaaaacctcaaaaccgaggtgcccggagtcctgctcgccgctgtagccgatccggcagagggaagtgcgagggaggttgcagctgaactgggtgttgaaaagtggtttgaagacccgtttgagtgcctccgcgatccggaaattgatgccgttgtcatcgttacaccgacatccactcatgccgaaatgatcaaacaggcagccgaattcggcaaacagatttttgtggagaagccgctgacattaaatcttgaagagtcaatagaagtcatttccaaggtcaaagaaatgggcgtgatttgccaggtggggtttatgaggcggtttgatcctgcttatgcggatgccaaaagaaggatcgatgccggagagatcggcaaaccgatctattataaagggtttacgcgcgattttggctctcctccggccgaattcatcaaaaaaagcggcggtattttcgtcgattgttcgattcatgactatgacatcgctcgttatttaatgggggctgaaatcactgcggtttccggccacggaagggttttgaagcacgcattcatgccgggatgccatgacgtcgatcaggcgctcacctatatggagtttgattcgggagcggcgggtgatgcggaagcaagccgcaattcgtcttacggccacgatatccgcgccgaaatcatcggaacggacggcagcatcttcatcgggatgctgcggaacccggcggttacagtgcggaccggaaaggggagcagctataatatcattcccgatttccaggcgaggttccatgaagcgtactgtttggagctgcagcattttgctgattgtgttcgcatcaaaacgaaaccgcttgtgactgaagtggatgcggcggtcaatcttgaaatcgcgcttgcggccacacaatcctggtcaacaggcaggcccgtcaagattcagtatcagacgaaaaagcttacggtatgaaacgggggccaccctgagcgggctgttgagatgatcctgcggtcacaaaggaacaacaggaaggagggcgtaaggaagcgttccccgcccggtgccgcctttctccatgcgttttcaattttgcgggcttcccatggatgccggaggattagacccgtccgtcattccggcggtaaaaaaacggcatggcgccgatttgttgtacacgattccgtcatttcacaatccgacgggcaaactgatgtccgaagaccggaagcgcgagctgattcaaatcagcaagcagctgtcgctcccggttattgaagatgacgcatatggcgatttgcagcttgacggcccgccgtcgtcgccgctgaaggccatggacagagaaggcagcattctttatgtcggcacattatcgaaaaccgtcagtcccggcctccgcatcggctgggtcgcaggtccggagcccgtcatcgagaggctggccgatattaaaatgcagactgactacggatcaagttcattgtcgcaatgggcggctgcaaagtggctttcaagcgggctctatgatgaaaatctcagccggattaaagtcgaactgagacaaaggcgggatgaagcgctccggtgtcttgagacctattgcagaggaatcgcccgctgggaaaagccctcaggcggattttacatttgggtcacattcctaaaaccgctctcgctcagcgctttgttcgaacaagcattacagaaaaacatcctcatcaatcccggcaccctctacgataaggaagccaaatacagcatcagattgtcctattcgtacgcctctttgacagagcttcgctacggcattcaaacaatcgcagaactcgccggtaagctcatgtgaaccccgctgtaccggctgctgaaaaagcgacgttcagcagccgctccgctttttatttcaggcctcaggttatttaaaaacagtccataaaattccattaatatatcattcaaggaactattgattcatattagcagatgaatgtgcagaagtggaaatattcaagttgcctcgttatgagaaacgtcctatttttctgaatcttattgacatgccggtgtcacaaaatatacactttttttgtaattgaaaatgataatctttatcaattggagggatgctttctatgcctgtacaaacgagttctaaaaatcaagtgtttttggagcagcaaaatagaagagaatctaatgcgcgttcatatccgagaagatttccgctcgccatgcagacagcggaaggcgtcttggtgactgatgcggatggaaagcaatattatgactgtctggcaggagcggggacgcttgcgcttggtcataatcatccagttgtgattgaagcgattcaaaaaatgattgaggaaaaacgcccgctgcacacccttgatattacttcggaaatcaaagaggagtttgtcaacgaagtatttgcaagccttcctgaggcgtttgccaaacgggcgaagatacagttttgcggtccgaccggcggcgatgcgatcgaagccgctctcaagcttgtcaaaacggcgactgggaaaagaaccatcctatcgtttcacggcgcctaccatggagcaactcacggaacgatggcgctgagcgggaatttatctcctaaggaaaacgtccagggtctcatgcctgatgtgcatttcctgccatatccgtatgaataccgctgcccgtttggaaaaggaggagaggcgagccacaagctgtcgagcgcatatatcgaaaatatgctggatgatccggaaagcggagttttacagcctgcagggatgatctttgaagccgtacaaggagaaggaggctcagttccggcccgggctgaatggataagagaaatgagaaggattacaaaagaacgcggaatccctctgatcattgacgaggtgcagaccggcatcggcagaaccggcaaaatgtttgcgttcgagcacgccggcattataccggatgtcatcgtcctttcaaaagcgatcggcggaagccttcctctgtctgtcgtcatctatgatcaagaccttgatcagtggggacccggggcgcacatcggcacattcagagggaatcagatggcgatggcggccggaagtgcaactttaaaatatataaaagagcacgatgtgctatcacatgtagaaaaggtcggagcgaagctcatgcgggaattgcaagacattcaggagcacgttcccgaaatcggcgatgtccggggacgagggctgatgatcggcgccgaaattgtcgcaccgcataaaaagcaaaacgcaaacggcagctatccggctgatgcggagcttgcaagcacgattcaaagaaaatgctttgaaaaaggactgatcgttgaaacgggaggccgccacggaagcgtgatccgcttcttgccgccgcttatcgtaacagaggcgcaaatcgacgatatcatcacgatcttcagagaggccgtctatgaagcagtcaagtaaacaaaaaaactttgattccctgtttatgcacaacggggaacaggggatcaaagcataccgtgacgcggtagagaccgctgtagagacgctttgggccgattggaagaataaatcgaagccctacagcgggaagatgccgaaagaattggatctcgaaatcaaaagcttgttttcgtttcaggaagcgggagaatcgcttgcggatgttcttgagcatctgaaagaagcctatttgccgcaccggattcatgttgaagatccaaaatgcgccgcacacctgcactgtccgccgctgatcccggcgcttgctgcagagatgctgatcagcgtgctgaatcagtcgatggattcgtttgatcaaagcggagcggcttcattgatcgaggaagaaatggtgcagtggctttgccgaaagtttgaatacggaaaagatgctgacggaacatttacgagcggagggacacagtctaattacatggggcttcttttggcccgcgatgccttctgcgaaaagcagtggaactggaatgtacagaaggacggactgccgccggaagcgaacaggctgcggatcctctgttcaaaggatgctcattttaccgtgaaaaagtcggcttcccagctcggcctcggagagcgcgccgtcgtgcttgtcgataccgatgctgaaaagcggatgagcctttacgatttaaagcaaaaaaccgctatgctgaaggaatcgggcttacatccatttgcgattgtcgcaacatgcggaacgacggacttcggaagcatcgatccgctttccgagcttgcggatgccgcgcatgctggcgggctttggttccacgttgatgccgcatatggcggagcgttgattttgagcaggacccgccgctataaattggctgggatcgacagggccgattcaatcagcgtcgacttccacaagcagttttatcagccggtcagctgcggcgcttttcttgtaaaagacagaagacatttccgcttgattgattatcatgccgattatttaaatcctgaggaggatgaagcggagggaatcgttcatctcgtcaataaatcgattcagacgacgcggcgctttgacgccttaaagctgtttgtctcgctgcgtgtgcttggagaagatacattcgccgagatgatcgactggacattcgcattggctgaagcggcagcggaaaaaatctcagcaagcgatcggttcgaactgctgaatccgcaccctgaactgaacgctgtcgtcttccgctgcctcgcctcagaagacgacgcggagaacgaccgtttgaataaatgtatccacagagaattgttcagaacgggacaggcggtgatcgcaaagacggcagcagctgggaaaacatatttaaaattcacgctgctgaatccgcggacgacgctttcggatcttgatgacattctcgggaggattcaagagcttgcaagtctttatacgaatagcaggagggtaacaggatgagttcatttaaagaaatagcagaaaacgccacgattcaaagctttttaaattgctatttgcgtgaaaccggcatcgaaacccgtgagatcgcggacggctctcaaaaaacgctgattgtcccgctagagcgccagcagatcgagctgatcgttccgatcaagtactggtcgaagacgggaaggcaccttttctcatttccgctttattatcaaacagcccaaaacggaaagccgcttccactcgactatgtgacgctcgtctccctcgcttcaaaggaattgcttcttcagcaaagccgcgggggtgccgaggatgaattcatgctcagagtcattttgagctgccgaaatatcagccgttatgttgaggaacgagccgatgatcaaagtgagcttagccgtgctgattttacgtttatcgaagcggagcagtcgctcttgctcggccatctgatgcatccgacgccaaaaagcaggcaggggatgaagcctgaagaggaaagcatctattcgcctgaacttaaaggggagtttcagcttcattactttaaggcacacgcctccctcgttctgcacgactcaagtacaggaacaaaagcgccgctagtcattcaagaggaattgagaaacgacccgatgattgacaatgcgtggctggatgagcaaacggccgatccggattttgcgcttcttcccgcacatccgctccaggcgagagccttgttggaggagccgtatgtgcaaaaattgatcgctcaaggtctccttacatatctcggcgcaaaaggccggaagtatacggcgacatcctccgtccgcacggtctacagcaagcactcgcgctatatgtacaaattttcggtaccgatcaaaatcacgaattcgctgcgtgtgaacaagcagaaagaattggacagaggtgttgaaatggcccggctgcttcagacagagctcggccaaaggttgaaacaggagtttccgggctttcgcgtcatcacagatcctgcttacatttccattcgaggagagaacggggagtccggctttgaagtcgtgatcagggagaatccgttttatgaagacgaccgttcggcatgtctgatcgccgggctttgccaagatcacgcctacgggaaagagtcgcggctgtgctctgtcatccgcgggctggctttagaagaagggcggacgacggaagaagtgagcatcgattggtttgacaaatacttatcgatttcgcttgagccagttttatggctgtttgaaacatacgggctggcgattgaagcgcaccagcaaaacgccgtcatccgcttaaaaaacggctatccggagacattttactacagggacaaccaaggctattattacagcgaatcaaaagccgggattctttccaagctgatcgaaggcttgagcgaaaggagcgagacgatctgctcggacagcgtggctgtagagagactgcgctattatttcttcttcaaccatttgtttgggcttgtaaacgggtttggctgcgaagggctgatcggggaagaaacgctcctgtccatgatcagagagcggcttgaaaaagcggagcaaatttacggtatcacagagctgacggacagcctccttcgttttgcggagcttccgtgcaaggccaatctgctgacgagattttacgacatggatgagctgacaggctcgcttgaaacccagtctcgctatacgtctgtcaacaatccgcttttaaaggaggcggcggctgtccaatgaatgaacggatcacatttcaaaaagcggactatgaaagagacatatcgctcgtctaccgctggatgcaggaggagcatgtcattccgttttggcatttaaacatgccgtttgcaaaatttgaagcccattttcacaaggccatcacagaccctcaccaaacgctgtacatcggctttatcgacggtgtgccgatgagctactgggagtcgtactgggtcaagggagacatcattgaacaccactatgacaatgaaccttttgaccagggcatccacctgttgatcggtgaaaaagcgtatttgggtaaaggtcttgcccttccgctattaaaagcgatggtcaacatgcaatttgccgtgcctgaaacaaaaaaggtgatcgcagagccggatatccgcaacaaaaaaatgattcatgtttttgaaaaatgcgggtttcgccctattaaacctgtgaatctccctgataaaaccggattattgatgttttgcgaacgagaacgtttttttgaaaaggagaaaaaagatgaactctacaaagagacccaatgatgtatacgatgtcatcggcgtcggcatcgggccgtttaatctcggccttgccgcattggctgactccgtgcctgagatcaatgcgctgttttttgaacgaaacgaaagctttaactggcatcccggcatgctgattgaaggaacgacactgcaggtgccgtttttggccgacttggtgagcatggccgatgtgacaagcaaatacagctttttaaactatcttcagcagcataaccgtctttattctttttattttctggaagactttcatattccgagacaggaatacaaccactactgccgctgggtggcagaacagctcgacccgtgccgcttcgggatgaatgtcgaaagcatatcactcgttgaatcgaacccggaggcgctttttaaggtgcgggtcgcgaatcgggagaacggaggggaagcggtttattacacgaggcatattgcgcttggcattgggacgggcccgcacgttcccgatgcgctctcagacgctttggggggctcggtgttccattcagccgagtatttaaagagaaagcccggcggatttaaagggaaaagggtggccgtcgtcggctccgggcaaagcgcagccgaagtgttttatgacctggtcggtgaagatgaagcggagcatgtcagctggctcacccgctcaaaaggcttcttcccaatggaatattcgaacctcggactcgaatatttttcgcctgactatatcgattttttctatcagcttccgcagtggaaaaaagatgaattgctaacgcagcaggatcttctttataaaggaatcagcgcgaagacgatcagcgatatttatcatattctgtatgagcggacctgcggggggcggaaagcggcttttgatcttcagtccatgacagaagtcgagcagatcgaacagcgtggggaaacgctggttctatactgcacaaaccgggtgaatgaagaccggtttgagcggcaggcagatgtggtcgttctggcgacgggctataaagagaggctgccggaatgtctggcgcctgttgacagtttgattgaaaaggacgcgagcggccgctacgtgattacacgcgactacagactagtgacagctgcaaaatcaaaaaaccatatttttattcaaaacggagagctgcacacgcacggtgtcggtgcacctgacctgggactcggcgcttaccggaactcggtgatcatcaatcagctggccgggagagaagtatacaccgtcagccataaaacggtttttcagacattcggaacaggaatcgcggaaaaaacagctgtaccaaacggctaataaaggaggcattttcatgttgtttcaagatgaattaaagagggtcctcgatcctgacaggtggagagaagtcaatcggcgattgctggcgaagatgctttctgaatatatgtatgaggatatcattaagcccgatttcattgaaactgaagacggcatcaaccgctatgagctgagaacggccgaggataaggtgtaccggtttgccgccaaaccacgcatgtttgacagttttgacgcggtgccggagacgattgaagtcttcaagggcggacaatggacaaaacatgtgagcgcgattgaatttctcctggatattcagccgcatatcccgatgagtccggagacagcgggtcatttgatcaaggagttcaaccatacgatgctggctgatgcccaccttttggcaaaggatgcgcttacggctgacgagctgaccgaagccgattatgccgtaattgaaggcgagatgaccggccatccgtggatcgtctacaacaaaggaagaatcggttttggctatgatgactacctccggtttgccccggaaaatcagagagccaaacggctgctgtggatcgctgtacacaaagataccgcgtcatttcactcggttgaagggctcgattatgagacgctgattcataaagagcttgatgagctgactttaaggcaattcgctaaagtcatagaaaagcagggcgcagccagtgaagactattattatatgcccgtccacgaatggcagtggacaaatacgatcattcagcagtttcctgaagaaattgcttcaaaagcgatcattcctttaggggaaggcggagacgagtacctgccgcagcaatcgattaggacctttacaaacatcacaaacaaacacaagcatcatattaaactgccgatgagcattttaaatacgcttgtatacagaggcctgccgtcggaacgtacggttatcgcgccgaaaatcactgagcatatcaaagggatcgccgaaaacgacgcatttctaaaagacgaatgccgggtgatcctgccaggcgaaaatgccagtctgaacgttgaccaccaatactatcactctcttgaaaaagccccgtatcaatatttggaaatgctcggcgctattttcagagaaagcatttatacgtatttggaagaaggagaacggcctgttacgctcgcttctttaacatacattgatcaaggcggcgtgccgtttatcaggcgcctgatcgaaaagtcggggctgtcagcggaggagtggatcggaaagctgtttgacaccgtgatgccgccgcttctgcatttcatgtaccgctacggaaccgtattttcaccgcacggacaaaatacgattctcgtcttaaaagatcatcagccgcacaggctggcgattaaagattttgttgatgacgtcaatatcagcgaccagccgcttcctgaactgagcggtttgacaggggatttaaaagccgttctcagaagcgagccgccggaagggcttgtgcagtttatctttaccgggcttttcatttgccatttgcgctatgtagccaacattttagaaaatgacggtctgcttcctgaaaagcgtctgtggaaagctctggctgatgcgattcttgattatcagcaaaaattccctgaactgcgtgagcgcttcgaattgttcgacttattcaagccggaattgacgaagctctgcctcaacagaaaccggatggtcgactacggctacaaggacggcgatgaccgcccgcacgcctccgaattcggaaaagtgacaaatgcgcttgcgaaatttaaaaaagaggccgcaaagctgtaatgctaatgcggccgagaatgccccgcttccggcggggtttttttacgtcaatttcttatacatcaaaatatgaggtccgatcggcggtatgtcgtagacttcgccctgttcgctgaagccgagcttttcatagtagccgctcacagatgtcctggcattgcaccataaaaggtctgccccctttttccgaagaagctcttcggcatggcggatgagcgtgcttcccgctttttgctcacggtatccttcaagcgtcgccatccctctcagctgatactgttcttcgccttcaagctctgaatgttcggctttatgaaaggaagcgatgctgatcagcttgccccggtaatatccaccgaggtgaaacgcacccccgagcaaatcggtttcatacatacatgcttcaagcggctgattcggccggagaatgcggtgcctgatctcatacgtatcttccgcgtttattggtttgacttcaatcatatgattcctccttcagttgcagatcagatgagagcgatcgattttcagcatgctgtgatgttattccattatatataacgcttgtggaaacaatcaaagcaggatgatcatcaccccctgatctgtttaaagaatcatttcccccgggaggcggtccctaatccctatatcgtaaatggcggaatatatcgtccatccacatcggtaaactgatattctttggctaaatcaccaactcttaacgcacgtccgcttttctccatcacatccggatccttagccaatgctgtgattccgcgtccgacataataaggcgtttcggttctccttaaatcttccgactcccgccaatgcgcctcatctgattcatggtatttcagcacaagttcggttctcataaatcccggcgaaacggcaataacggcaatgttgtcccgttttaattccaatgaaagaccgtacgccatgcggacgattgcgttcttggccaaatcgtaataaaactgtccggtgtacttgttctcatcccagaaggtcgtgtgaatgataagagcttgtttattttcgcgaaggagcggcacggcgaagtggtttgtcgccagctgggcacgcaccccggcggcgaacatcgtatcccaatttttcaatgacaattcccaaaaaggctttgcctcgacacccagatcgtgcgccccccacacattgttgatcaaaatatccagttttccttgctcttcgcgaattttagcgatgacagcctctgtttctgcatcgttcgtatgatcacatcttacagcaatagcctttccgccggaagcttcaatttgtgacacggtgtcatcaattgtaccgggccattgattcgtggaagcccctctgatgctgcggcctgtaatatacacggttgcaccggcttttccaagttctgcagcgatggcgcggcccgcgcctctgcttccgcctgttacgagggcgatttttcctttcagcggcttcattcatcccattcctttcatttaaaaagatatgttcattataaaagctcaatcttgacaaccattgtcatattttattaaataagttcattcattgataagaaaggtggtcatatgagaggggatcgactgatatctattcttttaatgcttcaggcacaagggcaaatgacggcgaaagaattagcggaaaggctggaagtctccgagcgcacgatttacagggatatggaagctttaagcggagcggggattcccgttgtggccgaacgcggcataaacggaggctggtcattgcttgatgattaccaaaccactctaaccggcttaaaagaatctgaaatacgcgcactatttgttccgctttctgaacaattgcttgacgatctcggattaacccgcatatccgaagaagcccgaaataaactgattgcctcgctgccttcggaatatcgccaaaacgcaaaggatgtatggaaccgcatatatattgatacctgttcatggcgccataagaaagaaaaagcagaatcctttgaagtgctgaaagatgccatatggaaagatcaaaaattaaaaattgtctatcagcgggcagatggacaaacggctgatcgtgttgttgcaccgcttgggctggtggctaaaggggcgaactggtatctgattgcatctaaagaaaatggggagattcggaattacagggcttcacggattaaatctgccgtttttgtccgcgaaacgtttgataggcccgaaaattttgatattgctcacgtgtggcggtcttcaacaaaggaatttattgaaaggctgccgacgtatgaagtgcgggtgaaggcggcgcaggccatcttgccgaggctgtcgtttaccaatcattttgtgcggatcatcgaaacaaatgagatcgatcaggagggctggatccccgttacgctatcctttgatacggaagaagaagcaaaaaggtatatactcggattcgcagagcacatgaggatcattgaacctaaagaactgcacggaaagatacttaaaatggctgaatccatagttgcgcattataaaacctgaaagcggcaatgactttatgttaaagacatacatgataaaccctgccggccgcaaacggcaggcagggtcttcgtttaatgaacattgaaatatctggcttccgggtgggagacaacgatcgctgatacggaagcttcgggctccatcatgaagccgtctgttaagtgaacgccgatgccttcgggctggatgagcctgaaaagcttttcctgatcttcaagattcggacaggccgggtatccgaaggaatagcgctgcccttggtatttcgcctgaaaacgctgttccatcgtgaagtcgggtgcatcagggaagccccagcggtcgcggataacctggtgcgtccgttcggcgagcccttcggccagctcaagagcaagcgcttgtaccgcatggcttttcaagtagtcgccttcctccttaaagcggttggcggcagctcttacatgcctgcccgccgttacggcaaagaacgagacataatcaagctctcccttcggtcggacgtaatcggaaatacagcggtacggaagcttttcctgccttggaaaaacaaacgtttcaaggatgctgtctttgttcactggatctaaaatatgaagcgaatccccgtcgctgtacgcagggaaaaattggtagacgaccgcaggatcgaaccagccgtgttcttttccgtctctcagcagctcgtcgatcagttctttcagctccagtgcttttggatgctgttcagccagtagttttttgactttccctttcaagccgagatgatggccgagcagcatttgttcattgacatacggcacaatataggaaaggtcgatgtttttcaaatagtgccgtttcaagtcttcaggctgaaagaccggcgccttcggaacgtgcgcccgtttttcaagcatttcaattacggctttcgtctgctttttttccgcgacggcggcgggtgcagcggcttcttttttctcgagaaactgcgacgggtccgtccgcagctgattggcgagcgataggccgtccatggcgtccttcgcgtataaaaccggccctttatattcaggcgaaattttcatgttcgtgaattttcttgaaagcgcggctccgccgaccatgatcgggatggaaatatccgctttatcgagatccttcgccgtaacgaccatctgctgcgccgatttgacgagcaggccggacagaccgatgatgtcggggttctctttgcggatcgcctcaattaactcctgcggtgtcactttaatcccaagatcgactaccttgtagccgttgttgcttaaaatgatgtcgactaagtttttgccgatatcatggacatcgcctttaacggttgccaaaatgatctttcctttgccgctgtcgtctttcttttccatatattgttcgagaaaggaaacggcagctttcataacctctgccgactgcagaacttcagcgacgatcagctcattgttgttaaacagccgtccgacctctgccatgccgtccatgagcggaccgttgaccacgtcgagcggggtggcgaattttttcaacgcttgttcgagatcgggaatcaagccttcttttgtaccttcgattacgtattcggccaggcgctcttcgagggaaagggacgttttcggctgtttgtccgcttttttctttccacgatagaagtcagtgaaggatgcgagcgttttatcgtcggtatgaaacagaagtttttcagccatctcgacttcttctttaggaatggaagcaaaccgctcaagcttttctgtattgacgatcgcgtaatcgagcccagcctgtgttgcgtggtacaagaatacagcatttaagatttcccggccgacgggcggaagaccgaatgagacgttgctgacgccgagaatcgttaagcattcagggagctgctctttgatgaggcggatcccttcgatcgtttctttagctgagccgatgtattgttcatcgcccgttccgaccgggaagacgagcggatcgaatatgatatcgctggccggtattccgtatttttcggtgagcagctgatgcgaccggacggcgacggccagcttttttgccgcggtgactgccatcccctcttcatcgatcgtgccgacgacgagtgcgcctccgaactgtttgacgagcggaaggatgtcagcgaaccgttcttcgccgtcttcaagattgatcgaattgatgatcgcttttccctgcgagtatttcagcgccttttcaattaccgttttgtccgtcgagtcgatgacaaacggggcttttacttttttcatcgctttttttaaaaagccttccatatcttccgcttcatcgcggtccgggtctgcgagacagatgtcgatgacatgggcgccgtttttcacttgggctctcgcgatttcggatgcttcctcaaatttatgctcggcgatgagccgcttgaattttctcgagccgatgacattggtccgctcaccgacaaaaaggggacgcattgtttcttcgtaaattaatccgtcgattcctgagacggtgtgcggctttgctcccgaaggaaccgtccgcggaggcagaagggctacttcatcggccagcgcttcaatatgggcgggcgtcgttccgcagcagccgccgacaatgttcagccagccttcttcagcaaacgccttgatttttttcgccagcgattgcggtgattcatggtattgcccctcctcatcggggaggccggcattcggatagcagctgacggccgtcctcgctagggaagaaagggtcctgatgtgatctgtcataaattccgggcctgtcgcgcaatttaaaccgacgctgaccggtttcatatgctcgagggagatatagaacgattcgatatcctggccggcaagcgtcgtgcccatcggttcgattgtgcctgacaccatgagcggaagggttttgccggttttttcgaaggcttgtctaatgccgataaagccggctttaacgttcagcatatcctggctcgtttcgaggagcaagaggtcggctccccccgtgatcagcgctcttgcctgttcctcgtagttatcgatcagttcgtcaaaggtggtgccgccggtgacggaaagggtttttgtcgtcggacccatcgcaccggcgacaaatctaggccattcaggagttgaaaacttttcggcggccgctttggcgagtttgactgaagcgaggttgacttcataggctcgatgcccgaggtcgtactcgtccagaacgagccgggtggctccgaacgtattggtctcgatgatatcggctttagcctcgagataggcttcgtggatgccctgaatgacatggggcgccgtaatgcttagaaattcattgcacccttcatatgcctcgcctccgaagtctgcggcggacaaaccggcgtcttggatcatcgttcccatcgcaccgtcaaggacgaggatttttttcttcagctggtcattgatgttagacatttgtcttctccttttctttctgatggatatatgccgtcagctcggcggttagatcggaccgcaaaaacggtgtgatcagataaatgccgttgaacaggtcgcacgccgcatcaagcagagagcgagcgatcgcgagcccttcctcggcctgtttttgtttgtcgtttcctgccagcgccatcttttcgcggattgaatcagacagcttgatgccggggatttcgttgtggatgaattccgcgttgcggctgctggtgagcggcatgacgccgatatagatcggtgtttcaagatgccgcgtttccttgtggattttaatgagctgctcctcggaatagacaggctgggaaatgaaatagtctgcgccgcaggcgatttttttctcaagccgtttcaccgctttgtcaatgtgtctgacattcggattgaaggcggccgccactgagaaattcgttttcttgccgagcggtttacccgaataggacaagccttcgttaaactgcttgatcaggctgatcaaatcgaacgatgtcaggtcatagacggaagtcgctcccggaaagtcgccgattttcgacggatcgccggtaatcgccagcacgtctgacagccccagcgtatcgagtcccattaaatgggactgcaggccgatcaggttgcggtctctgcatgtgatatgaatcagcgacctcatatcgaggcgctgttttaagagcgccccgcaggcgacattgctgatcctcggtgtggcaagggagttgtccgccaatgtcagtgcatcgattccggctgattttagctcctctgcggcgtgcaaaaatttctcaaagtttaattgttttggaggatcgagctcgacgataatggaccgtttctgctttgccagatcgtcaagagcaggctctgtcctttcgttttgaacggcaagcgccgctttctttctgattttcactcgtttttcggtgactggaggaagtcctttgacggcctcagccatcgctctgatgtggttcggcgtcgttccgcagcagccgccgatgatccgtgcgccttgattgcggaattcctccgcgctttccctgaaatattcatcatccgtctcataaacaagcctgccttcgacaagggacgggaggctgctgttcggatagacggaaagataggcatcttctaaaagcgggacttcttcaagcgctctgatcatatgataagggccgagacggcagttgatgccgacgacatctgcgccgagtgatgccagctgcttcagaccgtccgcaagcggggtgccgtcctgaagaacgccctcttcgtgcatcgagacattcaaaatgatcggcagctccgtttcctttctggcaatctttaaaacttcgcgcgcttcttctaagtcgtaataggtttcgagcagaagtccgtccggctgctcatttaacagaaggtagagctgttcgcggaagcttcttttaatgtcctcgagagaatacgagtttttgttgaacgtccggattccgccgagcgtaccgagaacataagcggagccggcggcggcgcgggcgaggcggacggctttttcgttgatttgttttgtttcgtcttcgagtccgtatctggacagcttgatgaagtttgcgccgtacgtgttcgtttgaataatgtcggcgccggcctgtacatacgcttcgtggacgcgtcttatttcttcgggcttggagatgttcagttcctcaaaacacctgtcgatcccataggaatacagaagcgtgcccattgcgccgtcagcgattaacgttttgttttttatatcctccaaaaaacccatcgttttcccccttaatcattcttaataaaacaaaaaagtcttctgggaagcagaagacttttcagcgacatttgtccgtcttcttatcttccaagcaggctgcttgctggatttagcaccttggtcatgaatattcattcaccggttgctgaggcttcatcgggccagtccctctgcctctcttgataagaacagctatttagtttctattgattacttttactcaatttaccgaaaatcgggggaataatcaacagtaaattaagaatttatcgaaaatttataaattgaacatcaatcggcaggtcggcttccctcaccatcgcgatgatttgctgaaggtcgtctttattttttccggttacgcggacttgatcgtcctgcacttgcgatttaactttcagacccgatttttttataaggttattgattttttttgcgttttctttgtcgatgccttgaactaattttccgcgctgtctgaccgtgccgcctgaagcgttctcaagctttgagtattcgatgtttttcgtcgggacgttccgcttgatcagtttgccgacaagtacgtctttcaactggttcattttaaattcgtcgtctgatacgagaacgagttcgtctccttcgagtgtgatgctgctttttgaccctttgaaatcatagcgtgtgccgatttccttgagagcggtctggattgcgttttgaacttcaggcagttcaacctttgagacgatatcaaatgagctttctttcgccatgtgaaaaaacctccatccattttacttatgagtcaattatagtagaataaggtgaaacttccaatatcgagcggttttgcctggccgcgatctggcaataatttgaacattggaggaataataagaaaaagaaaaacaggcggataagaaaggaagaagcagtatgaaacctggacagcagctaacattgaaaatagatcataaagcagattacggttactttttgacggacggcgaaacggcggtccttctgcatcagagcgagatcaccgaggatattgacgggagagaagaggtcgatgtttttttatatgtcgatcacgaagatcgccttgcggctacgatgagaaagccgatcatcagcgctgaacaatacggctgggtggaagtcgttgatgccgtcagcggcatgggcgttttcgtcgatgtcgggctctcgaaggacgccctcgttgcgacagagcatctcccgccgtatgaatcagtatggccgcaaaaaggagacaggctgtactgtatgctgaaaatcacggggcacggaaggatgtttgccaagccggcgccggaggacaagatcagcgaactgtttactgaagcttcacccggcctgatgaataaagagctcaccgggacgatctaccgcttgatcgcatcaggctcttttatgatttccgaagccggcatcagaggcttcatccattcttctgagcgaaaggaagagccgaggctcggcgaaaagctgactgcaagggtgatcaaagtaaaagaagacggttctgtaaatctgtcgcttctgccgagaaagcaggatgccttgtcggttgatgcggaacaaattctgacttatatgagatcgagaaacggcgcgatgccattctgggataaaagcgatccagaggatatcagagagcgcttcaacatgagcaaagcagcatttaaaagggcgctcggccatctgatgaaacaggataaaatctatcaggaagagggttggacgtacgagaaaaaattatcttgaggcggcgttccgatcgggacgccgccggtttcttacaggtgatgaggcttctttgattcctggtgtttaccggcttgtctgttcttttcggcgagccggtttttctgctggttgacggcgttattgtcaaccggctttttatcatcatctttcatgaggaagcacctcccgtcaaaatgtcgctcttagcttgctcactgccggcgaaactatgtactctcccaattgcgatgttttttgccgggaagtttatgccaccttgttccgtcagcatacacatatcataagacccaaaaaaggagagttggtatgaaacattgctgctcagttacattcatcgcgtttcggcaggaggggtcgtcaacttcggcggtgcgtacaaaatttgtccgatcacaatggaaaaagtggtcgagggatctggaggcccggatgtcgcgacagctgctgccggctttcttgatggagcgcttgcgccggccgttgaggaagggacagtcaccgaagacagctgacgctgaggcctgcttttaaaaagcaggcctcagcgtgtcgacaaaccctcgcattcgttgtcaggcctgctaagtcggtgctcacgaataggagaaggatcggcggctaatcgcccaggcgtcctgcctgaacgccgccgtcgtcacttcctgtgaaagtccgctccgatgctcggccttcctagactgaaagggttttgggtcacgctgaaagaaggatgacaaaatcccaaaactaagagccgttttgggattttgtcaacaatctaaggcctgcttttataaagcaggcctctgttttatcttatcttttgtctttccccggaaaaaagaccgccaatgttccgggtccggcgtgggcgccgaccgctgaaccgatcatgttgacgacgatctcctccggctggaattcggcttcgatcatccgtttgacttcttcggccgtctcttcgtcatctccgtggctgatgccgaccgtctgtccgctcaaatcgacgcttctttccttcattaattcgatcatccgtctgagcagcttctttttgccccggattttttcaagggggacaagcttgccgtcatcaacatgcaaaagcggtttaatattcaacagcccgccgacaaatgccgatgctttgctgattcttccgcctcttgccaaataagtcaagtcatcaacggtaaaaatatgttcaagatgttcgcaaaagtcctttacagacgactcgatttcttgtattgtattgccgttagttgcgagtttgagggcgtgcttgacagcaagcccatagcctaatgaagcgcattttgagtcgatgatccgcaggtcgaaatcagggaactcctccttgacttcgtttgccgccatcacagccgtctggtatgttccggacagctctgaggaaaaggcgatatagagagcgggtttattttcgttggccagctcgctgaatgcgttcttgaacagcatcagagacggctgggacgttttcggcgctttgccttcgcgcatcgcttcataaacgtccagaggctgaatcgtcagaagatcatcgtattctttttcatcaagcagcacccttaacggaataaatgagatgcgatgttcatcataaaaagatttcggcaaatctgccgcgctgtctgctaaaaggtgaacgttcatttgaaccccttctttctaaaaaatggttgaaaaggacactaagctgtccttcggcatacttcgttttttaggtcaactatatcatatatttttacattgacgttttcaaaatattgttttaagggtaaaccaaatatatacgaaagtagcggaggaactaaatatggtcatagcggaagcaaaaaaattgttcattgtcatcatcggcgccttgttaaatgccatcggattgaatctgtttctgattcccgccgatgtttacgccagcggctttacgggggtggcgcagcttttatcgagcgcgcttgaccagtacagcccgatttatttttcaacggggacgctattgtttattttaaacattcccgtcgggattctagggtggctcaaggtcgggcgctcatttacggtctacagcattttgagcgtggccttgacgacggtctttttggggatgctccctgaggcgagcctgtcaaacgacattttgctgaatgccgtgttcggcggggtgatcgccgcggtcgggatcggcctgacccttaaatacggggcttcaacgggcggtttggatattattgcgatgatcctggcaaagtggaaagacaaaccggtcggcacctatttctttattttaaacggtgcgattattttaacagcaggattattgaacggatgggagaaagcattatatacgctcgttacactatatgtgacaaccagggtgattgatgccatccacacccgccacgccaagctcaccgttatgattgtcacaaagaaagcggaggagatcaaagaagccatttacgggaggatggtccgcggaattacaaccgttccggcgaaaggcgcctttacgaatgaacagaaagaaatgatgatcattgtcatcacaaggtatgaattgtacgacttggaaaaaatcattaatgaagttgatccaaaagctttcacaaacgtcgtacagacaacacaggttttagggtttttccgcaaagattaatgaaagggtgaatgaatgcggctgatttccatgattgtgatgctgctgtttgtcagtggatgcgggcaaaacggggatcaagtccccgataaggaggtatcaggggaagtggataacgggagtgtgacattgacggttgaacccgtccagaagcagggagaaatcgaatttcggatgtcggttgtaaaccatacggatgatgcggcagagtttgaattcagcagcggacagaaatttgagctgatcgtcagcgacaaagaagggaatgaaagataccgctactcgaaaggaaaaatgtttacacaggctttccagacgatgacgctcaatccgaaagagtcctacgattttactgatgtatggaaagaggtgcctgaacccggcacatacgaagtaaacgtgacatttttggggagatcggaacagtttgcaactttgagggccggcaaaacgtttgaagtgaaataaccatcaaaaaaggcatcccgggaaaggatgcctcttttgtattctgtcaggaaggatcggcggctgaatgaacaccgccacggtcacaggatgtgaccgttaatattgatccccattgaaaatagaatttttaacgatgacatagtctacgttgcggatcgcatcgagcttgtttcctcccgcataagaaatggacgactgcagatcctgttccatttctgtcagcgtatccatgatcgcgcctttatgctccacgtacatttttttgccttcgacatttttcttttcgcctttttggtactcagaagctgaaccaaaatattctttgtagagcttgccgtctttttcgatcgttgctccaggcgattcttcgtgtccggcaaacagcgaaccgatcatgaccattgtcgccccgaatctgaccgatttggcgatgtctccgtgggtgcggatgccgccgtcagcaatgatcggcttgcttgccgcttttgcgcaccagcgcagcgcagccagctgccatccgcccgttccaaaaccggttttgatttttgtaatgcagacttttccgggaccgatgccgacttttgtagcgtcggctccggcgttttcaagctctctaacagcttcaggcgttccgacatttcctgcgatcacaaagctgtccggaagatgttttttaatgtgctgaatcatattgatgacggcgtttgagtgaccgtgggcgatatcgatcgtgatgtactcgggtgtgagattctctctcgtcagctcttcgataaacgcgtattcttcatctttgactccgacgctgattgaagaaaacaaaccgcgtgccttcatgtctttaataaaatcgatccgtgtttccggctcaaagcggtgcatcacataaaagtaaccgttttccgctaatgaaacagccagcttttcatctataatggtctgcatattggccggcacgacaggcagtttaaatgtccttccgccaaactgcacggatgtatcacattcagaacggctcttgacgatgcactttgcaggaattagttgaatatcttcgtaatcaaatacattttccaatataaaaacccccaaaaaaacgaatatttattaataagttatttaaaatgttcgccttttataatgtacttccttttgttcccgatgtcaaatttttatgctttgagagcggaaaaataaaaaaggagccgtgccgatggcacagactcctctccggctgtcaaaagccggtgcggtattatgatagttgatctagctgctcctgaagattgtgaagctgtcgccgttcggcatcagttgaattggcatacgccgaggaaagggcgtttttagctcttgcaacggctttcgccttttcgcctgaatccgccgaagcttcagctgcatgtacggctgctttggccatttgaaacagttcgtttctcatttacagccctccgcattccgtcgggccgctcttctgttcagcctcttctaatgtggagcggtaagggaacctggcggcatgctgtttaagcgagtctttgccttgctgaataaaccgttttgatttgctgcgtttacccatcttgaattcccccttaacacaagtgacggtccggtgcggccgtcttctcatagtatggccgttttgaaaagccgtttatgaatggcaaattataaaattataaagcgaagtaatcctttaaaaagactgcgattccgtcttcctcattcgatttcgtgaccttgtttgcaacgctttttaccccttcgatgccgttgcccatcgctactccgcagcctgcgaactcaagcatttcaaggtcgttgtcttcatcgccgaaggcaatgacccgctcaggcgggattccgtagtagtccgtgattttctctaagccgaccgctttattgatgccgcttttaatcagttcgattacatgccacggggccgcccatcttctatggtcgaccatctctgcgtgtacgtctgacagataggagcggatcgccggaacatcctcttcttttgcgtgaatcaatacgcttgtcacatcctggccgaggtttgttcttaaatctccgactgtaatattcgggctgcccatcgtaaagacatcaatcagcttttcgtcatgataatgaaaataaacatcatcgacaatttcagcaaggatattatgtacgttgtacgtttcgctgacttcaatgatctgtttgaccacctcgagatcaagagatgtatggaagcgtccccagctttcatctttagggtgatggacaaacgcgccgttgaaattgacgatcggcgtatcgagctggagctgatcataatacatggagcttgctctgaacggtcttcccgtagaaatgcacacgtaatgtccatcttcccgcagcttgcggatgacttcgctggagctttccgagatggtcttgtcgtcttttaataatgtaccgtctaagtccaatgcaattaaatatggttttgtctccataaatgctcctttaatgtgaatttgaaagttctgacttacctatagtgtatctttttaccttctttattgtctacatgttaaacttatgatgatggacatcctaaaaggaggaagaaacagtcgtgatcataatcgaaaagcagcatatttcaaacattcctcttttgcatattgtaaaagaggagaaaaaagagaaagctcttcctcttgttttcttcatacatggttttacaagcgcaaaagagcataaccttcacttcgcatacctgcttgccgaaaaaggaatgcgcgtgattctgcccgaggctctctatcacggggaaaggaatgaacagctcacccaggaagagctcgccccgagattttgggagatcgtcacgaatgaaatcaaagagctggaagtgctgaaaaaccactttgaacgggaaaacatgattgaaaagggccgcatcggcgccgccggaacatcgatgggcggcattgtcacgctcggcgctttgactcaatacgaatggattacaactgccgtcagtttaatgggcagtcccgcctatgtagaattttttgatcagcagctcgcatttatgcgtgaaaagaaaattgaacttcctatcacagaagaacaaatcgatcagcagcgcgaagaactgaagcgttttgacttgagtctgcagccggacaaattgaacatgaggccgcttttattttggcacggcaaacaggacggcaccgttccatttgctttaacgcgccgcttctatgaatcgattattccactgtatgaagctcggcctgatttgctgcattttatcgaagatgagcgggccggacataaagtatcgagggaaggccttttgaaaacagtcgaatggtttgacgcgcacttgtaagcactatcgttttagaaaatgaacgaggtgcgttatactgatgaaaaaaggagtgaggaagagtggatgaagcattaaaagaaaacatcatgggcgcccttgaacaggtcgttgaccctgaattgggcgtcgatatcgtcaatctcggccttgtatacgacgtaaatatggatgagaacggcaaaacagacgtgaccatgactttgacttcaatgggctgtccgctggcgccgatcatcgtagatgaagtcaaaaaagcgctcgcagatattccggaagtcaaggaagttgacgttcatatcgtctggaatccgccttggacaagggacaaaatgtcgcgatatgcgaaaatcgcacttggtatacaataaacgtttccagagcctgttcaaccgttgacaggctctttctcttccatataaggggaatgatcccggcagatggcctctcccgttattaatgaaaaagaacgcttttacaagcgttctttttttattgcaataactgctgccggcacattctccggtttgaaaagcggggaacccgggaaggtaagaacggagcacgaccgagccgaagaaaaggaccgccggcgggaggaaagaaccaatatgaaaggtgattgaaaaaatattaaatatacaattgaattaatttttattcatgttataatgttaaataatttcacaaagaccaagaaggtgaactcgttttgaaaataggtattataggtgctactggctatggaggggcagaaatcatgaggattatgaggactcacccttatgcagatgaatgcatattgtattcatcgagtgatgagggagcccgctatgacgccgcatacccgcaccttgtgaaactgacagatcaacacctgcaaccgatcgaggttaagaggattgcgaatgaaatcgattttttatttatggcagcgcctccggggatatccagccggctgacgccacagtttgatgcatatgacatacccatcattgatctgtccggcgatctcaggatacagaacccaagcgtctatgaaaagtggtataaaagggaagccgcgcctgaacacgtgcttcaaaaagcggtatacggactgtctgagctgaatcgggaagacattaaaacggcgcagtatatagccaatccaggatgttttccgacagcggttcttctcggcttggcgccgctcgtcaaaagcggcagcatcaacgaatcttttgtcatcatcgatgcaaaaacaggggtatcgggggcaggcagaaagccgtcgatgggcactcatttttcagaggtcaatgacaattttaaaatatacaaggtaaacgaacaccagcacacgcctgaaatcgagcagactgtcaaacagtggaactccgcatttaaaccgatcacattcagcacgcatttagttccaatgacaagaggcattatggcgaccatctacacagagctgaaagacagcatggatgccgaacagctgcagcttattttttctaaattttataaagattcatactttgtcagagtgagagaaacgggttcgttccctgccacaaaagaggtgtacggcagcaatttttgcgatatcggcgttaccgtcgatgaacggacgaacagagtgacaatcgtgtcagtgatcgataacttgatgaagggagccgcgggtcaagcggttcaaaacttcaacattatgaacggcttgagcgaaaccgccgggcttgaatttacgccaatttatccataagacgggagagaacaaacttatgattcaggtgagtcaagacagcataaaaaaaacagacggaagcgtcgcttcgcctaagggctatcttgcaaaaggggtccactgcggcctccgctattcaaaaaaggatcttgggatcatcatcagctcaagaccggcggtgagcgccgccgtttatacccaaagccactttcaggctgcgccgatcaaggtgacgcaggaaagcctcaaaaaaagcgcgcatctccaagccgtcatcgtcaacagcgccaatgccaacgcatgcacgggagagcagggcttaaaagatgcttatgaaatgcgccgtcaaagcgctgatatgctcgggatcgagccggatctggtggccgtgtcctcaaccggcgtcatcggcgaatacctcaatatggaaaacatcacaaaaggcatcagccttctcgccgagacagagcctgccgaaggcgatttcgaagaagcgatcttaacgacggacaccgtgatcaaacaaacgtgctatgaactgatgatcggcggccaaaaagtgacgatcggcggagcggccaaggggtcgggaatgatccacccgaatatggcgacgatgctcggctttgtcacaacagatgcatgcatcgaagaaagcgcgctgcaaagggctttaagggaaatcacggacgtttcgttcaaccagataacggtcgacggcgatacatcgacgaacgatatggtgctcgtcatggcgaacggatgcgccggaaatgagcgcctccatgaagaacacgaagattggccggttttcaaaaaaggcctgcagcttgtctgcacagacctcgccaaacaaatcgcaagagacggggaaggggcgacaaagctgatcgaggttgaagtgaacggcgcgaaaagcaatcttgaagcgcaaatcatcgccaaaaaaatcgtcggctcaaaccttgtaaaaaccgcggtttacggaacggatgcgaactggggcagaatcgttgtcgcaatcggggacagcatggctgctgtgacaccggagaaggtggaaatccgcctgggcggccaatgcctatttaaaaacaacgaaccccagccgttttcggaagagctggccaaaacatatttagaaaacagcgaagtgaaaatcgaggttttcatgcaggaaggtgaaggaaagggtacggcttggggctgcgatttaacttatgaatacgtcaaaatcaatgcgagctatcgtacgtaaaaaaggggatcacaatgggtaaaacaatcgtttttaaatgcggcggaagcgtcatccgcgaactctcggacgaattttttcaaaacctgaaagatctgactgaaagcggctggaaaatcgcgctcgtgcacgggggtggacccgatattacaaagatgctgaagaagctcaatattcgaaccgaattcgtcaacggacagcgcaagacgacaaaagcggttcttgaagtcgctgaaatggtcctgtccggttcgatcaacaaatttttcgttgctgagctgacaaagcacgggcttccggctgtcggcgtatcgggaaaagacgggggactgctccttgcagactatttaaatgaaaaggaatacggtcaagtcgggcgcattaaaaaagtaaacggccaaatggccgaagcgctcatggaaaaaggatttattccggttatcgcacccctctcgatgacggatggctgtgagaccttgaatgtgaacgccgatttggcggcgtcggctgttgcggcagccttgcgcgctgacaaattgatgtttgtgacagatgtcaaaggaattatgaaaaacgaagaaatgctgaaagagctgacgcccgaagacatcgaaagcctgattgctgaaggcgtgatctcgggaggcatgataccaaaagtgcattccgcaaaagaggctcttacagatgaagtggaagaagtaatgatcgtaagcgggaaaggatctttcctgacgaaagacgatttcatcggcacgaaaatcatcaaacaaaaggaggccgtatcgtgagtcacttatttcaaacgtacagccgctggaatatcaatattaaaaaagcgaaaggcacgatcgtccaggatgagaaggggaacgcctatctcgatttcgtccagggaatcgcggtctgcaatctcgggcattgccccgattcagtaacggctgctctcaaaaaacagcttgacgatgtctggcatgtttccaatttgtttcaaaatgagcttcaagaaaaggttgcacagctccttgccaaaaacagtgcaggcgatctcgtcttcttttgcaacagcggggcggaagcgaatgaaggggcggtgaagcttgcgcgaaaacatacgaaaaaaacaaaaatcgtaacctttcagcaatcgttccacgggcgcacgtatgcgggaatggctgcaaccggacaggaaaagatcaagcacggattcggaccgatgcttgaaggattccattacctcccttacaacgagccgaaagcatttgccgaattgcaggacgaaaaagatatcgcggcggtcatgctggagccgattcaaggcgaaggcggcgtcatcccggcgagcagagaatttctgcagagcgttcaagacttttgccgagataagcaggctctccttatcattgatgaagttcaaaccggaatcggccgcaccggtaaagcattcggatatgaacacgaagggctgtcacccgatatcgtcaccgttgcgaaagggctgggcagcggttttccggtcggagcggtcatcggcaaaaaagagctctcagaagcgttttcgccgggctcccacggcacgacattcggagggaacatgcttgcgatggctgcggcaaatgccacgttggagaccatttttgacagaagctttcttgaagaagtgagcgccaaaggagcatttttgcatcaacagctgaaagataagctccaatttccgcttgtgaaagatatccgcgggaaagggctgatcgccggaatcgagtgcaaagaacccgtgcagccgctgatcgaagcgcttcaaaaagaaggcctgctcgttcttcctgcgggtccgaacgtcatcaggcttctgccgccgttgacggttgcgaaaagcgaaatcaaagcggccgtggagaagctgaaagatgtcatggcaaatcattctgctgtaaagcagtaattttttttgaaatgaaagtataaaaattcatgaatatcactatttattcatcaaaggtgggcataagatggaaggatatttagttcttgaagatggtacatccttcagcggagaactggacggtcttgacggctgcaccggtgaagtcgtcttttttacgggcatgaccggttatcaggaggttttgacagatccttcatataaaggccagattattgtctttacgtatccgctgattggcaactatggaattaatggaagcgatgctgaaagcaaacagcctcaggtgagaggggtcgtcgtctatgaagcgtgcgacagattttcccaccatcaggcgacagaaagccttcgggaatacttggcgaagtgggatgttccgcttttgtcgcacgtggacacaagagcggttgttcagcatatcagggcaaaagggacgctgaatgcgaggctgacgaaacaaaaggacgacatcccggctccgcgccagctggaaaactatgcggcacaggtttccggacaaaacgaaaacggcgcttttggggaaggcaatacgcatattgcgctgatcgatttcggctataaaaagtcgatcgcttcatcgctagcaaaccggggctgcaaagtgacggtcgttccctatcaagagatggacggcattgcgaagctgaatccggacggaatcgtcctttcaaacgggccgggcgatccgaaagcgatccttccatatatggatgcactccggggtatcatttcttcctatccgacgctcggcatctgcctcgggcaccagctgatcgcgctcgcattcggaagcgacacgtataagcttccgttcggccacaggggagccaatcatccggtcatggacaaagagaccggacgcgtgttcatgacaagccaaaatcacagctatgtcgtcgatcgggacaccatcagcgaaaatgaattttccgtcaggtttcatcatgtcaacgacggttcagtagaagggctgatgcataaaacactgcctgtcctatccgttcagtttcatccggaagcccatccgggaccggctgaaagcgaatggatattcggagaatatttgcagaaattgaacgaagcaaggagagagatcgcccatgcctaaagaccaaaccatcaaaagcattctcgttatcggatcggggccgattatcatcgggcaggccgctgaattcgactactcaggaacccaaggctgcatggcgctgaaaagcgaaggctaccgggtgattctcgtcaacagcaacccggcgacaatcatgaccgatgaatcttttgcagatgaaatctattttgagccgttgacagtggaaagcctcacacaaatcatcaagcgcgaaaaaccggatggactgctcgccaatctgggcggacagacagcgctgaatttggctgtcgagcttgaaaaggccggcattctgaaagcgtacggggtgaagctgcttggaacatctgtcgatacgatcgaaaagggtgaagacagagaaaagttccgcgccttgatgaaagagctgaatgaacctgtgccggattcagaaatcgttgacaatcaggatgatgcgcttcgttttgcgctctcaatcggttttccgattatcgtgcggccggcctatacactgggcggaaaaggaggcggcatcgcggcgacaaaagaggagtttctgcctttaatcgaaagcgccctcctcgcaagtccgatccatcaatgccttgtcgaaaaaagcattgccggttttaaagaaatcgaatacgaagtcatgcgggacagtaacaatacatgcatcaccgtctgcaatatggaaaacatcgatcctgtcggcgtccatacgggagattcgatcgttgtcgccccgtcgcagacattaacggatgcggattatcaaatgctgcgttctgccagcttaaaaatcatttccgcgctcgatgtcgtcggcggctgcaacattcaattcgccttggacccggagagcaaaaactattatgtcatcgaggtcaatccgagagtaagccgttcatcagccctcgcctcaaaagcaaccggctatccgatcgcaaaaatggcggcaaaactggctgtcggctacacgcttgccgagctgaaaaatccgctcacagattcgacctatgcaagcttcgagcctgcgcttgactatgtcgtcgtcaaatttccgcgctggccgttcgacaaattcaaacaagccgaccgcaagctcggcacgaaaatgaaagcgacaggggaagtcatggcgattgaccgcaatcttgaagcggccctgcaaaaagcggtcgcctcccttgagctgaaaacatcaggaacacatttgcccgaacttggcggcgtatcttctgaagtgctgtggaagctgcttgagacccctgatgaccgccgtttctttgcggttatggaactgctgagcagggggacttccatcagcgaaatacacgagaaaacgaaaatcgatgattatttccttcatgtgttttctaacatcattcagctggaaaacacgctgatggagcagggagactcgttgtccgtcagccttttgaaaaaggtgaaagaaaagggatttaccgactttacgatcgcttccctcaccggaaagacagaagaagaagtgcgcgcgcttcgcaagaaaatgggcattgccgcatcctttaaaatcgtcgatacatgcgcggctgaatttgatgcgaagacaaactatttttactcaacgtacttcgggaaaagcgacggagacatctctcaaaaaacgaaaaagcgggccttgatcatcggttccggcccgattcggatcggccagggggtcgagtttgactacagcgccgtgcacggcgtcatgacgctgaaaagcctcggatttgaaacgatcatgctgaacaacaatccggaaaccgtcagcacggattatgaaatggcggaccgcctgtactttgaaccgattacacccgagcatattctcaatgtcgctgaagcggaagacatcgactttgcgattgtgcaattcggcggccaatccgccatcaatgtagcgcaagcgattgaaaaagcgggcatcaccctgcttgggacatcatcggaaacccttgacatacttgaagaccgcgatcaattttatcagctgcttgacgagctcggcatctcccatgccaaaggagaaacggcttcatcaaaagcggaagcggtgaaaaaagcgaacgaaatcggctatcctgtgttgatcaggccgtcatacgtgatcggcggaatgggcatgatgatcgttcactcagaagcggagctcagagagctgctgggcggggcatcgcaaatgccttacccgattctgatcgatcaatacgtatcaggaaaagagtttgaaatcgaccttgtcagcgatggcggcgatctctacatcccgacttatatcgagcatattgaaaaagcgggcgtgcattcaggtgacagctacgcgattttgccggggccttcggttactccggagatgaaaagcgccgctcgggatgctgccgcaaaaatcgtccgcaagctcggatttaaaggcattatgaacattcaatttatagcggattcggatgagctgctcatccttgaagtcaatccgagggcgagccggacggttccggttgtcagcaaggtgatgggagttccgatgatcccgcttgcggcgaaactgttagccggttcgtcactcaaagaactgaagcccgccgccaaaaattcacgcggcgttgccgtgaagtttccggtcttttcatcgcacgccattcaagatgtcgatttgaagcttgggccggaaatgaaatcgaccggtgaaggcatgtatgtcggcttcaatccggaaagcgccctgaagaaaatctttgcaggaatctggcaaacgaaaggctgcatttacatggaaggagccggcgagctccgttctctcgcagaacaggcgggcttcaccgtacagtcggacgattttccgggctggatcaaacggaaggacaaagcgctgcacatccatttagccgagtcaaaagaggcgagaaagcagaggatagaagccgtcactcacggcgtggcggtgatgacggaagaagagacggtgcgggcatttttgacgagcgggcatggaacgactaaagccgtgtcgcttaaagatttatataaaaaggaagtggagacatgtctactgtaaacatcggggcgacccgggagatcaatctgtcaggcaaggatttcttaagcctgaaagacttttcaaaagaggagatcgtctatttgctgaaagaggcagcggcaatgaagcgaaataaaattcaagacatctttaaaggaaaaacattggcgatgatctttgaaaaatcgtcgacgagaacgcgcgtatcgtttgaagccggaatggcgcagctcggcggaaacgccctgtttttaagcagtaaagacatgcagctgggcagaggggaaacgatcgcagataccgcgaaagtgctttcgcgatatgtggacgcgattatgatccgcacattcgaacacgaaaaagtcgaagagcttgccaagcacgccgagattcccgtgatcaacggattgaccgatctttttcatccgtgtcaagcgcttagtgacctattaacgattcaagagatgaaaggaacattaaaagggctgaaagccgtttatgttggcgacggaaacaatgtcgcgcattcgctgttaatcggctgcgcgaaagtgggatgcgacattacggtggcttcacccaaagggtatgagccgaatcaggacgtggtgaaactggccgagacattcgccgaagaatccggtgcggccgtcacgatcacaaatgatcccgtgtcagccgttcaacaagcggatgtcatctattctgatgtttttacaagcatgggacaggaggaggaagccgaagaacggatgaagatttttgctccttaccaagtcaacggaacgcttgtctcccatgccaagcctgattacatctttctgcactgccttcctgcccaccgggaggaagaggtcaccgcagagatcattgacggtccgaattcagcggtatttcagcaggctgaaaaccgcctgcacgtccaaaaagctttattaaaagcactgttatcttaaatgaaaaacagctgatccattgatcagctgtttttaggcgaatatcaaaacggcgatgccgatgacaaagcagtaaatcgagaaataaaccaagtttcctttcgccataatattcatgaaccagcgcaatgagaagtatgtagctataacagatgcgatgaacgcgaataaataaggaagaaaaagctctcctaaacgcggatcatgaaaaatatcggtaatgcttaaaatggttccgccaaggctgaccggtatgtaaagcaaaaatgaaaacctgagcgcggtttcagatttgaggccgagcgccatcgcaggaacgatcgtcgctcccgaacggctgatgccgggaacaagtgcaaccatttgcgaaaagccgatgatcacggcgtctctcagcctgatttcgccgtcgcttttccggccgcgcaaatttcgaataagaaacaatgccagacccgtaataagcaaagtaaccgcggtgatccggacgccgtctttaaagaaagccgaaatctcatcatcaaataaaacgccgatgacaccggcaggaatcgtggcgatgatcagatagatgataaacctgaagtccgcttttcctttttcattttttgttgtgacataagacagcccgtttaccgccagcctgaaaatatcgtttttataaacgagcagtacggcaattaaagaaccggcattcatcaaaagctcaaaactgaagccttcaatattcaagcccaaaaagtgctgtgccagcaccaaatggccgcttgacgaaacagggatcggctctgtgaatccctgaagcaaccctaaaaggatatacttgatcaacactaaaaaatccatgatactcctccgtttcccacaagttgtgatgcccttttaacagacggaatgtacaggcggttcgtttcaattttcagaacgcttttctcattaaactacacaaagcaaacagatgtaaagataaaatcgacatgttttttgagaaattggggcaatctaatggtaaaagggagtgaagcaaatgggacagcagcgtcaattccggccgggccaaaaagcgcccaataatggagtgtatgtggaaatcggcgaaacgggaagcatggttcagaaccctcagcaaatcaaattgagcgccggcgagttcttccctgaaacctccaatcataaccggctctggacatataaaagaaagccttaaaaaaacagccgtcggttttctgccggctgtctgtctaaagcaaaaaaccccacttttagaagccggggttttaatgttgacttgcatcctgtttaacaggcataatttctccaagaacaataacggctgcggtgatgataaagcccataatgacactggtttgaaggtcatacccagcaccgttcatggcgccgacaatgtagcaggccatctgcgtcaaaagaaatgtccagaaaaaagcgaccacaaatcgcacgtttcccacctcgtccttctcattcaattctaaaacttatcataccatatacatagccggctggaaaagacattttagtgaacaagacagggctttcaactctgctttcagaaatatcagaaagggtatttcattaaagtttacttttcatcatgaagactgggacttttccttattcgtttgctgcacgtacgacataaaataatgagcagattacggcaggaaggaggcgggcaagtgatgaaaataaccgaacgtttttttcaaatggattcagaatggaacgtggttcatcttccgtacaagccgaacggttttctggtgttcattttcggcgaccggaaccattttgtcggggaagattcgagcttctggcttcagcattacggacgaaatcagcttctaacgagcctgagaaacaaaggctataccctggtaaacagcaatttattcggcaggcactggggctccgaaaaagcggttgcatacgcgaaacagctgattcattacgtgttcaaacaagagatattaaatgaaaaaattcatctattggcggaaggcacaggggccctcattgcagatgagctccttcgctcaatcccgaaccaaatacgttctacagcgatggttaatccttgcctcgatcttcaggctcatcataaacgagaaaaagaaaacaagtttttctacaaacagtttattaaagaaattgccgaaagctacggaattacggagcgggaggcagccgattatccgttcaaaagcatatccccttatcacaatctcgtacccgttcatatttggcaaagactgaacgggtcaccgtatccgtatatgatccatgccaaaacgtttgaggagcgccagcttaaaggccgtcacagcgtggggcttaccctgcacctgtccgaacatcctcagcgcattcattcagcaatcgcgaactttttcaaaacgcatgaaaaagtcttatagagaatagaataatagcagcccgaaaatgatgaaaagggctgttttttgcttggttaaaaaagctgaaacgaaaggtggtccatcgaatgaagccggcacttgtatatggagcagatgagttcttcggcctttcattttgtgaacatctacttgaagagggtgttgacatagatgtaaagctggaacagacaagcgacgaaaaaaagctgatgtacctcgaagagcggctgatgtggctgggaagaaacgagcatttccgtctcatcgaaaaagagcttgaagccccgtacgaacaagtcttcatccaatacacaggctcagtgccggaagaagcgctggctgcaggcgttgaaaacaagcctgttattctgtttgtctaccaggaacaattggaagaggatttacgcgccggcatggaggaaaagggtgttgaactgatcgtgcttccggatctgttcggtccgtgggacgtcagggcagaggataaacaaaacagggacggagcgctttttgtgaacgacgcggccgcacaagccgctgcctgtgctgttgaaaaagatttttcagatttgcagtttgtacagaagacgccatacgataaagccgatgagatcattgaagaatggatcagacaaatgtctacatttttcgacaaaaaataagaaagatcttcctaatttacacttgaaaggatacaataaagatagatttgaattgctgtttttcgaaagggagttgaacatggcatggtgtacaggcttgtcgcgatttttttcattctcctggcgctaagcggctgcggacaatcgccgctgaaagggaaaattgaaaaagtcggtttgcttgtccctgatacgataaatgaccaagtatggggaaccaaaggatataaaggattattaagaatacaatccgtctacaatgtcgacgtctattataaagagggaatcgataatgacgctgccattaaaatggctgtagaagattttcacaaaaaaggcgtcaacctcatctacgggcacggaagcgaatatgaaaaagcctttaatgagatatgcaaagattatcctgatattcattttgttttaatgaactcgaaagccgaccaccaaaatgtgacaagcatatcgcttgaaggagaagcgatggggttcttcggcggaatgacggcggcccatcagtcaaaaacaaagaaaatcggcgtgctcgcaacgtataaatggcagcctgaagtagaaggattttccgaaggggctaaatacctcgatccggacattgaggtgatgacagaatatgtcggccagtgggacgacagcgaaaatgccgtcaaactgtatgaaaaaatgaagaaggcaggcgcggatgttgtgtatccggccggagacgggtataatgtccctgtcattgaacaaatcaaaaaggacgggctgtacgctatcggctatgtaagcgaccagtcggaattgggtgagaatgtcgttttgacaagcactatacagcatgtagatgacgcttatgaactcaccgccgacgagtttaataaaggaacgcttaaaggcggcaagcgctcatttgacattcaagacggcgtcatcgaaatgggagaattcagccctgttgtcgatcagtcatttcaagaaaagatgaatcggctgattgacgaatacaaaaaaacaaacaaactgccaaacgaacattgaggtgatcaagatgcacgaaaaatcaatggaatttttgcaaattgccatgaagtacgttccggaagcgaaagcagagatggagaaagcgggaatcgaactttccccggaaatgcttgagccattcatgaacttgtttacgaaagtgatggccgaggcttacgagctcggtaaagcggaagccggttcagacgcctgacttaaacgcccgcaaacgcttaaaaagccacttttcagaagaagtggcttttttatatggaaatcttatttttcaaagcgctgaccattgagccgatttctttaaacacaggcttcagctcatcgagcgaatccataatttctccaacctgattcaacacgtgcatataatcggcttcttgggatacttcagcgtcttcggcggtttccgcttccgcatccgtctccgtctcttcatgcctggcgggtgcatttgagccaaacatcatttttgtgaaaaaatcgtcgttcgccactcttcattccctcctttttcatatatatcactactatatgaaggttttggtctgctagattagacgaatatattgccaactaaaaaaaaatagggtaggattagtaccagatactaataattactcataacattagttggaaaaaatcatgaataaaggagtctttcctatgaaagctggaattattggaatcggccggtacatccctgaaaaggtgctgaccaatttcgacttggaaaaaatggttgaaacttctgacgagtggattcgtacaagaacaggcatagaagaaagaagaatcgcagccgaagatgagaaaacgtccgatatggctgtggccgccgcaagaagagcgatggaagatgcaaacatcgagccggaagatcttgatatgattctcgtcgccaccgttactcctgatcaggcattcccgacagtgtcctgcatgattcaagaaaagctcggtgcattcaatgcctgtgcaatggatatcagcgcagcgtgcgccggttttatgtacggcttagtcactggaaaacagtttatcgaagccggcacatataagcatgtgcttgtcatcggagttgaaaagctttcaggcattacggactgggatgaccgcaataccgccgttctgttcggagacggtgcgggcgccgcggttgtcggccctgtcagcgacgataaagggattctgtcctttgaactaggtgcagacggcagaggcggaaaacacttgtacttggatgaaaaagatcatacaatcatgaatggcagagaagtgttcaagtttgccgtccgccaaatgggtgaatccagtgtaaatgttattgaaaaagcgggattatccaaagaggatgtcgactttttggtgccgcaccaagccaacatccggatcatggaagcggcgcgcgaacgtttggagcttccggtcgaaaaaatgtcgaaaacggttcataaatacggaaacacatcagctgcttctattccgatttctcttgtggaagagcttgaagctggtaaaataaaagacggtgacgtcattgtgatggtcggcttcggcggaggtttgacatggggagccatcgccatgcgctggggccgctaaaagaaaggtgaggtgcaacttatgaatagtaaaagagtagtcattaccggattaggagctttatcacctcttggtaatgacgtcaaaacaagctggaacaacgcgatcaacggggtttccggagtcggcccgataacaagggtgaacgcggacgagtatcctgctaaagtagccgcagaactgaaagattttaagatagaagattatatggataaaaaagaagcgagaaaaatggaccgcttcacacaatatgccgttgtgtcggcgaaaatggccgtggaagacgcgggcctcgacattaacgaaagcaacgcagaccggatcggcgtctgggtcggttccggaatcggcggccttgaaacgcttgaacagcagttcgaaacatttttaacaaaaggaccgcggcgcgtcagcccgttctttgtaccgatgatgattcctgatatggcgaccggccagatttcgatctctctcggtgcaaaaggggtcaactcttgtacggtgacggcttgcgcgacgggtacaaactcaatcggcgacgctttcaaggtcattcagcgcggcgatgccgatgtcatgatctccggaggaacggaagccccgcttacaagaatgtcatttgccggcttttcagccaataaagcgctatccactaatccggatccgaaaacggcaagccgtccgtttgacaaaaaccgcgacggcttcgtcatgggagaaggagctggaatcgtcgttcttgaggagcttgagcacgccttaaaccgcggagcgacaatctacgcggaagtggtcggctacggatcaacgggagacgcctatcatattacggcacctgcgccaaatggagaaggcggcgtcagagccatgaaagaagcgatcaaagatgcgggtctgtcccctgtggacattgattatatcaatgctcatggaacaagcacgccgtacaatgataaatttgaaacgatcgccattaaagaagtgttcggagagcatgcctacaagcttgccgtcagctcgacaaaatcgatgacagggcacttgctcggggctgccggaggcatcgaagcgattttctccgtccttgccattaaggaaggcatcattcctccgacaatcaatatcgaaacgcctgatgaagattgcgatctggactatgtaccggatcaagcccgccgccaggacgtgaatgttgtgctcagcaactcgcttggtttcggcggacacaacgcaacgctgatcttcaaaaaatatgaataacccgcaatataaacggctgccattttaaatggtggccgttttttttagcgtgcataccatacagatgaaaaaggagtgtgatctaaaatgagtatagcaagcacgtatgaatggcttgaacaggcttcatccgtgcgggaattgccaagctttctcctgccgtattttaaaggcgcttcaaaagcggatgcggcggcgattgtcagccacctgcagatccacggcttgttccgttcgtggacggacggcgaacgtacgatgaagcagcttaaggaaaacggcgtatttcagcatgtcagacgggaagaacagctgctctgcaaaagatggaacgggccggatgttccgattttcatcctgccggtcgatgaaagaaaccgcaaaatccgcgtcgaattcggctcgaaatcaggcctcgcgttcagcgacaaattatttttgtttttatcggccgatcttccccggtcttcaatttctgcgatcatgacacacgaatataatcacgtttgccggttagaaaatatgccgaaagaagaaaaaaagatgacgctgcttgatacaatcattctcgaaggccttgcagaatatgccgttttcgaacggctgggagaagccgaaacagccgcatggacgtcatattactccgaaaagcagcttcgtcatttccaggaccggttcgtaaagcctcatttcgacctgcgccgacacgatggccggctattctccaatattttatttggaaaaggacattaccctgacatgctcggatatgctgtcggttacagtattgtgaaaaaatatttatcggctcgaaaattgaaggttgccgatgttttagcctttccgtcagaagactttataaagctatcgctttaaaatactaaaattatgggattaaattaatattattacaaaaaatcaaaaaactccttgcttttgtaatgattatgtaataatatacaactataaaattttaagataattcagtcatattaagaaaattctaaaaaagtaatatattagttttttgtgatatttaacttctggtctatggaaggggaatctggatgagcgcattgctggaagtcaatgatttaaaaacttatttttttaggaaaaaacagccgatacctgcagtggacggcgtcgatttttcaattaaaaaaggggaaaccgttgcgctggtcggtgaatcgggatccggtaaaagcattacctctttgtcaatcatgggactggtcgagggctcgggcggaaagatcatgagcggctctatcaagctcgaaggacaggatctcgttacatacaaagaacaagatttatgcaagatccgcggaaatgaaatctccatgatttttcaggaaccgatgacctcgctcaatccggttttgacgatcggcgaacaaatcacagaagtgctgatctatcataaaaagctatcgaaaaaagaagccgccaaaaaagcggtagaattattaaagcttgtcggattttcaagagccggcgagctgatgaaagagtatccgcaccgcctgtcgggcggcatgaggcagagggtcatgatcgccattgccttaagctgcaatccgaagctgctgatcgcggatgaaccgacgacagcgcttgacgtcaccattcaagcccaagtgctggaactgatgaaagacctatgcgacaaattcgatacctccatacttctcattacccacgatctcggcgttgtgtccgaaattgcggaccgcgtgatcgtcatgtattgcggacaagttgttgaaaatgccacagtagacgagctattcgacgaacccctgcatccctatacaaaaggactgttaaactccatccctgtcattgaaggctccattgaaaaattaacagccattaaaggaaatgtgccgacgcctgacaaccttcctgccggctgccggttcgctccaaggtgtccgagcgcggtcgacaaatgctggggggcgcagccagacttgaaaacgcgtccggacggccggtctgtcagatgttttttatatgaggagggagaataagggatgacttcatcagctgaacaattacagcccggacaggaaatgaacccgcaagaatcccttctggagctgaaagacgtcaaaaagtactttccgatccgctcagggatttttcagaaaaaaatcggcgatgtcaaagcggtggacggcatcagcttttcgcttaaacgcggcgaaacgctcggcattgtcggtgaatcgggctgcggaaagtcgaccgccggacggacgatgatccgcctttataaaccgacggcagggcagattttttacaaaggccgcgacatttcaagtttgtcggaagaagctttgagaaaaagcgtccgcaaaaacatccagatggttttccaagatccgtttgcctcactgaacccgagaaaaacgctgcgttccatcatcaaagaacccttcaacacgcatcatatgtacaatttcaaagagcgcaacgaaaaagccgaagagcttttagccaaggtcgggctgcacccgtcgtttgcgaaccgctatccccacgaattttccggggggcagcgccagcggatcggaatcgcgcgggcgctggctttaaatccggagcttattatcgccgatgaaccggtatccgcattggacgtgtcaatccaggctcaagtgatcaacctgatggaagagcttcaggaagaattcaatctgacatatttgttcatttcccatgacttgagcgtcgtccgccatatcagcgacagggtcggcgtcatgtatctcggcaaaatgatggagctgacagacaagcatgagctgtacggcaacccgcttcatccatacacgcaggcgcttctgtccgccgttcccgtcactaggaagaaaggcggaacaaagcgggagcgaatcgttttaaaaggcgagctgccgagtcccgccaaccctccgaaaggctgtgtctttcatacgaggtgtccggccgcaaaagcgatttgcgcggaagccgaacctgctttcaaggaagtgaaaacaaaccatttcgtggcatgtcacctttacgaataaaggggaaggccgtcacatattaaatccttgagagggggaatgtcttctttaaaaaacgggggtcaatcgggtggaaagaaggacaacagtttaataagggggaattcataaaatgaataaacgcaaaacaggattttcaattttaagcttgctgctgatcttatcgatttttctaacggcctgcaacagcggcgaagtcggaggggatgaaaaagaaggcaaatctgacgggaagccgcagcagggcggagatctgattgctggatccacaggtgaaccgacgctgtttaattcactgtattcaactgatacagcaagttcagatattgaaagactgatctacaacactttgttagacgttaatgagaaacttgaagtggaaaaccaactcgctgatgaagtaaaggaatcggaggatgggttaacattcgatgtgaagctaaaagaaggtgtcaagtttcacgacggtgaagaaatgacagccgacgatgtcgtttttacttacagcattccgatgagtgatgaatacgttggagaacgcggctcaaactttaaaatgatagagtctgtcacgaaaaaaggtaaatatgaagtgcagtttaaattaaagaagcaggatccgtatttttacaatgttacacttgccagttacggtattctgcctaagcacattttaaaagatgtcccaatcagcaaactcggtgaacacgaattcaatcgaaagaatccgattggaacaggaccgtttaaatttaaagaatggaaagaaggacaatatgtaaaggttgaggcttttgatgattattatgccgggcgtcctcatttagattcgatcacgtataaaattattccggattcaaatgcagcgctgtcacagctgcaagctggagatgtcgattacttggtcgttacaccaggaccagactataaaacggccgagaaatttaacaatgtgaagatggaaaccgatttaggtttgaattatacgtatatcggctggaacgaaagaaatgagctgtttaaggataaaaaggttcgccaagcgctgacacatgcgcttgaccgccaggcgctcgttgaccaagttctagatggagatggggaaatcgcgaacatcccggaaagcccgctttcatggaactacccggataacaaagataagtttaaaacgtttgaatacgatccagagaaagcaaaaaaactgctcaaagaagcaggatggacagactcagatggtgatgggattttagataaggacggcaaaaagttttctttcgttattaaaacgaaccaaggaaacaaaacacgggaagacctcgcggttgttgttcagcagcaattaaaagaaattgggattcaagcaaaaccgcagattgttgaatggagtgctttaattgaacaaatgaacccgccgaattgggattttgatgcgatgatcatgggctggagccttgctacgttccctgatcagagcaacattttccattcgaaagaagctgaaaaaggactaaactatgtttggtatcaaaatgaaaagcttgataaactgctggatgaagctaaaacgttgaaggaccgtgaagaatataaaaaggcgtatgaagatatttacgaaattctggcggaagatcagccgtatacattcttgtattatacgaattaccatagagcgatgcctaaaaatatgaaaggctacgtattccatccgaaagaagatttctataaagccgaagactggtggctggatcaaaaataacgagaatcccttgagggaagtgtagcttgcagcttccttcccttccttcttaatgacttttaaaaaaggggataaaaaatgattacatatatcattcgaaggacgctcatgtcgattccaatattatttggtattacaattttgtcatttgcgattatgaaagcagcgccgggagatccaatggcattgatgatggatccgaccatcagcgcgggagaccgtgaaaaattcattgaaaaatacgggttggatgaacctgaacacgttcaatatttaaagtggctcggaaatatggttcaaggtgacttcggtacttcaatcgttagaaaaggaacgccagtgactgatttgattatggcgaggctgccgaatacgttattgttaatgctcgtttcaaccattttggctctcctcatatcgatcccgcttggagtgctttcagctaggcggccatattctaaattggattatggcatcacattcacatcatttatcggtcttgctgtcccaaatttttggcttggactgattctaatcatgtttcttgctgttaatttaggatggtttccaaccgggggcgttatgactctgaatgccgattttagtttatgggatcgcattcatcatctaattttgcctgcattcgtcctggcgaccgcagatatggcgggactcacccgctacacgagatcgagcatgcttgatgtgctcaggcaagactacatgcggacagcgagagcaaagggttttaaagaaaatcgtgtcgtgtacaagcatgggcttcgaaatggtttgcttccggttattacgatctttggtctgatgattccttctttcatcggcggagctgtcgttactgaacagattttcagttggccaggacttggaaagctgtttgtcgactctgctttccagagggactatcctgtcattatggcaatgacggttatttcagccacacttgttgtcattgggaatttagttgcggatattctttatgcaatggtcgatccgcggattgagtattaatgaaggagggaattgattcatgacacagacaaatccatcgacaccttcgccggagatcacattgcaggaaaatgtcgcaccaaagcccgagacaatgacaaaaatcttttttgaaaagttttataaaaacaagctggcggtaattggaggagttttattatttattattatcctatcagcgatttttgctccggtgatcgctccatacccgccggaacagcaaaaccttctgaataagctaaaaccgccaagtggtgaacatctaatgggaacagacaagtttggccgagatattttcagccgtttactttatggggctcgggtttctttacttgtaggctttgcctctgtacttggatcgattacgataggtacggtggtcggcgcaatcgccggctactttggcggaataatcgacgctattatgatgagactggtggatattgtattatccatacccgacatctttctgttaatcacgctggtcaccatcttccagccgggcatagataaactgattttaatattcgccttgacgagatggacgacgacagcgcgccttgtccggagcgagtttttgtccttgaggtcgagggagttcgtcttggcggcgaaaacgatcggtacaagaaattacaaaatcattttttctcatatccttccgaatgcgatggggccgattatcgttgccgcgacgctttccgtcggtaccgtaatccttgcggaatcggcattaagctatcttggattcggggttcagccgccgatggcaagctggggaaacatgcttcaggatgcacagaactttacgatcatgatccaggcgtggtggtatccgctgttcccgggcctgatgatcctgctcactgtgctgtgctttaacttcttaggcgacggactccgcgatgcgcttgatccgaagaatattaaatgatttatgcagtgtattacagaggaaatattttaacaaaatggaaggtcaatagatttagtttcaatgaatgtatgtagtggacattgaacgaatgtttcctgttagtcgataaagaacactttcataaatgaggtaccaaagggaatatcattcgtaaatctttggtatctcactttgttcaaacagaagcaggtcttccaactcctgaagatcttttggaactgttagatgaacaaatgggcgctgtagcaaaaaaataaatcgctttgttaaatgaatagaggttttaacgatgttaagcgtattgaaaaataaaaactttttatttttgatattagggcgtttggtaaccaatattggggacagtatgtatacagttgcggcaatgtggcttgtgtttgatttatcaaaaagtacattttattccggattagctggttttttgacgatgttcccaactgttttgcaatttttaacaggtccgattgttgataaagtcagattaaataaagttttggtttggagtcaactcatccaagctattttggtgttgattattccgcttttttatttcattggatatttgaacatttggatcatcatgatgattatgcctcttatcgtattcattgagcaatttacttatcctgcgcaatctgccgcactgcctaaaataatcaaaagtcaagatctagttaaagcaaactcacttatgtcattttcatatcaaggtacagatattatatttactggtattgcaggtattgtgattgcttcggcaggagctataagcatatacttagttgactctttcacttttttgttagcggcgctgttttttaagtgcgtaaaattagaacaaaaaaatgagatagaacataagccccgattccacttcaaaaaagtcatacacaattatacaacggatataaaagagggatttacactcattcgtcattccctcattccaaaaatcctcttgggctcgatgatttctaacttcatgcttagtgcgacgattgtgattttgccaagcttctcttcgattagaggaggagaagaatactatggatattatttggcttccatgtcatgcggtttactgttaggttcaatattcgcaacagtgtttggccgattcgcgataggatcacttacgatatacggatttttcatttcaggggttttatggagtatttcggcgatcgccacctcttcatacatatcgattattttatttggtttgtctcaaatatccatcggcgtgacaaacgtcattttcatgtccattttgcaaagcatactgccggaagagtttatagggagagttttttcttttatcgcaagtttgacaagcatagcagctccttttggatctttgctgggagggtttaccgcgtcattgatcggcagcgataaggttttctttataggaggaattgccatgctgtttgtatctgtttattgggtgtttcagtcttctttaagatcaattccttcatcagaaaaaataaacgctaaagaatacagcttttttacaaacgtgttgaataaataatgtgtgaattgcttcattcagtcatcatgattttgcccattgtctggactccgcgatgcgcttgatccgaagaatatgaaataaaaagctgagggattgccgcccttggctttttttttaacggcgattgccataatctcatccgcttggaataaattcctgcccccttgcctatactgtggacaacagtttttattaaaagtgaggggttagaaatgttgtttcttcatgatgtgtgggtgaattggtttgagggagaagaaaatggctacaacgtctgccactttcatgaatggcggaaggaagacagtgttgaattgcttgaccaggtgcctttgttaagggtgtcgtccgttttgtttcactacatagaaaatgatttgtcagagcttccggccgaattattgaacgaggttcatcaaaaagcgtatattcgtaaaaatcatgagcggacacagcttgatcattgtttcgtcgtaacggacggcattggtattctcgcggtcgatacggccggttacacaataccggtaagaaaaagccgcctcattccgagacaggagcagctcgtttatgaaatggtgaaggacgttgaagcggaaacttacgagtttgcaccagagaagctgcaatcttccaaagaataccacattttatctttatcaccggagcatgtcagaggattaacgagaaaagaacgccagctcaaacagctgctgttcatggcgctcgatcagctcaaagggctccaaaatcgggccgagatcgcttattggtacaccgaatggaatccgtatatgtatgaacagatcaagcgcatgacatttgaagaaatctgggacatgcttttcaatgagacgatcgacggatggtcagacaaacacagggacttttgtgaaaatttgattaaaggacagccgttttttgaaaagctttgggaaattgagaatgagtctaaagtcaactaaattaagaatcaagactgccggaagtacggcggtctttttatttgtaaaagcgaaaattctatattgaaaaataaaaaatatgagctgtctttctgacaaagcggtcaatgaaggactggagacatgtgttttgaatcatttattatagaaatatcgtgatccggaggcaagtgaatgcggagctgcggctgttctctatgaaaaacaccttccgattatcgtacaatcggaaggtgtttttggatcagcgtctttttcggccgagtcccatcgcgttttccattttttttagcatcttgtttgctgtttgatttgcgcgttcggcgccttcgtccaaaatccggtccagctcttcagattcgatcaattcgtggtaacggtcttgaatcggtttcagcgcgccgatgacgacttcggcaaggtctgatttaaattcgccgtagcctttgccttcgtattttgcttcaagctcttcgattgaggcttgtccgagaatcgaatagatcgtcagaaggttggatacaccgggtttgttttctttatcatatttgacgattccgtcggaatccgtgacagcgcttttgatttttttctcaagctgttttggttcgtcgagcagggtgatgaacgctttttggttcggatctgatttgctcatctttttgagcgggtcggcaagtgacataatgcgggcgccgaccttcggtattttaacctccggaaccgtaaaaatgtcattatatttcttattgaaacgctccgccaagttccgggttaattcaagatgctgcttctgatcttctccgacagggacgacgtctgttccataaagcagaatgtccgcagccattaatggaggatatgtcaaaagcccggagacgacagcttcttttccggctgatttatctttgtactgcgtcatgcgctcaagctcgccgatgtaggcgacacactgaagcatccatcccgcctgggcgtgtgcaggcacttccgattggataaacagcgtcgcttttttcggatcgaggccgatcgccaaatacagcgcggcaaggttccggatgttctttctcagcgcgagccggtcctgcggtactgtgatcgcgtgctgatcgacgatgcagaagtaacagttgtagtcatcctgcaagtcgacaaactgcttcatcgctccgatatagttgccgagggtgacagagccgctcggctggataccggaaaaaatcgtttttttcatgtgaatccctctttccatttcaaaataaaaaggcccattcttcccttaaaagaaaagggacgaatgaaccgtggtgccaccctgattatttcattatggtcaaaatgaaatcgctttagacgtttgtaacggagtcttctccggctgagcctacttatccgtgttcggtcagctgctccgaagcccattccacattcgccattatccgctcccagcaccgcggactctctttaaatgggaagaaatgtgtactcttcttcttcatcgcatgttattcataattttattatatataaattttaaatgaaagtcgacagccttggggaaaagaaaacgaataccgggctgaataaagttggcgcggcggcatctggttcgatataaagaatggttaatgttatacgtgtaaaacgttttaacctgtaaaacataaactttccttttaatgtggttacgctttaaaacagagaagtgtatttgtacatttggcagaaaacctgacaatcataaatagtttgaataaaaaaataattgaaaattaatattgcaataaattattctattaattataatgaatttgttcacctcggggttacaggtttcttacataacaaatattcagaaaagacgaaacagaggaaaaagtatggcaagtgggcctattacttttttatgataaatctgaatgttcaggagtaaggaactaaaaaaacaagaaattggggggtttctcttgaagaagcgtttgtcatttatcagtttaatgctcattttcacactcgtcctcagcgcctgcggcttcggctcaagctccggtgacggcggtaaaaaagacagcaaagggaaagacacattaaatgtcaacattaaaacagaaccgttttcactacatccgggactcgcaaacgattcggtgtctgcaaacgtgcttcgtcagacttttgaaggattgacgacaatcggtaaagatggaaagccggttgaagcggcagccgaaaaaatcgaagtcagcgacgaccaaaaaacatacacattcacgctccgcgacgcgaaatggtcaaatggagatcctgtaacagcagaggattttgaatacgcatggaaatgggcgctcgaccctaaaaacgaatcgcaatatgcgtatcagctttactacttaaaaggcggagaagcagcgaacaccggcaaagggaaaattgaagatgtcggcgttaaagctgttaatgataagactttaaaagtcgagcttgaaaaaccgacaccgtattttactgaactgacagcattctacacatatatgccagtcaataaaaaggtagcagagaagaatgcgaaatggtacacaaacgcagatgagaactacgtatctaacggacctttcaaaatggcgaaatggaagcacagcggaaacatcgtactggagaaaaacgaccagtactgggataaagacgctgttaagctgaagaaaatcaatatggcgatggtcaacgatccgaacactggtctgaacatgtacaaaaaaggcgagctagactttgtaggacagccgcttgaccagatttcaacggatgcgattccaagcctgaaaaaagaaggcctgaacattgatccgttcgcatcggtttacctgtacaaattcaacactgaagcggctccgctgaacaatgtcaacatccgtaaggcgctgacatacgcgatcaaccgcgaagcgatcgtcaaaaacatcacgcaagcggaacagctgcctgcgatgggattagtgccgccggcggtccacggctttgaatccaacaaaggctatttcaaagaccatgatgtcgataaggcgaaagaacacttggaaaaaggcttgaaagagctcggtttgaaaaaagcgtcagaccttccgaaaatcacgctttcctacaacacggatgaagcgcaccaaaaaatcgctcaagccgttcaggaaatgtggaacaaggaactgggcgtagatgtggaattaggcaatgaagaatggaacgtttacatcgataagctccatgccggaaactatcaaatcggccgtttaggctggaccgccgactttaacgacgggatgaacttccttgaaacataccgcgacaaagaaggcggaaacaatgatacgaactgggaaaacgcgaagtataaagagctgctgaataaagcatcaagagaaactgattcagcgaaacgcatcgagctgatgaaagaagcggaaagcatcatcatggatgagctgccggtcgcaccgatctacttctacacaatgccgtatcttcatgatgaaagcttaaaagactttgttctgaccggtacaggtgagatctatttcaaaaccgcgcattttgaataaaattgcatgaaagtatatggggcttagactttccccccatatacttttatttatgaaaagaagttaatagactgaatattcggaggtgtgtaaaattgattaaatatttaggccgtcgtcttgtttatatgttaatttctctctgggttatcgtaacagctaccttcttcctgatgagagcgataccgggcggacccttttcaggcgagaggaaacttccccctgcaattgaagccagtctcaattcctactatggtttagaccagcctctttttaaacaatatctcgattatttagtatcggtagcaaagtgggatttcgggccgtcatttaaatataagggacaaactgtgaacgacttgatcagctcagggttcccgatttcttttacactcggattggaagcgatttgccttgcgctcgctttcggcgtattgttcggcgtgatcgccgcgctgaagcgaaacaagtggcaggactacacagcgatgatcattgcggttgtcgggatctctgtgccgaacttcatcatggccgcgcttctccaatacgtgctggcaatgaagctgggcatgtttcctgtcgcgcaatgggagtcatggggacatactgtgcttcctgcaatcgctgttgcctcgatgccgatggcgtttatcgcccgtttgacgcgctccagcatgcttgaagtgttgagcagcgactatatccgcacggcgcgtgcaaaaggtttgagcacatcagccgttacgtttaagcatgcgatacgaaatgccatcatgccggttgttacatatatgggcccaatggcggcgtccattttgacaggaacgtttgtcgtcgaaaaagtcttcggtataccaggactcggcatgcactttgtcacaagcattacgaaccgagactatacggtgatcatgggcgttaccgtcttcttcggggcaatcttgctgctttgcgtcttgattgtcgatcttttatacggcttaattgatccgcgcattaaattgtttggcgctaagaaaggggagtaagaggatgcagcaaataccaaaagacatgtttgaacctgcagctgttgaccatagcgaagccgaaaagatctcaaagaaaaacctttctttttggacagacgtattcttgagatttaaagaaaacaagctggcgctgtttggactggtggttctgatcctgatcgctctgatggctatcttcgcgccggtgttctcaagctttcaatatgaagaaacagatttaacgaatgcgaaccagccgccaagcggtgagcactggtttggaacagatgaccttggaagggacgtattcgtccgtacatgggtcggcgcccgcatctcgctgacaatcggactcgctgctgcgctgatcgacgttttgatcggtgtgatatggggtgcgatttccggcatcagaggcggacgtacggatgaaattatgatgagaatagcagatattttatgggcgattccttctttattaatgaccatcctgctgctcgttgttatgggaaaaggcctgatcacgatgatcgtggcgatggttattacgggctggatcaacatggcgagaatcgtccggggccaagtactccagcttaaaaatcaggagttcgtactcgcctcaagaacattgggagcgaaaaactcgcgcattatcagaaagcacctgctgcccaacatcatgagcccgatcttggtcaccatgacattaaccgttcctacggctattttctatgaggcgtttttaagctacctcggcctcggggttccgcagccgcttgcaagctggggaacgatggcaacagacggtgttcagggattggaatactacccttggcgcctgttcttcccggctacttttatctgtctgaccatgtttgcattcaacgttatcggcgacggactgcgcgacgctttagatccgaagctgcgtaaataaaggagtgagaaagatgaaacacttacttgaagtgaaagatttagccatttcttttaaaacatacgccggagaagtacaggcgatccgcggcgtcaactttcatgttgacaaaggagagacgcttgcgatcgtcggtgaatccggatcaggtaaaagcgtcacttcacaggcaattatgaaactgattccgatgccgccgggctattttaaaaacggacaaatcttatttgacggacaagacctggttccgaaaacggaaaaagagatgcagtcgatcaggggaaaagagatcggcatgatctttcaggatccgatgacttctttgaaccctacaatgaaagtcggccgccaaatcacagaagtgctgtttaagcatgaaaaaatctcaaaagaagaggccaataagcgggcggtagagcttctcagccttgtcggaattccgatgcctgaacgccgcgtcaaccagtatccgcacgaattcagcggcgggatgcggcagcgcgtcgtcatcgcaatggcgcttgcggccaatccaaagcttttaattgcggacgaaccgacaacggctcttgatgtgacgattcaggcgcagattttagagctgatgaaagacctgcagaaaaagatcgagacatccatcatttttattacgcacgatctcggcgttgtcgcgaacgtcgccgacagagtcgccgtcatgtacgcgggacagattgtggagatcggtacggtcgacgagattttctacaatccgaagcatccgtatacatgggggctgctggcttcaatgccgagccttgacaatgacggtgatgaggaattaatggcgataccgggctctccgccggatttgaccaatccgccgaagggcgatgcctttgcgttaagaagcccgtacgcaatgaaaatcgattttgaacaggagccgccgatgtttaaaatatctgatacacattatgtgaagtcatggcttttgcatccggatgctccaaaagtcgagcctccggcggctgtcaaaagcaagatgaaggagtttaaaaatcagtatgaaaaaccggttcaagtgaaagaaggtgaatgacatggcagaaaaactgctcgaaatcaagaatttaaaacagcacttttcaacgccgaaagggattgtaaaagctgttgacggaatctcttttgacatttacaaaggggaaacgctcggtcttgtcggagagtccggctgcggaaagtcgacgaccggccgttcgatcattcgtttgtatcaagcgacttccggagaagtcttgtttaagggaaagaatgtccacgacaaaaagtctgccaaggaccttctcgaattcaaccggaagatgcagatgatttttcaggacccgtatgcatccttgaatccgcggatgacggttgccgacatcatcgcagaaggtattgacatccacggtttggccaaaacgaaaaaagaacggcttgagcgcgttcatgaactcctcaatctcgtcggcttaaataaagaacacgcgaaccgctatccgcacgagttttccggcggacagcgccagcggattggaatcgcaagggcgctggcggtcgaaccggaattcatcattgccgatgaaccgatctctgcactggacgtgtccattcaggcgcaagtcgtcaatttaatgaaggatttgcaaaaggaaagaggactgacataccttttcatcgctcacgatctgtcgatggtcaaatatatcagcgacaggatcggcgtcatgtatttcgggaagcttgttgaattggcgccggcagatgaattgtatgaaaatccgcttcatccgtatacacaatcattgctttccgccattcctctgcctgatccggattatgagcgcacgcgcgtgcggaagacgtatgatccgtccgtccatcagctgaaaggcgacgaacagatggagctccgcgaagtaaagcccggccatttcgtcatgtgtacagaggaagaatttaaagcctatcaatccaaataaacgaagcaggaagacagccgtcacaaggctgtcttttttgatgcagaaccacagccggcaatttttttgagaaaaaatttgaaaccttagcgtaagacaaccgtcttagtatatgtaggtaacatgctcagcttcaatgaagctcctttctaaaaaagattttgtttaaactaaaaagaaagcgggtatatctaaagtgtgaaattagaacatccataaggagcaaatcaatgaactggtatgagaagcttagcgagtatttccctattgaagaaatgaaatcaaaagagcatatggaagcattgttaaaggaacaaaacgatatttaccataaagaagaaggccgtcatcatgtgttgatgtacgccgaattcgactcttttattttcatcgactatttattcgtttctaaagacgcacgaggacagggacttggatccaagctgattgagaagctgaaaaagaaaaacaaaccgatcctactcgaagttgagcccgtggatgaagatgatgccgatacggcgaaacgtcttaaattttatcaaaaggaaaactttaaacacgctgagtcgattggttaccgccgccggtcactcgcaaccggcaaagtgaacaaaatggagattctgtattggtctccaaaatcaaacacagagaaagaagtgtttgacgcgatgaaagaaacgtacgaaaaaatccatacatacaaagatgaaaaatggtatggagaatcttatgaagatgtggatgacgtccttacgattgttgacgatcataaacagaagaacattttcgatgaattaagctaaatgagaataagacctggcataaaaaagcaaaagtcgctggattgtcaaaaaatttctgttacagactgttcacacttacttttttatagtataatactcaataaagattacttttttagagttatttcaatttaagaatacgctaatttcattctactttttaaggagtgaagcaatatggttacattatatacatccccaagctgcacgtcttgcagaaaggcgcgcgcatggctagaagaacatgatattccgtttacggaaagaaatattttttcagagcctttatcaattgatgaaataaaagagattttacgaatgacggaggacggaacagacgaaattatttcaactcgttccaaagtgttccaaaagctgaacgtcaaccttgaaacaatgccgcttcaagagctgtaccagctcatcaatgaacatccgggccttttgcgccgtccgatcatcattgacgaaaagcgcctgcaggttggatacaacgaagacgaaatccgccgcttcctgccgcgcaaagtgcgcacattccagcttcgtgaagcgcagcgtcttgcaaactaaaagaaggctgaatttttcagccttcttttagttgtagacaaaatcgtttagattttgtcaacttttgattcagcgtgatccgaaaacctttgcagtctaggaaggccgagcatcggagcgcagcgaatgttggaattcgtgagcaccgacgcgcaggccctgacaacgaatgcgagggtttgtcggcacgctgagaaggctgaatttttcagccttctttttttaatgcttttcactcgtctgttcataataaatactggctaaaatcacaaaaataaccgtaaggacgggcagcagcatttcgagggtgctgtgctgcgccataaaggaagacaactcctgctccctgacgatcatttcgccgccagtataagccagcagtccgcttcctgcgtatattaagagcggaaatttggcaagagccgcttgaatcagcctgctgccccaaatgatgaccggaacggagaccatcaggccgacaacgacaagcatcaggcgtccgtgtgaggctccggcgaccgcaatcacattatcaagggacatgaacaagtcggcaatcacgatgatgcggatcgccttaaataaagatgtcccgcctttgacatgctgggcatcttttttctcaatcagaagctgatatcctaagtacaaaaggaagattcctccgataaattgcagataaggaaccgcgagcaggtatactgctgccatggttagcgcgattctcatcatgatggcgatcaatgtgccgatgatgatcgctttttgcctttgccggggaggcaaatgacggcttgccattgcaatcacaacagcgttgtcgccgccaagtatgagatcgattccgatgatcacaaggaacgacatcagtatatcgtgttccatccactggcacctcgctttgcctttgcatcgggacttgctaaaaaggcccccgcattaatagctgctgcttgtacaactaatatatgaagcgggccggaaaatatgttagcttgaccttggaggcgtttttatttcttttccgccttttttatcataaaatagaaaataaagattgatcagggataaggttaagaagtggacgtaatgggtaaagtgtagtaaagtacaattaattgggagcttagttatcccttcaacatcttacaaagaagggaaggttggcaaatggaaatcgaaagaataaacgaacacacggttaagttttatatttcctacggtgatatcgaagaccgcgggtttgacagagaagaaatttggtacaatcgagaacgcagtgaagagcttttttgggaaatgatggacgaagtgcacgaagaagaagagtttgccgttgaaggccccctttggattcaagtgcaggcccttgacaagggattggaaatcattgtgacaagagctcagttgtccaaagacggacaaaagctggaactgccgattcctgaagataaaaaacagcatgtagcagaagaaagccttgatgctttgcttgacgactttcaaaaagaagagcaggcagaagagcagaaactgcagtttgttttaaaatttgacgattttgaggatttaatctcactgtcaaaaatgtctgtcagcggttgccaaacgacattgtactctcatgaaaaccgctattatttattcgtggatttcaatgaactgcctgatgaagaggtggaaaaccagctgagcattctgctggaatatgcctcagaatcaaagatgacgattcatatgctgaaagagtatggaaaactgattgcagcggatcatgctcttcatacaataaaaaagcactttgcataaaaaagccggtttcctttgaagccggctttaaccttctccattacggggaaggtttttttgtgaactttatgaacaaaaagaatattatgcagttaaactgtgcacgaaaagacgaggaagctataatgaaagcgattacaataaagggggagcacaacatgacaaagaggggcagatgttacggctttacgattttacttgtgtttgcgctgattttgggaggatgcggcggaaacacggcttcaaataaagccgcgaatgaaaaagactttaagccttcgaaagcaatcgaggtcgtcgcgcctgccggagccggcgggggatgggatacaacggccagaacgatctcgaaaatcatgggtgaagaaaaattgattgaaaagatggctgtcgtcaacaaaccgggcggcggtggagcgtccggatggtcgtatgtccaccgcaaaaaaggcgataatcatacgttgtttgttacatcaccgccgattttgttcgtgcctttaaacggacaatcccagtacggccacaatgattttacgccgattgcaagcgtgattgccgattacggagcgtttgtcgttcataaagattcgccttatcagtcgatgacagaccttgtggatgcgcttaaaaaagatccgaaagcagcttctattgtagggacgtcttctcctggaagcatggaccacatgcagtttgtcagcgctgttcaaaaggcgggcgttgatgcgaaaaagctgaaatatattacggctcaagacggcgcagggatgagcatgctgctcggcaaaaaagccgacgtctactcgacgggtgtcggtgaagcggccgaacaagcgcgagccggaaaagtcagagtgctggccatcaccgctcccgaacgcatgaaaggagataccgtcaaggatttcccgactttaaaagagcagggaatcgatgatgaatttacggtttggagaggatttatgggacctccgggaatgagtaagtccgccgtaaagtattatgaggaaaaaatcaaagagatgatggaaaaagacagctggaaatcgattcgggacagctatggatggacggataactttatgggccatcaagaatttaaggactatcttgacactcaatataaagaaatgaaagcgctccttgatgagattggattgggcgacaaataaaacggtctccgcgcgcggggttgccggtacgcagagcctaaaagccccgcccggcacagcccgcgaccggcatgctgaaatcgagaaaggctggtgtaaaccatgagaatcacaaaccgggccgtttctgtcatcattttggctgtagcagccatttacctggcgctcagctttaatttagacagctatccgtacgcggtgatcgatgcggatgtgctgccgaaaagtttaggcatattgcttctcatattaggcatatttctgttttttgaaaaagatcaaaaggatacaacggtgaaaaagctgtttcagctgcagaaaaaagacgttaaggtcatgatgctttgtgttgtttctctgttgatctacatttccgttttagaattcatcggatttttgctatctactgtgatgctgctgctcgttttgcccgcggtgttgggatatcggaactggaaaactgctgcgatcgtttccctggttttcagcagcacaatttatttttcattcaattatgtactcaacatcatgcttccgcagggggttatgcctttttaatcgaacataaggagggaagtgaatgttagatagtattttatacgggtttcaggtggcgctgactctgcagaatatcatgttcgcttttatcggagtgctgatcgggacgattattgggatgctgcccgggctcgggccgatcaccgcgattgccattatgatcccattaagctatggaatggatccggcctccgcgttaattttgatggcgggtgtctattacggagcggtctttggcggttcaacatcatcgattctgttaaatgcccccggagtggcaggcactgtcgcgacatcgtttgacggctatccgatggcaaagcaggggaaagcggggaaagcccttgccatcgctgcaatttgctcctttgcaggcggaacgatcaccgtagttgcgctgatgctcgtcgcgccgacaatggcaaacattgcggtgacatttgggccgacagaatattttgcattgatgatgctcggcttggtggcaatttcgagcctttccgaaggatcgacggtcaaagcgctgatctctgcgacattgggctttatgacggctaccatcgggattgatccgcagacggggaccgaacggtttacattcggtgcggcaagccttctggaaggaatcgattttctgatcgtggcgctcggtttgtttgcacttgctgaagttgcgtttttaatcaagacgcggaacaagccgatgacagagggagcgtctcaggtcggcagcctgaaggtgacgaaaagcgaaatgaaagagatttcgggaccgatcgcaaggcattcggtcatcggatttctgctcggcatcctgcctggtgcaggagcgacgattgcatcatttatttcttatattacggagaaaagaatctcaaaacatcccgaaacgtttggcaagggaaatattaaaggagtcgcagctcctgagacttcgaacaatgcggcaacgagcggcgcattcgtacctctcctgacactcgggattcccggatcagggacaacggccgtcctgctcggcgcacttttggtcgtcggcgttcagccggggccgctcatgcttacggatcatcccgacgtgttctggggcgtgatcgcaagcatgtatatcggcaatttatttctgctgattttaaatttgccgttaattcctttcttgtcaaaaattcttctgattccgaagcagcttttgatttcgctcatatttgttttctgcctgatcggcgtctacgctgtgacatttaatgtcgtacacctttatattctcgtgttcttcggaattctcggatattttatgagagtgctgtcttttccagcggctccgtttattttggcttttattctcggaagtttgatggaagagtcgttcagacaagcgatgacactgtcatcaggaagcctgtccgtgttttttgaaagtcccgtcacaatcggtttattgattacggctctattgtctctcatcgtgccgccgatttcccgggcaatgaagaacagaaataaaaagtcgatcgatttggaaggctaagctgtcgatgtccggaacgctacgtttccggactttcattttttacgggcttgtagcgccgttcgggccgcccgacggttccatagtaaagttctgtttttacatgcttttcggcagctaaaaattctaaatagcgccttgcggtcgtccggctgacaccgatggtgcgcccgaggctttcggcggtgatgccatcgctgttttcgcttttgtttaaaacgccggctacttttttcagcgtcagtccgtcgattcctttcggataatcggctttagcaatttgttctttcgtgatgctccgcctttttgccatcaggctgtcaacgtctgtctggtcgattgaagacatttcatttactttgagccggtaagaccgatagtttaacagcgtttctttcagcctggaaaacataatcggcttgatcaaataatcgacggctcccgcgcgaatcgcctgttcaacatattcgacttccttagccgccgtaatcatcatgacgtctgtatgcctgagcgtttgtctgatcagccagagaagctccatgccggagccgtccggcagaaaaatgtcgagcaggacaaggtcgggcttcacgtccggaagcaaatcttttgcatcttgaaaattttccgcgattccaatgacagaaaatccatcaattttgctgatcagtttttggtggatgtcagcgtttctgatgtcatcctctacgataaatacttgtaatgctttcataggtcagtcccccagcgtttctctattttggtatcacgacagtaaacaatgctccgccaaggtcgcttttgtccgctttaatttgcccgtttaacgcattgacggcttctttaactaaaaagaggccgaggccgcggtggtttgccgtttttgtcgaataaaacttttgaaagatccgctcctgttccccctttggaatcccgtctcccgagtcttcgacttcaattaatatgtgatctgcaccgtctgacaaaaagacaaggatgctgcggtcttttttgtgggaaacggcgtcaaaggcattctcaatcaaatttcctaaaatcgtaatgaattttcccttatccatttcgtccggcaaagcgttcaattttgagctttcatcaatttccaggttgatgtgcagctctttggcacggttgaccttacccagcagcaacccggaaagaagcggatctggaatcgaatggatgagaaattgcagcatatcctgatggcttttattctctttttggatcaactcgagtgcttcaggatagctttccagctgaatcagtcccgcgattgtattcagcttgtttgaatattcgtgggtctgggctctcagaccttccgcgtattgcgaagtttgcgccagctttttggagagttcgtcaatatccgtctttctcctgaagctcgcaacggcgccgcggattttttcgttttcgaaaatcggcactctgttgacgattaattcttcgtttccgatcgttaattcctgatctttttgcgccgttttcgttttcagcacttcggggagcagcgtatccggaagaagctcggaaatcggtttgccgagccactgatcttcgctttcgacacgaagcagctcacacgcttttctattcaaaagcgtgatttcttcatgtttattgatggcgatcaaggcctcgtgcacagattctgtaatcgcctgcttttcagtatataattgattaatttcataaggctcaaggccgaaaatggactttttgacattgcgggaaatatagacggctcccaaaatccccatcagcacgacaaatcccaataaaaatatgaattttgactgatattgatagacgatgtcctgaatattttctattaaaaaaccgactgagatgatgccgacgatttcgccgttttcattatggatcggcgctttgcccctgatggccgggccaagcgtgccgacggcttccgaaacgtatgcttcacctttttcaagggcgcgccgattgtctccgccgaccattggtttgccgatttttccagggtccggatgagcatagcgaatcgcatccgccgagccgatcacgatgtattgcgcaccggactgttttctcgcattttctgcaattggctgaagggttcgagacggatcgtccgtttcaaacgctttctgaacggaaggcatgtgggcgagcgttttcgccatatcgagcgctctggcctggatttgtgtttttaaagaattttctaaaataattaaatagaggccgctcatgacagaaagcaagagcaaaagcagggtaagaatcagcaatgtgagcttggtggtcagcttccgtttgatgtcaaaaactccttttctcaaaatttcgagttctataatactactttatataaaatcggcctggatttgaagcgttttcaaataaaggaaagctcccgccaatgttgaatactagatcaaacaggaaggagagataatatgttcagtgcaatgatcgatcaaggcgggaccatctgccttgccgacggatacaaagccgaagatctcaagcgattgagaaaaagacatgcattttactgcccggtgtgccggtgtgaactcgacctgaaaatcggttccgtcaagcttccgcatttcgctcataagccggatgcagcatgtccggtgccccatgaaccggagagcccctatcacctgaaaggaaagcggctgttgtacgaatggcttggcagacaaggactccgcccggtgcttgaaccgtatttgcaagagatcagacaaaggcccgatttgctgctggaacacggaacccgccaggttgcggttgaatttcaatgtgcgaatctcaatgccgcagcgtatcgcaaaaggaccgaaggctttctcagactgggaatcgagcccgtatggattctcggcggaaaccggataaaacgcttgacgggggatttatttcagctttcgcggtttcactggcagttcattcagaaaagcgacaagcccccaaagctcctgtttttttgccccgaacaaaaggctttcatcatcctcgaacacctcattccctttcaaacaaacaaaacatccgcatccttgcgctttcttcctcttgctgaagcaagctggcgtaatgtaacagaacgagaaagccgttcgcctctccagctcaaaggctggaaaaagaacatcctcagctttcggatgtcggccgtgcgttttttatcaaaagaaacgaagcagattgccgccctcttttatgaaaatcatcagcttccgctcccgttttttccctcagaagcctttctcccggtgccgtcaggctatatttttgcccacccggtttatgtatggcaagggtacctttttttatttataacgaagcatgatacatttcgcctgcagtctgcgcttcactatatggactggctcatcaagggcaaaaggctgaagctgagatggagcgggcggcaaacggctgcggatgccgtcggtgaatacatttgttttttgcataaaaaaggatttttggtgaggaaagaggaattttattattccgcgggttcttttgttccggagccgcggttagaggcgctgttaaaaagggatgaacattatttttccgaatgattatcaagcctttcgttcaatctaaagaaaggaaggtggtgtccggactgtttcagatcaaaagatatgtattttattttttaacggcgggattttgtgtcttttttttcgcatatgatttgacaaaagacggtgaaaaaacagaagatgaacacaatacaagtttattggataacaatggacttggagtaaagaaagcgaggggattgacagtggctgaagaaaaaaaatcgaagaaactgccttcaagagaagaggtgaagcaagaagacacgtggagactggaggatatcttcccgtcagatgacgcttggaacgaggaatttcaagccgttaaagaactgctgcccaagctttccgaattcaagggcaagctcggccattccgccgatgatttatatgaagcgctgacttatcaggataaggtgatggagcgtctcgggaagctgtatacttacgctcatatgcgctatgatcaggatacgggaaattctttttaccaaggtctcaatgataaagcggcgaacctctatactcaggctgcgagcgccacggcctacatggtgccggaaatattatcgattcaggaagaaaagcttcagcagttcctgttggaaaaagaggaattaaagctttactcacacgctctcgaagaaatcaataaagagcgccctcatgtgcttagcgaggaagaggaagggattttggccgaagcgtctgatgttctttcatctccttccaatacattcggcatgctgaataacgccgatatggaatttccggagatcaccgatgaaaacggagaaaaggtgcagctcacacacggcaattatatcacctttttggaaagcgagaaccgcgatgtccgccgcgcggcattcaaggccgtttatgaaacatacggccgctttaaaaacacgctagcttccacgctcagcggagctgtgaaaaaagacaacttttatgcgaaggttaaacattataaatcggcgcgggaagctgccttgtcgcgcaacagcattcctgaagaagtctacgacaatcttgtcagcacgatcaacaagcatctcccgcttcttcaccgctatgttgagattagaaaaaaagtgcttgagcttgatgaagtgcacatgtatgacctgtatacccctctggtcaaggattctggaatgaaagtcacttacgagcaggcaaaggactatatgctgaagggtctggcgcctttgggggaagaatattcatccatcctgaaagaaggattgaacaaccgctgggtcgatgtgtatgaaaacaaaggaaaacgaagcggcgcctattcttcaggaacttacggaaccaatccgtatattttgatgaactggcaggacaacgtcaacaatctgtttacgctcgtccatgaattcggccattccgtgcacagctactatacgagaaaatatcagccttacccgtacggtaactacagcattttcgtagccgaagttgcttctacgacgaatgaagcgctgttgggagaatacctgctgaatacaatcgaagatgaaaaacagcggctctatattttgaatcatatgctcgaaggctttaaaggaacggttttcagacagacgatgtttgccgaatttgaacatgagatccatgtcaaagcccaggaaggggaaccgctgacacctgagctgttaacgagcatatactatgatttgaataagaaatatttcggagacaatattgagattgataaggaaatcggtcttgagtggtcaagaattccgcatttctattacaattattatgtatatcagtatgcgacaggcttcagtgcagctcaggcgctcagccagcagattttaaaagaaggcaaatcggctgttgaccgctatattgagttcttgaaagctggaagctcggattatccgattgaagtgctgaaaaaagccggcgtcgatatgacgtcttcagagccgatcgaagctgcgtgcaaaaagtttgaagagcagctgaatgaaatggaagaactcctgcaaaaagtcaatcattcataaaaggcgtatgcatgaaagaggctgccggtctaccggcagccttgttcgcgatgatgtcaaaaacctttaaacgttttgcggtggttgaggcggctgatcgtaaaaaggattgatataaataataggggagacgtaatataaaggggtagcatattcatcaaacctaaaatattcaagacgaaaaaaaataaaattgatgcaagtcccaaaatgatctgaagcataaaaaccctcctaaggactgataaaatattaagggggcgacgaagcgcaataagaccggcaaaaccgggcgccagtccgcataattcggggtttggcagcgtgcgtcgggctcgttttctttgttactttgatcatatgatggacatctattatttatgtttttgtgacaaaaatgtgaaaactaatgaaatcagttgtcaaaactcgacatgatttgatattataaagatgtgaaattgatcacaaacaaacatttacccctttgtttgaccgtgaaaaatttctcccatcccctttgttgtcgttaagacataatagaaaccgcgcttatcccggcgcggtttcttactgctttaaagaggaacgtgtgttcgttttttgtgcgataaaaaacacgggagaaacccgtgctatttttcgcattgatagagcggaccggcatcgtgatgttcatttatatagcgccagaacatgccgtgtttcgcttccactctttcgactttgcgggcgaacgcgagctttttcatttcccgttccacctgttcaagcgtccagtcgtaaacgacggcaatctctttgtcggctacaaattgaaagtattcgataaaaagttcgagcggaggtgtttgtgaaggcttcggctcatcgccaagcatttcaaacaatacttcttcgtaaatttcatatgaataatttccggttacctttaagccttctccttcgcggaggctgttgaaaaacgtaagagtcggaacagatgccacttccatttcggcagcgatttttaaatcgcattgcagggctttcacggcgctctgcgaatgaagatcccttttgaattcctccaaatcgagctgcgtgtgctctgcaatcgctaaaagcacctgttcttcagtgatatcctgctgattgagaaacaagctttcctgcatgcatctcaaaaactgcagccctgcttttctgccttgcagttccgctgctttcaaagcgagcgaggcaaggtaaggtgcagagagtgctttgtcgtgcaggagcgttccgtcgcaagacatgcccgacctgcatgcgatcttttcccatgcctctgcgagccggcgctttttgcgtttctgaacgttcagcgctgtaatgctgcatgcggcgatgatccttagtgtgaaaaagcggccgtagcggattttcaactttttgatcgccggctccaatgcccagcattcgggagataaagggtcgacaaacatataaatttccatcggtttttgcggatgtccgtggcaatgggagaaaaattggtcacgctgattgagtgtcaatgtgaaccatcctccattttcggctgatttaccatatgtctggctgtcaatgtcagcctttcaaaaagaaattccctgatttcgccctttaaaccgacatgatccattgcctctttcatacacgaaagccatgcgtccgcccgttccggtgtgatcggaaacggcaggtgccgcgccctcagtatcgggtgtccgtgttcttctgtataaagcggcggaccgcctaaatattgcgttaaaaattgcttctgctttcttgccgtttccgttaagtcgtccggaaaaatcgggtagagcagcggatgccgctttacacgttcataaaaagtatcaacaagttgcgatagaagctcttctccaatcgcttcataaggtgcgttaaacgattgtcccatgttgactactccttttaatatggctaataggaaaatataccgattcctattgcaaaaaaatatttatcttgtgcatcatttattatttcacgattgtatatacttattttagcaacctcgttccatttctacaaacaaaccgacttctgcctgcgggcgaaaatcgctgttttgtttcaaatatcatatcatattcgcttcttaaatgtgtatttttaataccgggaggatgaaagaggaggtaaatgcaggaaaaaaagccggaaagcgtcctttccggcttaagcgtagtaatttgaggtgattttttttacataattttgcgtttctttaaaagggggaatgcctccgtacttttggacatttcccggtccggcattgtatgccgctaatgcgagcttcacatttccgctgtatttatcgagcatctgctttaagtattttgttccgccttctatattttgaacggggtcaaaagcgttattcacgccgagcgccttcgccgtggacggcatgagctgcatcaggcccatggcgccggccgggctgaccgctttctcttgatagcgtgattcctgcttgacgacggcatgaatcagtttctcatcgaccccgtatttttctgcggcgtttttgatgatctggtcaatgttctgattttggccgccgaaagagacgggtttcgctgcggcagatgggacggccgcaattgcctcaggcttttcagctgccagcggggcctgaagctgagacgctgtcgacacagtcggagcaaccgcgggctgtgaagactccaagccgccgacattgcttaaatattggtttaaaatcgagctgaaatcaaaacccgcatcttcggaaccgctgtctgaagccggataaaacgaccgtatcgcctgaagttccaagagagcggccaaatggttgacgttcattgttttcccaccttattgatctttaagtttttgctcataaaatcggacgattttgtttttggtttcacgctcagggatgccgaacgatttcagcagttcagagaaatcccgttttccgcgttcataatccgtcacttcgaattcgatttcaaagtcttctaccattaagtatcggctgtgatccaaaacaattaagccctgcggcaattttttttctgcacggcttgtcgcaagcgttccgaaaaggatgagctcgtccgcttcaatgccgagacgcttcagacgatcgtataccggcccatgcggaatcatgaacgtttcgatttcaggcttccgggtcagctcctggtgggtttccatcagtccgacaggcgccggttcttttaatgtcaggacaaatcgctgctgcttttcgcgaattcttagggcagctcctttttcttttaaagagaaggaaggcgtatcgtaataatggtttttttgtataacaaattgctcggaggaaaattgataatatgatttgattttctcaaattctttttttgtcagcatatttttaaattcgatttcaagttcctggctcattctttaattttttcatcctctcagctcgtaaaattgcattttccttattatctcttgagaaggaacgtttatcaatattgaagctgatatgataaaatgaatctgtacttttattgtaaaggagagcattatgcagaacagaattgagattacagaagccaatctgcgaaacgaccggctggtgttgaccagcgaaatcaatgacggagcggagcggaagccggccggacgcatgctgacagactccgatcattttgcatttgtatacatacttgaacaggacgaatcctttgaatacgtcattttaaacgaaggcatctggtccgatcttaaagcggcccttgacgccggtcttcctgtgtttttacatatcggaaacacggagctggagcttaacgggttccatgatgagctcggatatttaatagagaatattaaagataatgcaaattatggcgaagaaatggaagagagagtgaaacggatattcctctagaaaaaaaggcgatgaaattgggggaaggtttatggatgaaaaacaatgggagcagtttttagcgccgtaccggcaggctgttgaagagctgaaagtgaagctgaaagggatccggaccctttacgaatacgaggaagagcattcgccgattgaattcgtgacggggcgggtgaagcctgtgccgagtattcttgagaaggccaagcgaaaaaacattcctctgcacaacattgaaagcatgcaagatatagccgggctcagaatcatgtgccaattttttgaggatattcgcattgtcgtcgatatgcttttggcgagaaaggacttcacggtggtggataagcgcgactatatcgcggaacataaagagagcggctaccgctcctaccatctcgtcgtgctgtatcctttgcagacaatcaacggggaaaaacagattttggttgaaattcaaatccggacgctggcgatgaatttttgggcgacgattgagcattctttaaattataaatacagcggcaacattccggaaaaagtaaaattaaggcttcagagagcttcggaagcagcatcaaggctcgatatggaaatgtctgagatcaggggcgagattcaggaggctcaggcggcgttttcacgcaagaaaaaggatgaggatgacggttaggggagtgagatggaatgatgaagtttgcggtatcgtccaaaggaaatgcggtttctgattcattgaaaagcaaaattcagacgtatctgctcgacttcggtctcgaatgcgatgaagaagagccggatatcgtcatttccgtcggcggtgacggaacgctcttatacgcatttcacaaatacagcggccgcctcgacaaaacggcttttgtcggggttcataccgggcatctcggcttttatgccgactgggtcccgagtgagattgaaaagctcgtgatcgcgattgcgaaaacgccgtatcaaattgttgaatatccggttttggaagtcatcgtccgctataatgacggcagcgatgaagcgagatatttggcgctgaacgaatgtacgatcaagagcattgaaggaacgcttgtgacggatgtcgagattaaaggggaactttttgaaacgttccgcggcgacgccctttgtctgtcgactccttccggaagtacggcatataacaaggcgcttggcggtgcgattattcatccgtccatcagggcgatccagctggctgaaatggcgtcgatcaacaaccgggtgtttcggacggtcggatcgccgctcattctgcctgagcatcacacttgtttaattaaaccgataaatgatgtgacgtttcaagtcgcgattgaccacttgacattgctgcataaagacgtcaagtcgattcaatgccgcgtcgcaaacgaaaatatcaggtttgcccgctttaggccgtttccgttttggaaaagggtccaggattcctttatcggaaaaggagaataggaaggtttgctgtgagcgattttttgatgaaacagatcataacagaagaggacagcggggttcttttgaaagaatacgtccagcggctgggcatttcaaaaaggatgctgacggacatcaaattcggaggcggcgatcttttggtaaacggcgggcatgtaacggtcagatacgttcttcaaaaaggggacgagctcgtcattcagtttcctccggaaaaaatgagcgaatctttgcaaccggaagaagtgccgcttcatattttgttcgaagatgaccatgtcctcgtcttaaataaacagccatgcatttcgtcgattccctcgcgtgagcatccatcaggcagtctggcgaacggtctgattcattattaccagcggacgggcgtacacgcgaccgttcacctggtgagcaggcttgaccgcgatacatcgggtgtcatgcttgttgccaagcaccgcttcgcccactcgcttttatcggggctgcaaaaaaagggagccgtcaaacggcaatatcgagcggtcgtccacggtttgatcgcggaagagcagggaacgatcgatgcgccgatcgggagaaaatcatcgagcatcatcgagcgggcggtaatcccggacgggcaaaaagcagtgacgcatttttgggtgaacaggcgtttcagcggcatgacggatgtctctatccgtctggaaaccgggcgaacccatcagatccgcgtccatatgagtcatatcggatatcccttgtgcggtgatacgctgtacgggggaacccgcggcttcatcaatcggcaggcgctccacagtgagaggctgacattttttcatccgttcacaatggaagagctgacgttccaagcgccggtgccgaatgatatgagacagttgatagagagctgaataggctctctatttttatggctccatgcggaatctagactcatcataaggcaaagaggagggaacagattcggttgtcagttccgggaatctgaaagcggtcagcctgttgccgaatacacaaccggtatcgatattaattgtatgatgaatcatcctcgggtttttgacgggagtatggccgtatacaacccacggctcgcctctgtaatgagcggcccagtcccgtctcactggccgtccgtctggcagcgtttcccctgtaatatctccgtagagcacaaactgttttacttttccgacaggctttttgccgatgtcttccgctttgatgccggcatgtgcaacgacaagttcgccgttatgcaggatctcgtaaagcggagccttttcgtaaaggcgcatgaaaaggtctctgatatccttctgtttttgtttcggaaggtttctgtattcggccgccgtcgtttccagtccgtgctgcagcttcaccggatttcccttgaaaaaacggtacagcttgttgcaatgattgccgggcacatatcgcacagctccatcttcaacggcccgtcctacaaattcaacgacctccagcgattttggccctctgtcagttaaatccccgagaaagacaagtgttctgttctccggatgaacgggaactcctgatgtcagcgagtagccgagtttttcaatcagcgcaatcatttcgtcatagcacccgtgaatatcaccgataacatcgtatttcatgcgttttttcgcctccagtccgtttgtttttcatatgtatatacattgccccaagccgtataaatcaagcttctgcaactttctccggagaaaatcaggcatattacttttttttctgagcgagcattgttaaaatcaatttttacacctgtgggaaaagagtttcgacggttcttttcccacatgaaaatgtcaaaaatatgccccttttatttttaaaaaagggaacgctaatcataccggaaaccggttttagaggaggtaccagtttatggagcacacatctgtctcatctttagttgtcgtactgattatcgcatttttaacacccatcctgctgcaccgtttcaggttaagcataccggtggttgtcgctgaaatcatcatgggtcttattatcggaaaaagcgggttcgatctggttgctcagcacgatacttggctcgaaactttatcgatgctcggatttatctttttaatgtttttaagcgggcttgaaatcgatttttccgtatttgaaaaaggtaagaaaaagcagctgcttccgagcggaaaggaagcgccgaatacgtttaaaacggcttccgtcatctttattgccgtctttatactatcgctcggcctctcctacagctttgtcatggcaggatttattgacaacgcctttttaatgacgctgatcatttcaacaatttcgcttggggttgtcgttccgacgctgaaggaagagcggctcatgaagacgaatatcggccagattattttgcttgtcgccgtgattgccgatcttgtcacgatgatactgcttgcggtgttcgcctcaatctacggagacgaaaacagcaatatgtggctgctgatgattttatttgccgccggcgttgttttatacattttcggtagggtatttaaaaagcggccttttgtcgaagtgctgtcaaaaggcacgatccagatcggcacaagggcgatatttacgctgatcatcgtactcgtggcgctttccgagtcgctcggtgcagaaaacattctcggcgcgtttttagccggggtgcttgtttcgctgctttcgccgaacaaagagctcgttcagcagcttgattcattcggctacgggttcctcatcccgatcttctttgtcatgacaggcgtcaaattggacatttggtcgctgtttggcaatccgaaaattttagtgatgatcccgcttctgtttgtggctctgttaatcagcaaagtcgttccggtgctgtttttgaaaaagtggtatgacatgaaaaccgtgctggcttccggttttctcctgacttccacgctttctctggtgatcgcggcgacaacgatcggcgagcgcatcggcatcattgacgcgcagatgtccggcgcgctgattttggtggctgtcattacatgcatcatcacaccgaccggctttaaaaaattaatgccgaaaacggaaagcgaaaaagagaaaaagacgatcacctttatcggcgcgaatcaaatgacgctgccggtcacgcttgaactttctccagaagattatcacgtcagaatcctgcatgtccggcaggaaaagaaggaagaaaagctggcggatccggtgtttgacgttgaagttttgccagattatgaatacgaaacgcttcaatcattcggcgttttccaaacggatatactcgtcgtggcgacaggcagcgaagagcgcaatacagggatcgccctttatgcgaaggagcagaaagtcgcgagaattatcgccagcgcagattccccagacgccgaatcgaggctgaaagaaaacggaattgatacattctccattctgctttccacgaaaacgctgctgcgcgcgcttatcgaggcgcctggcgttatgaaacttttgacgaaccaggatgcgtcgctgtatcagatcaatatgagcaatgagcgatttgacggcgtcctgttaagggagtttccgtttacgggagatgtcatcttcgtccggattttccgcggggttgacagcatcgtgccccatggggatacaaggctgcaaatgggtgacaggctgatcgccaccggttcgcgcgaatatattgcggaattgaaaaaaacgcttggagactgatgcttgaccattttgcaattcgtgataagattaaagtataaactgaatgaacaagaaatgttttccactaggggagtccttgataagggctgagataaaagtttgacttttagaccctcataacctgaacaggttcaaacctgcgtagggaagtggcacggtatttgagtatgtatatatgcaaattccaaaccactttccttgcgggaaagtggtttttttatgttcagaatcgaaggaggagccttgaaatgaagttttcagaagaatgccgaaacagcgctgcaacttggtgggaagggagttttgtccatccgtttattcaaggaattggagacggcacacttccggttgaccgatttaaatactatgtcatgcaggattcctactatttgacccactttgccaaagtccaatcctttggagcggcatatgctcacgatctatatacgacaagccggatggccgaacacgcgaaagggacatatgaagccgagatgtcgctccacaggaaattcaccgatctattgggcatcacaaaggaagagctggagtcgtttcagccgtcgccgacagcgtatgcgtacacatcgcatttgtaccgttctgtcgtcagcggcagttttgcggaaatactcgctgctttgcttccttgctattggctctattatgacgtcggcgaaacgctgaaaacgtgcaggcctgacaacgcgatttatcaggaatggatcgcgacatacggaggagactggtttaaaaaatctgtaacggaacagatcaaccgcttcgatgagctggctgaaaacgccgatgagaaaacgcgcgcgaagatgaaggagaatttcgtcatctccagcttctacgaataccggttctgggatatggcctatcaaaaagaaagctggtcaaaaagcggggtggatcagcttgcatctgcacgcgatcaccgatgacaagcactccgtggaagagctttcagcaaaaatcatctcgattcacgatgccgttgactttatccacatcagggaaaggtcaaaaaaagtaagcgaaatatcaagtttgatcgatcgcctggccgaagaaggcgttgataagcgaaagctcatcatcaacgacagggtggatattgctttgtttcatcatattcaccgggttcagctgccttcacacggcttttccgtcaaaagtgtaagaagccgttttccgcatttgaaaatcggaaagtccgtacattcacctgaagaagcggtgcaggctgaaactgaaggtgcagattacgtgctgttcggccacatttttgaaacggactgtaaaaagggccggaaaggaagaggagctctgagcttggcagaagtgaaggcggctgtccgcattccggtcattgcgatcggagggattaccgaacaacgtctggcggaagtcaaaatggcagacggcatcgccgtgatgtcggggatcttttcccatgacagaccgaatgaggcggccgcgcggcttgccagtctcgcgaagggagattcatatgagaaagcgctatgatacgatcgtgatcggcggaggcatcatcgggacttccatcgcttatcatcttgcgaaagcggggaaaaaaacggccgtgtttgaaagcggggaagtcggcaaaaaagcgacgagcgcggctgcgggcatgctcggcgcccatgcggaatgcgataaacccggtacctttttcgaatttgccagagccagtcaaaaagcctataagcgcctgacgggggaattgaaagacataagcggcattgatatcagaaggcatgacggagggatattaaagctggcattttcagaaagcgaccgcgaacacctgatgcaaatgggtgcactggattctgtggaatggcttgaagctgatgaagtatataaattagaaccgaatgccggaaaaggaattctcggcgccaattttatcagggacgacgtccatgtcgaaccggctgcagtgtgcagggcatttgccaggggagcccggatgctcggtgcagatgtcttcgagtatacgcccgttttatcgatagaatccgaagcgggggccgtccgcgtcacgtccgcttccggcacagcggaggcggagcacgctgtcattgcaagcggcgtgtggagcggagctttgtttaaacaaatcggcttagacaaaaggttttaccccgtcaaaggggagtgcctgtccgtatggaatgacggcatctctttgacgagaacgctttaccatgatcattgctacatcgttccgcgccatagcggaaggcttgtcgtcggcgcgacgatgaagcccggggactggaatgagcagccggaacttggcggaatcgaggagttgatccgaaaagccaagtcgatgctccctgggattgaatccatgaaaatcgaccaatgctgggccgggttgcgtcccgaaacaggggatggcaatccgtatatcggaagacatcctgaaaatgaccggattttgtttgctgccggacatttcagaaacggcatcctcctggcacctgcaaccggtgagatgatggcagacatgatcctcggcaatccggtcaaaacagagtggatcgaggcgtttaaagcggagcgaaaggaggctgtgcacaggtgaacattcagctcaacggccggaaaatagagtggagagacgacggcggcacgatttatgatttgctcgcatcctacaatttggaaaatcgtgttgtcgttgttgaaaaaaacaggcggattatcggaaaagaccaatatcaaacggtcaaattggaagaacacgatgtcatcgaaatcgttcattttgtcggagggggataaaccgttatgttaaaaatcgcagatcgtcaattttcatcaagattattgctcggtacagggaagtatccgtcatttgagattcaaaaagaggccgtcagcgcatctgaatcggagatcctgacgtttgccgtcagacggatgaatatttttgaagaatctcagcctaattttttggagcagctcgatttaagccgttatacgcttttgccgaatacggcaggagcaaaaacggctgaggaagccgtccggatcgccaagcttgccaaagcaagcggtctttgcgacatgatcaaagtcgaagtgatcggctgtgaccgttcgcttctgccggacccggtagaaacgctgaaggcgtcagaaaccttgcttgaagaaggcttcattgtactgccgtatacatcggatgatgtcgtcctcgcgagaaaacttgaagagctcggcgtgcacgccattatgcccggggcctctccgatcggttcgggacaaggaatcatcaatccgctcaacctgtcgttcatcattgaacaggctaaggttcccgttatcgtggatgccggaatcggttctccgaaagatgcggcatacgcaatggaactcggtgctgacggggtgcttttgaacacggcagtgagcggggcgaaagatccggtccaaatggcgaaggctatgaagtttgccgttgaagcgggcaggctcggatatcttgccggacgaattccggaaaagaactacggcatcgccagcagccctgaagaagggaagttgacgatttgaccggcaggtattcaagacaggagctctttcacccgatcggaccggacggccaggaaaaattaagccgcgcccgcgtcctcgtgatcggtgctggggctttgggcgcggccagcgcagaaatgctggtgagggccggggtcggttcgctgacgatagccgacagagattatgtggaatggagcaatctccagcgccagcagctctatacggaacaggatgtgattgatcatatgccaaaggccgccgccgctgaaaaaaggctgcgcctgatcaacagctctgttcaagtaaccggaatcgtagcggatgttactgcggaaaaagcgctcgagcttgcggaggaagcgtccctgatcgtcgatgcgacggataattttgaaacacggctgatcatgaacgacgcggcggtcaaattaggcatccctttcctgtacggcgcgtgtgtcgcaagctatggcatcacatatagcgtaattccgggaaaaacgccgtgtcttcattgtcttttggggcatttgcctgcgaataccatgacgtgcgacacagcaggggtgatcggtccggtcgtccagcaggttgccgcataccaggtaacagatgccctgaagctgctgaccgggcatgaaccgtcagggatgctccgctcatttgatatttggacaaatgagcggtctgaagtccgggctgacacgcttaaacatgagacatgtccgacgtgcggaaaaggcgagtttccgtttctttcagctgaaaacgaaacaaaagcagccgttctttgcggcagacaaacggttcagatcaggccggccgcggaacagccgctggaactggaatcgcttgctgccaaattaaaaaaagccggtttaaatgtgacgggaaatccttatttagtttcctgccgtgcggaggattttaagttcgtgatttttcgggatggacgtgctttaattcacggaacgaatgacatcaatcgcgcgaaaacgatatatcacaggtggattggctaaaaggccgaagggagtgcaaacatcatgagcatatataaagcattaacaatcgccggatcggattcaggaggcggagccggcattcaagccgacattaaaacatttcaggagcttggcgtcttcggcatgacagttttgacagcagtcactgcgcaaaatacaacaggggttcacggcgtctacccgctttctccggaagcgctcggcgcacagattgatgcagtggcagaagatttaaaacctgacgccgtgaaaacagggatgctgtggagcgcggagatgattgaggtcactgctgaaaaaattgcagcatatgagcttaaacgtgtgatcgtcgatcctgtcatgatcgccaaaggcggcgcttcactattgaatgaggaagctgttgaaacattgaaacggcgccttcttccgcttgcttatgcggtaacgccaaacattcccgaagccgaagtgctgacagggagaagcattcaaacaatggaagaccgcaaaaaagcagctcgtgacttgcatgaaatgggcgtccgcaacattatcatcaagggaggtcatcagcctgaggatggcaaagtaaccgatctcctcttcgacggagagacgttcacagaaaaaaccaattcctatattaagacgaaaaatacccatggaacaggctgtacatttgccgcggctcttacggcgcaatcagcgaaaggaaacgggattcaaggagctttccgcatcgctgaggctttcgtccacgaagcggttgtacacagccttgattttggagccggccacggaccgaccaaccattttgcatatcaaaagttatccaacgcagggttggaactgtagtcccgcaataagaaagaatcaatatcgcggcagagcatcaaaaacggcctctgccgctttttatattctgaaattgtcagcctgctattaattgtgatactatatattatgatcaggtactaataaaatgttaatcattaggaggatttcatacatatgaatttatcactagaaggccggaatatcgtcgtcatgggtgtagcaaataaacgaagcatcgcatggggaatcgcccgctcgcttcacaatgcaggcgcaaggctgatttttacgtatgcgggcgagcggcttgaaaaatcggtcaaggagctggctgattctttggagcgaaacgattcaatcgtacttccttgtgatgtcactaatgaccaggaaattgaagcatgcttcgccgacatcaaaaaagaagtcggggtcatccacggcattgcacactgcatcgctttcgccaacaaagaagacttggctggcgaatacttaaatactacccgcgacggttttctgctcgcacacaatatcagctcctactctctgacagcggtcgctaaagcggcgcgcggcatcatgactgaaggcggaagcatcgtcacgctgacataccttggcggcgagcgcgttgtatccaactacaatgtcatgggtgttgcgaaagcatcgcttgatgccagcgtcaaatacttggcgagcgatctcggaaaagacggaatccgcgtcaacagcatttccgcagggccgatccggacattgtccgcaaaaggaatcagcgacttcaactcgattttaaaagaaatcgaagagcgcgcgccgcttcgccgcacaacgactccggaagaagtcggcgacacggctgctttcctgttcagcgacctttcccgcggcatgaccggcgaaaacctgcatgttgattcaggctaccatatcatcgcgcgataaaatagcgctaaaaaagcaatccgctaaaggattgctttttcttttcttctgatttctccttttttgcatatagatataccatgaacagatcggagggatcaagatgtctagcagaaaacacgatgcggagcaaaagccgctcatgtatattgtgcagccggactatgataaggcagaggcgaacatgcaggatattctgattaaaagaaagaagaaagcaaagcccgaagcttccgaacaaaaagcgcggcggaaggaacagcaggatgaagccgtccggcccgacgaaaaagacggagctgaagcggtgtttaacgatgaggcgaatcgatccgaaaaaggagtcaaaccgattaaaaagccgctcagcaagatgacgattgccgagaaaatcgactttttggcaagccttcccggcaatatgccgaaaaccctttgtctcattgaagcagacgggaagacatacaggggaacgatcgtcggaaagaagggcgattccgtctttgtcagaacgtcgagcaaaggggctccggcggaactgccgatcgagagcattacctccttgcacccgctcggcttttaaatacacaagataaaaaaagtcccgattcagggactttttaatttgaacgattgatcagttttggatttaagcattcgatcgcacagaagcattccagatcgacttcaatgcagaaacttgttttttccaagcggaacacatcgcaaattttgtctttatcttctgtgaaatcgagaacgcggcgattatcatcaaaggcaatcaacagtctcaatgtagcgcagcagtcatcaatgttttcaactctgaaaaacacggtgctgaagcaaggacctgcctgaagttctccgacatttccaaacgctacgaacggcttagacttagaagtgtataaaataaacggaatggtgtcgcctaagtgtctcgaaggggaaagcaggttgctgaagcagcttgtcgggcagccttcttcctcaatggcgttttgcagatcgtgaatgttttcaacggcttcgcacacgcaattttcggctgaacatttcgtcatgttatgatccctcctagttcaggatttaaaatttcgtttttcggcctggcctttctattggtaaaaggagctgccgaaagccggcagctttcgtgaaaagactggcatcaagccgatcatatcggccggcttgatgcagcctgacaccttttaaccgtggtggtgattgtgttttttgtctgctgcgcgatcaactaggtcaggtgacagacattgaatcgcacagaaacaagtcaagtcaacctcgatgcaaaagtccgtcttttcaagcccgaaaaagtcagggtcacaaggatggcagacgcttaatgtgtcgccgtttatgtccacaggcctcaggattgaaagcgttgcacagcaatctttgagactttctgcccggaagaaaatcgattcgaagcactgcatatcatctgaaaatccgccgacatttccaaatgttgaaaacagtccgccttttttgtcgtacaaaaggaacggaatcgtgtctttaccggaaaccgtcggactcagcaggttgccaaagcagcttgtcgagcacgctgttgtttcctcaacggcatcctgttcttttataatctgttctactgcatcgcatacacaattttcatgccggccatggtgttttccgcagctcatggatttcagctcctttttatagggatatttgactttagtctttaacaacatatgtacccgtgcccttgttggtgtgggtaatcgtctataaaaatgaagaaaagcagagctggttggctctgctttttgaattatagaaggccgacgataagggcggtgatggtgattacaacagtttgaacaaatgtgcttacgatgatagctgtgtctgtatcttcggttgtgacatgtacatttctggaattatcgatcaccaatttttgtctgttcgtttgtttattggcagttacctgcaacagatcagttgtgacaagttcggctagatcaggatcatcgataatggcgagaataatagtaacagctagtgtttgtgcagctgtcatgactgatgccaacgtttgtgtgtcttcagttgagacttgaacatcacaagagtctttaatgatgatcgtttcatctgagagctgtttgttaagatgaagttgatctaggtcagaatcgataaagccattttgccctttcctaccacagttgcaagtatagtcgtcacataattttttcttaggataactagggtgataatcgttgcctggatgttcgcattccgggtcaagcgcaatccatgaatatggtcttgtttccatttcttttcctccttccatttactattattaaatgttgtaactccttaacttgtataagacagataccctactacaaatccccatttttttctgctgaagtatctgactcggttgaattttccgctgttgctgtgttttcttgctccctccgttgtcgaagtttttctctcagtctatttgttctgtttcttcttcttcttggtctctcgccattttctgatgacgcatcagcgttcttttctctctttgtccctttttcattcggtgcggctgctttttctttctgtttttgaaccaaagcatcggtttgtttttttagatcttccagcatattgaaaatattttctttttcttcttctgagagcgtccgaactttatcgctggttactccccgatttttcaagatatttttaacaactgatttcattatcggatctacgttctcttgaagtttttcaaaatctgccaattgtttctcacctcaatttctttaaaaatattagaaagaaaggaaggcttaaagtatgtcaagctctgtgataagcgcgatcagcacttcggttaaaacttggacggaaagcaggatctccagcgaggaaagcgtaatggtgacattgcggctgccgatgactttgatgatgactcttctcctgctttgcagcctgtgtacggctaaaaggtgttctgagacaatgtctgctgtatcctcgtcttcgatcgcaagctgagccgataaaatcgtcaaagagatcacgatggcttgtaaagagagagctgctgttatgtttgccgtgtttaccgtgacatgttctgaatcaattacttcaatgagctggtcatattcccggtgtaattcgtcaaatgtttctgcgtacagcgcttcggctttttcatgaaacgacataactttcactcctttcttatccacactttattaaatgcagaccggtaccatagcggaatgagaaaaacatacatttcagcacccaaatttgctgttttagggaaggcggttccggcatatatttggaaacaggaagggggagccctgtgatacaaagctggtttttattttttttattttctatcgcggtatttcggctgacgaggctgattgtgttcgacacgatcatggcgccgtttagaagcctgtttcatgaagaggttgaagaaaaaaacgaaaaaacgggagagaccgaaacgtatcttgtcatgaaaggaaaaggcgtgagagcgtgggtcggcgagctgctgagctgctattggtgcacgggcgtgtggtgtaccgcgtttttgcttgttttttacgcatttgttccggtcattgctgaatggctgattcttctgctttcgatcgccggcctggctggagtattggaaacgatcgtttccaaatggctcgattgaatggggatttgtcattagcaacttatgaaaagaagactcatataatggcgtataagcatgagaaaggaaggaatgcaatgagacaagtgaaaagaaggcagcaaggccgattaacgaacgcttccagcaatcatcagtccactttctcaaaaaaagtgaagaaaaaaggctgcggatgcggcaaaaaaaagagaacctattaatatcaaaaaaagccggaatgcatccggtttttttgttgccaatttttcttctggtgcatacaccatcataaggaggggaagcgatgaatttatttgaacagctggttgaatcgatataccgcaaacatgatcaaactcaagccggccatgacaaggtgctctttgaacagcagaaggaactggagacatttgaccgctcggccgaacagttcggcaggcagatcgaagcgtttgcggagaatgccgaaaaatggctgggagaggacgggagtctgccaggcatttttaaataatccacagaagccctatgcatcaatccaagccaatcctatcaactgtcatatcgtgtagggagaaaaggaggtgctttagatgggcttttgttgcggaggctacggcggtggctacagcggcggctatggcggcggctatggttcaacgtttgtattgatcgttgtcttgtttattcttttaattattgtcggcgcttcttttaaatattagtttttgagttgaagcgaagagggcggcggcagcatatgtgccgggctctcttctttttgagcgggaaaagcacaaggcttttcaaacatgcataagatagcgtatcactcccaaaaaggaggcataggtatggacaatcaatttttcaaaaacatcgaaaagaaaacgggcgtcagcatgaatgacgtcatgcagctcgcaaattcgctgcaaaatgccaacttcaaggatgaaaatacggtccgcagcgtgattaagcgcgtcgctaaattggcgaataaacgggttccgaaggaaatggaagataagattgttgaatccattgtaagcggcaaagaaaaaatggatttcaacacgatcgcgaaaatgatgaacagcaaaaaataaacaccgcgccttccgataaaaggagggcacggtgtcttttattgcagctgaacttgtggattcgggcgtaaaataggctgtaaaaaccttgagcggtatgccgttcttccccttctgaaggaagggacgctgatatacaggcggtcctcggcccgggtcatggcgacatacagcagcctccgctcttcttcaagagcggtttcatcgccttttctcgctgtctccagggcaaagtcatgcggaatcgagccgtcctgcactcccagtatatagaccgttttaaattcaagccctttcgcacgatgaattgtcaaaagctgaacaccgtatccgtcagctttttgcttttccgcggctctcatatgatcgacatgctcaagaaattcggggatcgttttgaatttttttgccgcagttttgagatcccgcagatcgtcagaccctttttcgagcttgttcccttcgtttccgcgctttttcaggtaatcggaaaagcccatcttttcttctgcgaaagagatggcttcaaccggcttcatcgtttttaagcctgggaaaaaaggaacgattttttttattttatcaagctgaaacggtttaatgtcagtcaatttttcaagcgcctgaaccattgtgcaatcttctgtaatcgagagcgctttaagcgtgtttaaagcggactgcttgagaaagagggcgggtaaaatctgctttacggcttccgcgtcatcttgattttggcttaagtagagataggccagcatctgccggacgatcctcctgctgtaaaacgaccggacgccttgttcagccgtgtacggaatggctgactggtgcagacgttcaaaaatggcgcggccgctgctgtttgtccggtataggatggcgaagtcatcaggctttgcgcccatttcaattttttcttggatatcagagacgatcataatcgcttcttcctcttcatcataaggataaaataagagcggtttttggcggtcgtctctcgcggcgcttaatgttttcggaaaacgctttttgtttttccttacgaccatatcggcgcttgccacaatcggatggctcgatctgtaattcgtcgtgaggcggaccgttttcgccttcggataatctttttcaaaatcgagtataaaagaaggactgctccctctgaacgcgtagattgactgatcatcatccccgacacaggtcaggttgttttcggggcttgccaagagcttgatgatggcgtattgaacagggttaatgtcctgaaattcgtcaatcaaaatcgcgtgaaagcgcgtctgatatcgctttaaaatgtccggctgttcttgaaacagctgccagcacgcagatgccatatcgtcgaaatcgaattggcgccgcgctgctttttgttcttcataatgacggtacagccggtgaacccgcttttcccattcgtcttcaagcggaatctgttcacccggaagataagcgttcttccagtagccgatctgctggatcgcctggtcaaccggaaagtctttttcatcaagcccttcttcggcaagggccattttgatgtactgttctttttgccattcccatttcagcaggtgctcgccattccatttggccggatcatgatgataaagaattttgtaaaaaaagctgtggaaggtgcctgtcacgaggcggttcacagtctgcatcggcaaaccgtatagcgaggccatccgctctttcatttctttcacagcttttgtcgtgaatgtgacgagcaatatggcagaaggcgggatatcgagccgggatatcatataagctcgcgcggttaatacccgcgtttttccgcttcccgcgccggccagaacgagaaggggttcttcgggggccgtcacggcggcaagctgtttctcattcagcggcacattcggaaagaccggttccggagccgtttctgccgctggagagaaaggagaatggatggaagcttcgcgaggcggcgtccagaagtccgtgtccgccttcttttcctctccgatcgctttgcctttcgggaggcggaaaacgccgctttcagtataatcgttctgtttggtcttctgctctgtcttctcatttaagcaagccgcttcacattgagaaaaatccccgttttcccggtggaaaaaatgcggctcttcatgaatcgacaatttcagtctgagcggcaagccgcaatatttacacgtgatcctgtcttttcttgcttcatcaaagaggaattgcaggtgttctctcgaatatgtatgtatatgaatgtctcggttattgaatcgggcgcatttcaaaaagaggtcctccaattaatgggtagtcgtctggtgtcatgagacaacgtctatcatatcaaatgaaaaccgtttaaaacagtagatttttgggaattaaagctgatgaggaggagatcgaatgggatatttgccgcctgtccgcaatgatcaatatatacagtatgccaatcgaagcatcagccaaaaatcgaactacgcttatatacaaaaaaccgccaatatcccaagcgagcgcgcctaccgcgaagtcgaaaaaagagaggaaaatcagactgcggcttttaggcgggtcgaggaaaaaaagcggaaaaaagcgctcaaccgccgtgttgcgaaaaaggcggaaagcgggcgcttcgtcaatgaatccgtttgagagatgaaacaaaccccggcttttataccggggttttcgttattttctgcgcagttttttgagtccgaaatacagaatgatcatagccgccgccccgagcatgatcggagtcgtgtacgttcttgctacattttcaacatggtcccaccggctgccgagctgtacgccgagatagacgaacagtatcgaccacggtatgatggccagcacggtcagacccgtgaattttaaaatcggcattttcgcaatgccggccggaatggagatggcgtgtctgaccacgggaatgaagcgggcagaaaagacgacgcctccgccgtatttctcaaaccatttttcggctgtttgaatgtgatgcttttggatcaataagtattttccgtatttgtataaaaacggacgtccgccgtagtagccgatccagtataaaaacaattgagcaatcgttcccccgatgacgccggcaatcacggcgcctgttatcgtaatcgagccgtttgagaccatgtatccgccgtaggcgagtacgatttcactcgggatgatttcgatcattaaaccgatcgcaatgccgaaatagccaagatcggtcagccacattaaaatatcattcactatgcttcccattttcgttttttctccctgcttttgatttcatcagccgaacgttggagcagccgccgggacgcttccctggcgcccgcgggggaaataagcgaatctcaaaaaccgtccggatgcgctttgtgccattgccatgcgctttgaatgatggtttgcaaatcgctgtattgcggcttccatccggtatcttccaccagtgtccggctgtccgccaccagcactggcggatctcccgctctgcgctcgtccgtttttgctgcaatgcttcgctctgtcatgttttccgcggtttcaatgatttcttttacggaatgtccggcccctgtccctacattataaacattttgcttcagtctgtcttcatataatccatcaagggcagccaggtgggcggaagccagatcgaggacgtgaatataatccctgatgcaggttccgtctggcgtcgaataatcttctccgaaaatggacagctgctttcgctgtcccaaagccgtctgcaggacgaggggaatgaggtggctttcgggatcgtggtcctcgccgatcgctccgtttaaagcggcgccggcggcgttgaagtagcggagggcggcccatttgacaccgtgcgtttttccgacccagtgcagatatttttcgatcatcagcttcgattccccgtaaggattgacaggggagaggggagcagcctctttaatcggggctttctccgggatgccgtatacggcggcggttgacgaaaagacgatgttattgacgccttccttgatggccgtttcgaaaaatgcacaagactttagcgtgttttccctaaagtatatctcaggcttttcgatcgattcggacacaaggcttttggcggcgaaatggatgacagcatcgacatcatgatgtttgatgatggctttgacaagtgccgcatcagcgatatcgccttcgtaaaagctgaccccgctgacggcttccctgtgtccggtagataaattgtcaagcacgacgacggagcggttttgctttgtcaattcgagtacggtgtggctgccgatgtatccggctcctcctgttacgagtacggatgtcattgccatgctcctttctgcgcttctttttttaagacgctctccaggtaggcgagcagttttggccgcatctcgtcccgcatgagggcgatttccgtactcgctttaaagctgcccagcttgtcgccgatatcaaagcggcttcctttcaatttgcgcgcatacatgctttgttcccggcagatttcccttagtgcgtcagtcagctgaatttcatttcccgcgccgcgcttcgtttgttcgagcacagggaaaatcgaaggcctcagcacatagcggcccatgaccgcgatatttgaaggcgcatctttgacggtcggcttttctacaagatcgtcgatttgatacactttgttcttttgcgcggatgtctgaatgatgccgtatttgctcacgtccgctggatcgacgggctgaacgccgatcacttcggtctgatattcttcatatacttcgagcagctgcctaagcgccggtgtttctgacaccatgatatcgtcgccgaggaggacggcaaacggctcatcaccgatgaaatgcttggccgataacactgcatgtccgaggccgatgggctccttttgccggatataatgaatattcgccatatcggcgatctcgcgtatctcttttaacacatcgttttttcctttggccagcaggttttgctcaagttccacagagcggtcaaaatggtcttcaatcgaacgcttatttcttcctgtaatgataaggatgtcttcaatgcctgattggacagcttcttccacgatatattgtatggccggtttatcgacaatcggcagcatttctttcggctgcgcttttgttgccggcaaaaatctcgtacctaatccggctgctgggatgactgctttttttactttcatggttattcactcctggtcttttttatgaatctgtgccgggttcttgaaacacccaaagcttgtttccggtaaagttgatggccattcctgcgactgttgcggacatcttgctgataaaaagggacaggccggctttttgaaaaatgtacagaaggacaaatgtagcgcccgctgctgcaagattgatcatgataaaccggacgatttccgcgccatgcgctttttcttttacttgaaacgtccatgtccgattccagatatagctgtttgccacgcctgccgaataggaaaacaactgtgcggccaggtaggggacgtggagcgacgtaaggaggaaaaacacgacgaaatcaacgagtgtgttcccggctccgactgtcccgaaacgaacgagtgtggggatgttttttttgttcataacggcattcggctgttacctcccgtctattttgtgtagggctttgtaaaagcttagaaacaactttaatagacaatgttgaataaacgataaacaaaagatgaacaaactatgaaatgttttctgaggaaaagaaaaaccgttccgcttaaaaagcggaacggttactttttgaccattttgacatggggaatattcgcatctgaaaattcttcagacacgactttatagccgtgtttttcgtaaaagggaacagcctgtgtctgcgcgttcagcataaattgagacgcgccttgcttggcggcttcctcttcaagcgcctgaatgatcaggttgccgacgccgagggagcggtggcttttcagcacacagattcgttcaagtttgccgtagccgtcgacaagccggagccggccagcgccgatcggctctttttcgtcatagatgacgagatgtgaagattcctgatcaagatgatccatttcttcttccggtgatacgtgctgctccttgataaagacttcctttctaacaaagaaggcgtcttcaagctgttgttgattcttcacaatgacggcttccactggctttcttcacgctcctaaaataaaagtttcatagacggtccatgatccgttgtccaattggtaaagcaggtgaaagcggtcgatgacttcttcgtgtgacgcgtctctcattttcagcgtgccgaggacgtcggaatgctcatcatctgacagcttttgtgcgactgtgacatggggaacaaacgcgtattcgggtttgtcttccaaaacgccgctgtacattttttcatgaagctgcatcaattcctctgtcggttcggctttcatgtaaatgacattattgacgggggcaaaggaactgaattttgtaatcttcagcgtgaccggtttcagctcttttgaaagctctctcaagtgtcggacgacgcctgagatctcgtcttcagacacttcaaaaggcgttcttaatgtaaggtggggcggaattaaagcgtaattcgggtcatagcgttttcggtaggaatttgcaatgtcctgaagtttttttgatggaaatagcacaataccgtatttcattttgttccctccttaaacaattgatatggtttagtatatcaaagatgggccgatatacagagagctacagcattttttttaaagcgggggtgatgagcggctgccagtacgtccatttgtgatccccgtcaaaagctttgaaatcgtagtttgtctgctttgattcaagcaactcttttaattgctcatttggacctgtgaaatccaaaatttgatcatcggtcgttttgacggcggtttccttctcgccgatttggtggcaaattgaaataagctgcagggaatcggactgtttcactttatcgagaacatggcggtctacataaggtgactgcataatgacgttcccgaacatattcgggtagtcaagcgccgtcatgagagaaaccgttcctccgagcgaatcccctatcagcgtcctgcctgatccgacttgatatgtcggatactctctgtcggtgaaagggacgagttcatttgccaaaaaacgtttatacgcttcgaattttgacccttccggatggtatgtaagccttctttcctgtacgtttttgtacggaatgccgatgatgatgcttctttcgatttcaccgttcgccaacagttcttcaacctgtctgctgatgcgcccgagccggaaatagtcatgtccatcctgtgcgatgatcacatgatatttgtaaagcggcgagaaggaggacggcaaatagacgagaagctccatttcctcgccgagctcttccgaaaaaagctttttctcctgaatgactcctgttttcatagccaaggtgaattcctccagaaataatgtttgtgaacgtttccattcattgtaacacgaaattctcttgtgaaagaagcgaaaagggctgccgaactgttcggcagccgtgattttttatgatcgttttttttcgtaccaaggcattgtcggtctatcggagggtatccgtatcgctcacggtacctttttctttccgctgtgaaatcccgccggcttttgccgctttcgggattgttggttataatggacgatgcatcgcagcgcatcttcggcacaaggtcttcccagcagcctttcaattttacgaggcggatgatcaaattcatgcttgatgtcgcctgaaggaatgacagcctaagtcaacggcgcactgcaccattttcggtccgatgaaaggtaccgtttgaaaccgggcgggcgctttgatgtatgcggcgcttttcaaagacgaagcgagcgatgtgcaaggaaggacagatcacatatgccgcgtttcttttttttatcagatgcccccttttatagatacaggtcgaacatgttgacgtcatagccgagctgttttaaataattaaacagctgggccctgtgatggaagatgtgggtgagcgtttccgtcagccagcggctttgggtcatcccttcatcgaggtaaaacggctttgttttttttgtcaaaaaatcctcgtcggagagggaagtcatatacgtttgaaaagcgtcgaatcctttctgcatagctgcagccatttggtcagccgactgcaaagcaccatatttcttttcaatccgggcgatgacgtcctcttccttttcctgcatgatggccaagtcggcttctgggatggccgtcagatggcttgccagttctttcaggcttcgcatgcggtcggcgggccggtaagaccagtcagattccttcacttttttcagaagatgacacgtggagcggatgcccgtctccaattcgtggaacaaatcgccgcgcagcgcttgaacttgattcatttgcttcatcctttccatttgcttttattctaaaagtatcacctaatcctgacaggtcttgtcatgattcttaaaaaaagtcagccgtacctcgctaaaatgtcagcagccttccgtttcagatgaagcttgatttccgcgggttctgttacagttacctcagcgccgagattccacaaaagttctccgaaatactcaagttcagacctggggatactggcatcgatcgcccccgttccgtcatcccgcatggtgaggatcttgaataaatccacatcagccgcagcccgcctggctcctctacgtgtcagttccgcttgcagccgcaccggttcagggcactcgctctccgaatgtttgatccagctgagaactgatggatagggaagctggcgggcctgcccgctgtccgctttttccgcacggaggatgcggtcggcgcggaacagtctgaacgcctgccttttaaagcaataggccggacagtaccagaagccgttccagctgtataagccgataggctggatggatctctccgtgcactcgtcagttccgtcataaacgaccgtcaaaacggattgagtgacggctgcgtcaagaagcgtctctaaatgttcggcggcttttgggcgatgcggattccagaacacgattctgtctttcatcgcatcaatccgctcctgtgtttccgggggaaggtggcggtagaacttttttaaaaccatccgcgtttccgcatcaaaggggagcgatccgaagaactgcaaagattgatacgcgaaaaacatagccgccgcctccgattgtgtgaaaaagagcggcggaagcaccggctcattcagcaaataatagcctccgttcgcgcctgtttcagaatagatcggaacgccgagtgcgctgagctcgtccagatcgcggagaaccgtgcggtaggaaactccgaattccaccgcgagctccccggccgtaaattttcgttttgtatgaatggtcatcatcaattcgattaaacgctctgttttgggcatctgattcctccggttccgtcatttggtttcatcataccatgttcaatataaagaaagatttaaaaatgacccttgaaaaatgtcttgaattaggttaaagtaaagaacaatcagaatattgaagagattcttatcacgagaggtggagggactggccctttgaaacctcagcaaccggtctgcactgacgacgtcagtgcaccaaggtgctaaatccagcaagcggatgcttggaagataagaagaagcgaataatcccccttcttcttatgaagaaggggtttttactttttaaaggatggtgtcatatgactgaacatgtacaaacaacgctggcgcaaatcggcaaccgcagtgacgaaataaccggaaccgtcaatcctcccgtttatttctcttctgcgtacaggcacaaaggaatcggggaatccacaggatttgattacattcgcacaaaaaatccgacaagacagcttgtagaagatgcaatcgcgaaactagaagggggaacgcgcggctttgcgttcagttctggtatggctgccattcagacgatcatggctctgtttcaaagcggggatgagctcatcgtttcatccgatttatacgggggaacataccgcctttttgaaaacgaatggaagaaatacggactgcgctttttatacgatgatttttcagacgaagactgtatcaagtcgaaaatcacggacaatacgaaggcactgtttgtagaaacgccgacaaatccgctcatgcaggaagcagacattcaaaaaattgcgcaaatcgccaaagagaacgacttgctgctcattgtcgacaatacgttttatacaccggttctgcaaaggccgattgagctaggcgctgatcttgtcattcacagcgcgacgaagtatttgggcggtcataacgatcttttggcggggcttgtcgtcgcaaaaggcgaagagctgtctgaggaaatgttccagcaccaaaatgccatcggcgcggttttatcgccgttcgattcgtggctcttaatgagagggttgaagacgctcgctcttaggatgagacagcatcaggaaaacgcgcgggagctcgcggcctttttggaagagcaggaggaaattgccgatgttctttatccgggaaaaggcggcatgctgtcattccgcgttcaaaaagaagaatgggtcaatccgtttctaaaaaatctcaagacgatctgtttcgccgaaagcctcggcggagtcgaaagcttcatcacctacccggcgacacagacccacatggatatcccggaagacatccgaattgcaaacggcgtctgcaacaggcttctgcgcttttcagtcggaatcgagcacgtctccgatttgaagcaggatctcaaagctgcactggaaaaagtgaaaggggaggcggttccgcatgagtcatgaaaactggacgcttgaaacaaagcttgttcataaccaaaataaaacggacggagcaaccggagccgtcagcgtgccgatccagcacgcatcaacctttcatcaagattcttttgacaaattcggcgaatatgactacagccggtcaggcacaccgacaaggaaggcgcttgaagacacgatagccgagcttgagggagggacgagaggatttgctttttcatccggcatggctgcgatttcctccgcctttctgcttttgtcaaagggcgatcacgtgctcgtcacaaaagatgtgtacggcggcacttaccggatgattacggaagtgctgagccgctttgggattgaacatactttcgtcgatatgacggatttaaatgaaattgctttaaacataaaggaaaacacaaaagtcatctatcttgaaacaccgtcaaatccgacgctcggcattacggatattagaggggtcgtcaagcttgccaaggcgcacggctgtctgacgttccttgacaacacgttcatgaccccggcgttgcagcgaccgcttgagctcggcgtcgatattgtgcttcacagcgcgacgaagtttttaagcggacacagcgacgtattatcaggccttgccgtcgtgaaagacaaaaagctcggcgaagaactctataagctgcaaaattcgttcggcgctgttctcggcgtccaagactgctggcttgtgctgagagggctgaagacgctccaagtgcggcttgaaaaagcaagcaggacggctcagcagctcgccgaatttttcgaaaaacatccggccgtcaaacaagtgtattatccagggctgtcttcgcatccgggtgcatcgatccacaaacaccaggcgaacggcgcaggtgcggtcctttcttttgaacttgaggatgcggaagcagtcaaacaggttgtggaaaatgtctctctccctgtcttcgccgtcagtcttggagctgtggagtcgatcctttcttatccggcaaaaatgtcgcacgccgccatgccgaaggaggagcgcacaaaacggggcattaccgacggacttctgcgcttgagcgtcggggtcgaaaatgccgatgatttacaggcggactttgcccaagcgttggaagccgtatccggagcgcttgcccgttcataaaagaaggcgcggattcgtcaaggaatccgcgcctttttttgccatttataacagggtggaaaaccatgtgcccaagaaggtgccgacataattgccgatcagatatccgaacgtcccgaccagcattacgggagcaacgaggccccgccagcctttggcaatcgccatcgccgccgctgtcgtcggtccgccgacagatgcgttgcaagccaagagaatttcatcgagccgaaaacgaaacagctttccgcagaagagcgatacgagcaggttggacatggcaatcacaaagacaaatgccaggaggagcggggcgttcatgaggatgatccgcaaatccgccggaatgccaatcacgacaaagaataagtaaatcaaataagtcccgatctcctgtgagccgcgcagccgttcaaaatagcggggaaacactaccgtcagcaaaattgtcagcgtcgtcagcagcaggaactggtcgcccagaataaaggcaagaaactgaaatccgccgtcagaagaaaaacgttccttgaaaaaagccgctgcttttacagacacagcaacgatcgcaaaggcggttccgatgtttaaagcgatgtcctgcaaggagatgtcttttctcttccaataggcttccgcctgattttcgcggccgcccgccacttcctgaacgccgaagcgtttttgaaaccatgttagcgccggtatccccattaaaatgaaaaaaagaaaagccatcataaaattatccgcaaccaccgtcgatgatacatactcaccgggagttgagaacttggcggccatcgctgcaaaattcacgcctcccccgatataagaggcgctgatcatgccgccgattttatcaaggtgcggaatctgatccttaaacagaaaaaaagcaatgacgcttccggccgcagtgcccagcgcgctgatgcaaaacatcatcaaaagtctgccgctttctttcaggatcttccgcacattgatttgaaaaagcagcaaaggaatcgcaagcggaacaacataggaccacaccgcatcatagaagggcgactcggccggaagaatccctgcattagtaaacagcatcgatccgcccagtgccaatacggcccccgatacagcggcagcccagcgaaaccgctgctctaaataaatactcacagcagcccacaccgcgataaatccccaaagcacccacacgtcatccggtgaaatcaatgaagaattcataaaaaaaccccctgtttccggttagtgttttgaattatctgataattaaatagtgtaaaacggaatgcctaattgatcaatgatcataaaaaaagtcaccatgttgacaaaattgcagaaagagggtattgtacatttgtcagcatgttgactatattcaaaggagagaacaaatggatatcaacggcttaatcaacgaattacatttgatgcagcaaagctatgcgacattgttttcggttgtcaataaggtgcaaacccgcggtgacgaatatatggaaatattaactgccaggcaacacatggcgctcatcgctatcgcgcatttgccgcctgaaactgccacgcttacgaatatctccaaaaagcttggcacaaccaaacagaccgccaacaagctgatgactggtctggtcaaaaaaggctatgtcaaatcagtgccaagccaaaaagacaaacgctccattaatattgaaatgaccgctgaaggaaagaaagcgctggtggagtgttccgaaaggtccgtctatttcctggccgacttgtttcagcaatttacatccgaagaggttgcgacattttggcggctgttgcaaaagctttaccgttttgacggtgaggaacatgacggttttgaggagaatgcaaacattcagcttggcgtggggaattcgttagatacagaaaggattctcggagaatttgagaaacgccgctatggaggagaaaacgatgaaaagtgatctttatgtaaaagcaacaacttttaaaatcaaggcaaagaagaagttctatcatgcaaaagataaattccgccagacaaaggaaaccattcgccgcggcacaaaattagacaggacaggcccctttttctcaagctgcattgctctgatcattattggatgttcctgggggacaaacgcagaatggctcgtctggttaggggccgcaagtcttttaagcaacgttttattgctgtttgcaacattttttcgccgtaatcaaaagtcaatttgacattcattgtgcgtctaatggatcgtatcgtagatcaatcaatgacttgcgacaaggatgttcagaaacttattgaattgtagaatagtgatttcaaagacaagaagccagtcttgtctttttttagttgaaacctcatatttccatatgcgtataaagaaagggaggtggaaaagtgaaacagaacaaaagagaacaacttgttaacctgtttagtgtgttaaaagaaaaaggtcagatcaacgcggcagtgctagtcgctgaagacggagacattctttatcaaggcgccttcggatatgaaaacttggcagataagcgtttattgcaggaacattccttatttgaattagcatcgctatccaagccgttcactgctttgggcatccttcaattagcccagcaaggggaattgaaaatcgaggatcccgtagaacggtggataaccgggtttccctaccagggcgtaacgattcgcgatttattgacacatacgtcgggtctgcccgattatatggagtggtttctacaacattgggatcataacaagattgctgttaatcaagatatcgttgatatgctgatgaatcatcatccgcaacgctattttgccccgggtgaaggttggctttacagcaatacgggatatgtgctgcttgcggttatcattgaaaaggcatcaggtctgagttttgcagaatatatgaaaaaaaacatctttgaaccggtgaaaatgcggaactcaagggtttataacagaaggctgcagcctgaaaccattgagaactatgcgtatggatatgtgtatgacgtgcatacagcacagtacgttctgcctgatgaccttgaagaaacaaaatatgtctgctatcttgacgggattcagggggacggaaccgtaaactcaaccattcatgacttatatttgtttgatcaagccttatatacagattgtttgatcaatcaagtctcaaaagagcttgctttttctcccgcgtctctgaaaaacggagagtctatagattacgggtgtggatgggtgcttcgggatagtcctgaaacagggagaattgtcggtcacagcggcggctggccaggctattcaaccgtaatgatccgatatatcgatcagcaaaaaaccttcatttatttgagcaatgtggaacaggatgatgaatatgaacaggccatctttgaagccgttgaaaatatcctgtttgacaaggcctacaaaatccctgatcgccctgccgataaaaagaaaaaagagatcgatccggccatttacaaaagatatgtcggaagttattcacttcaggatggcaccgccgctgatgtgacagttgataagggccggatttatatgcaaatcaccggacagatccgttttgaattatttccagcctcggaaacgcgcttttttctcaggtcattgtctgttgaagtggaatttattttggaggatggtgtcgcaacccggttgattatttatcaaaatggcgcagaggaagaagcggtgcggatagtggaagcaaacagcaaggtatgaccgttttgtttgagcgtttggcggcctgtgtctgttgtctgtcagaaggaaatttatcgtttgaaggttgactatgcaattcggggatatctgcccggctgaatttcctgatgagcatcaatcggatattcatggtaaaggtgctccatctataaggaggttaatgaggctgaacaaatttaacctgttgaaagagccctgggtgatgaatatagtggcatgatcattttgggataaagcgtttatatggaactgctaaagcaacagaaaaaaccaagcagaaaacatctgctcggtttaataactaatacttcggccagcctttagaatcccagtttaaatcattgatcagcagcttaggcgccccgttgtcaagcgcatcataaccatgtctgacgatgatgttgccgttcacgatatccgcgccgcccgggcccttccactggtcgtttccggagtcgaggattgtgcctccgccttccgtcattttcttgccgcttttgtcatagtaaggccccgtgatttttgtcgagcggccgtaagcgatcttatacgtgctgttcacaccttgacagcatttatcgaacgaaacgaataaataatagtagccgtttttatatgtgatagacggcgcttcaaccgctcctccgttgttcggccttgatgcgatggaataaaccttccctgtaggtttcatcgtttttttatcaagctttgtcagcttgatgccgctccaaaacgagccgaaggacagccacggatttccttctttatcaatcactaactcagggtcgattgcattataattgttagaggtcgtcgtccggatgacaagcccgtcgtcgcgccaatttccggatgagattcggtctgttgaagccagtccgatcgccgaagtattggagccgaacgcggataccgcataataaagccaatagcgtccattataatagctgatatcaggcgcccattggttttcttcatggttcggcacgtactttttccaccatgataatggagttgcaaatatgcttggcgctgcgctccatgtttttccgtctgtcgatttgatgacgcggattccattgccgatacccgtgccgaatgtataccacgtatttccttctttaatcatggaaggatcatgaataatgttgtctccttttgtatcccaaaaagccgctgatgttggttcagccgccgagaaaataagcagaaaaaataaaataaaaccagaaatgatagtcttagccacagttgttctcctttcaaatttcgatgtctttaacattcggccctcccttttgtgaaatatttcccaacaagacgaactttattttagcagggattggctgtctctcaatcagccaaaggacttgttttctagtcctaaaataaaacgaaaaaaccagaaaatatccatattaaaaaaacaatcacctaaaagtcatttcatcgtctgaatgtaaaagggatgatgtaattattttggcttatattggaacattttaggttaggtgaattatcaaaaactttgagatgttcgtggagaaaataaaaagcgttggaagaagaagcacggtctcccctcgaatattttcattagccccggaaggtgaatgacacttttagttgatttagtgggttgaaattgataatatgaatttgaagatagactgtcaaaataatgcatcacaaaagacgcaggcgcgtcatctacgtacggtttattaaacgttcaggtgtattttttctataagaaatgcataaaataaaaaagacccgactgcgccaacagtcgagtcgagtgtacaaagcggcccaacaagggcttggctcagtcattttaaaatagactttccctatgaactttaccagggctcaagggaagtctatttttctttcttcgacaacacggcaattaacatgccaaaagcaatcattaacgagattgtttcgaatgtcgtcataagcatcaccccctttcataggggatgagccagcttcccttgagtgagccgaaactttgtacaaagaatattttaccatacctctttcaaacactgaggctgttttttgatgttgaggcgggatagaggagaattaaataaaacgaaacacaaaaacggcaggaattccattggaaatcctgccgtttcgatttggtatgattccgactgggctcgaaccagcgacctctaccctgtcaaggtagcgctctcccagctgagctacggaatcatgatatgtaacactgggtatttgtttcgctgacaagttctattatatgcagattaggtggattcgtcaacagtttttttgattttttttgagaactgggaaagagtcttgcagtacgccgcgcgttatgaaaatattgtcttatatagaaatcaaaagggagcaggaattggatggatctgatacttaaaagtgttgatagtattttaatcgtatttttagcaatcttttttatgtggaaattcgtttatgaaattaaacatgagaagcggaaggctgttatcttgcttttgctgctcatcaatgtctattttattgtaaaagtgttcaatctcgtgttgcaattgatgtagcgaatataaaatgcagtcaaggagaccgaaatcaatgaaaacagaaaagcaaaaaatgctggacggagagctttatcatgcttctgatccggtgctgtgccatgacagactcaaggcgcgcaaaattacgaatgaattcaaccattcgaacgaaatcgacgacaataaaaggaccaagctaatcaaagagctgtttggatcaacaggggaaacgatcctcatcgaaccgtcgtttcgctgtgattacggctttaacatacatgtcggggaaaatttcttcgccaattttgactgtgttttcctcgatgtatgcgatatccggataggcgatcattgtatgctcggaccgggtgtccatatttatacggcgtcccatccgctcgatccgtccgaaaggataagcggtgcggagtacggaatacctgtcatcatcggccggaacgtttggattggcggcggcgcggtcatcaatcccggcgtcaaggtcggcgacaatgcagtgatagcttccggagccgtcgtcacaaaagatgtcccggataatgccatcgtcggcgggaatccggcgaaaatcattaaatacgttgatagcaaaaacaccaattctatgtaattggtgtttttattttgccatagacgcggtgaatgtcggggctgataaaatatccgcgggaagcagtttcctcccgcggatttaagtgctgctatcgggtgaccgtaatattgttgatgacaagctgtcccaatgaattgagatacgaaaatgtcgctttgcctgggcttacggcctttacgtatacgcggtccgaagtgattctgacggtaatggcgctgccgctgtaggagacgttcgaaatgccgacgtattgatcctcctgtccgactctcatctgcctgttgatgacgatcgcctgaggggcgatgattccttgtgcaaatgcgtgagaagagagattttcagtcttcgagagctcctgggcctgtacatgcatgggacttcccgaaacagcaaggatacccgccagtaatgatgaagcaactaaacttttacctaaccacttcataaccatcatctcttttcctatgtgatggttccaggatatgggattgttgggcggcagtcaattggctccaatgatgattcacacattggacatacgaaaaaaaacattttgtgaagcggcaggaaaaacgactcattatttcgaagatgttcttttgttcaaagcgttaataaaggttttcacatttttcttgtcctgcatgacaggtgaatatatataggaaagcgtcctgttaaaggtttgatttttcagccggataacggaaaggtttccgtgctgtacatctctttcaatgacgcttccagacaggagagacagtccgatgcccgtcatgagcgtttctttgatcccctggttgctgctgatcgtcagaaacgatttcacttttaaaccgtttgaacggatgacatggtttaagtattcgcgtgtgcctgagccgacttcgcgcgttacccacgtttgattttgcagatcggagattgtcacgtcctgtttggccgcaagcggatgatcgcttgaagcagcgatgaataattcgtcctgcataaaggcgtgtacagaaagctctttttcatttgtctgtccttcgatcaagccgatgtccactttgtacaggcggacggattgcacgatttcttccgtgtttccaatgacggccttgagctcgagttcaggatattccttttgaaggtcgaagaggagcgaaggcaaaatatattcaccgattgtgaagcttgcgccgattttcagctcgcctttgatcgagttgtggtgatcgagaatgtcctgcctcgtttgttcatagatggtgatcatttgtttggcgcggtcgtataaaatttcaccggtcggcgtgatttttaaatatttcggagagcgttcaaataatttcgtctggaattctttttcaagatttttaatgtgcatgcttacgctcggctgcgacatgagaagaagctcggccgttttcgtgaaatttttgacttctgcaagggtaacgaatgtcttcagcgcatcataatgcacacgaatctctcctttattaaaaatcttaatagctgtgataattaatatatattttactaatgttgagtattccagtaaacttttaattagaatctttttttaggaatatttggtttgaagcaggatgacgccgcgcggcaaaggggacgtgatgagtgagcgcttacaatgtttcttagcagcaaaagccgtgatcgacagatgctttgcgtcaataaaaccgatttgatttataggaatagtggatatatgatgagtattatccttttccgtttcaaaacaagtcatgatttttttattccttagtgaggtggatatcgttgcaacttcaggtaatgaacagtccttttaatcaggagcaggcagagctcctcaaccgtcttctgccaactttgacggcatcacaaaaagcctggctgagcggttatctggcagctgtgcaaaccgccgatgccgcggcggctcttgaaacattgccggcggaagctcctgctgcaagcccggctcagcctgtttccaaagaagtgaccattttattcggatcgcagacaggaaatgcacagggacttgccgaaaacgcggctaagacgcttacagaacggggatttcaagtcaccgtctcttcaatgagcgattttaagccgaaccaattgaagaaactaaaaaaccttctcatcgtcgtcagcacgcacggtgaaggggatccgccggacaacgcgctgtcattccatgagtttctccatggaagacgggctccgaagctcgatgatctccgttattctgtgctggctcttggcgacacgtcgtatgaatttttctgccagaccggaaaagagttcgaccagcggcttggtgagcttggaggcacaaggctccatccgcgcgtcgactgcgatctcgattatgatgagccggctgcagcatggcttgacggtgtcatctcaagcttaaacgaaggacaggaacagggcgcaagcgccgcacctgctcaaacggcagctccgcaagccgcgggaggagtaacagtatattcgagaaaaaatccgttcagagcggaagtgctggaaaatttgaatttaaacggccgcggatcaaataaagaaacgcgccatcttgaattatcgcttgaaggctcaggtttgacttatgaacctggcgacgcgctcggcatctttccggaaaatgaccctgaactcgtcgatatgctgctgaaagagctgaaatgggatccgaatgctgccgttgctgttgatcaaggggaaaacctttctttgaaagaagcgttgacttcttactatgaaattacggtgctgacaaagaaattcattcagcaggcggcagaaatcattgaaaatgaaaagctgcgcgagcttgccgctccggaaaatgcggatcaattaaaagcgtatatcgctggccgcgacctgattgattttgtgcgggatttcggtccgatcgcagcagctccgcaggaatttgtatcgattcttcgaaaaatcccgcctcggctttattcgatcgcatcgagcttcgctgcaaatccggatgaagtgcatttgacgatcggtgctgtccgctacaatgcgcacggcagagaccgaaaaggggtctgctcggtattatgtgccgaacgtctgcagcctggcgacaccctgcctgttttcattcagccgaataaaaactttaagctgccggagaatccggagactccgattatcatggtcggccccggcacaggcgttgcgccgtttaggtcatttatgcaggagcgcgaagaaaccggagcatcggggaaatcgtggatgttcttcggcgatcagcattttgtcactgatttcttatatcagacagaatggcaaaagtggctgagtgaaggcgtgctgacaaaaatggatgtcgcgttctcgcgggatacggaagaaaaagtatatgtacagcatcgcatgctggagcacagcaaagaattgtttgagtggcttgaagagggagcggctttctacgtttgcggcgacaagaacaacatggccaaagatgttcaaaacgcattgcttgaaattatcgaaaaagaaggcggcaaaagccgtgaggaagctgaagcctacctcgcagaaatgaaaaagcaaaaacgttatcagcgcgatgtatactgattttgattgaaaggggactttttcaacatggggaacgaaatattaaaagcgcctgaaggcccgccgagcgatgtagaacgtattaagaaagaaagcgattatttgcgcggcaccctgaaggaatcgatgctcgagccgctttcagccgggatttcagatgacgacaaccgtctgatgaagcaccacggcagctatttgcaggatgaccgcgatctccgcaatgagcggcaaaagcagaagcttgagcctgcgtatcagttcatgctgcgcgtccggatgccgggcggtgtggcgacgcctgagcagtggcttgtcatggatgagcttgcccggaaatacggaaacggaacattgaagctgacaactcgggaaacattccaaatgcacggcattttaaaatggaacatgaaaaaaacgattcagtcgatccattcagccatgctagataccattgcagcatgcggcgatgttaaccggaacgtcatgtgcacttccaatccgtatcagtcagaaatccatcgagaagtgtatgaatggtcgaaaaaactgagtgatgacctgctgccgcgcacacgtgcgtatcatgaaatctggcttgatgaggaaaaagtggccggcacgcctgatgcggatgaagtcgaaccgatgtacggaccgctgtatctgccgcggaaattcaaaatcggcatcgccgttccgccgtcaaatgatatcgatgtattttctcaggatcttggttttatcgcgattgtggaggatgacaagctcatcggcttcaacgtcgcgatcggcggcggcatgggcatgacccacggggacaaagcaacgtatccgcagcttgccaaagttattggcttctgcaagcctgaacagctatacgatgtcgctgaaaaaacgattacgatccagcgggactacggaaaccgttcggtccgcaaaaatgcccgcttcaagtatacggttgaccgcctcggcttggaaacggtcaaaaacgagctggaaaaccgtctcggctggagcctcgctgaagcaaagccttatcatttcgagcataacggcgaccgctacggctgggtaaagggcgtaaaaggaagatggcactttacaatgtttgttgagggcggccgtgtcactgattatgatgattacaagctgatgaccggcttaagggaaatcgccaaagttcataccggcgatatccgcctcacagccaaccaaaacttgatcattgccaatgtcacaagccaaaaaaagaaaaagatcagcgagctgatcgaacagtttggcttgactgacggcaagcattatacagcgctccgccgcagctcgatcgcatgcgtcgcactgccgacgtgcgggttggcgatggccgaagcggaacggtatttgccgaagctgattgacaaaattgatgaaattgttgaagaaaacggcttgaagaatgaagaaattaccatccgcatgacagggtgcccgaacggctgcgcccgccatgcgctcggcgaaatcggcttcatcggaaaagccccgggcaagtacaatatgtatctcggcgccgcttttgacggcagccgtctgagcaaaatgtaccgggaaaacatcggcgaagaagaaattttaaaagaacttcgcaatattcttccgcgctatgcgaaagaacgcaatgaaggagaacgtttcggagatttcgtcatccgcgccggaattgttaaagaaacgacggacggaacgaattttcatgactgatgagcattttaaaaaaacgcctcagcccattgattggtgctgaggcgtttttcttttttacgaaaatgcccggacagtttccgactctatgatcattttcataaactctgcagccgcaggtgttgcttcttcaaatgagggtgttatcatgccgacttcgcggataatttgaggagagatgtcttttttgatcaaccgatgggacacggaggaaagcgagaagcttgatatcaagccgattcccaaattgttatgaaccatattgaccaatgtttccgcgttttgcacagtcaggttttcttttaactcgaggcggtgtttttgaaagatttgagataccgcgatttcgtgcccgcctttacaaaaaatcaattcattttgatattttttcagatcaatgaacggtgcgtcttttaagtggtgatattgctcaggaatcacggccgtcatccggttggctttcgaatccgtcaaagggagaggcgacgattcctaaatcaaccatgcgagtttcgacccattgcttaatttggtcggaggttccctcaagcagttcgatttgtacgagcggatactttgatctgaaggaggcgatagcctgcggcaaaatatttgctgagacggcggggaaggagccaaccttgactttccctctgagcagatgattttcttgatcggccacttggtatattttgttttcaatcacgatcatctgtctcgccagtacgacgatttcctttcccgcgtccgtaagttttatcttgttttgtttatcccgaatcaataatttgaccccgagcgacgtttccaagctttttacggctttgctcacggccggctgtgaaatatacagttcgttggctgcttctgtcatattcaaagtctctgcgactttcacaaagatgtgaagactgttcatgtttataaccaaatagttatacccccgatgataaaaatgtatttcagttatatctcaatatagcatatgctgaacatgaaacaaagaagaaaggtgacggattatgtttaaagtacttttggggatcatctctgtaacgctgatttgggggtatacctgggtgacgatgaaaatcgcaatcactgacattccccctgttttattttcggccctgcggctgttcattggagctgttcctttgtttgtgattctcttgatcaaaggaaggaaacgttcaataggaaaggagaatatcaagcattatctggtgatgagtttattgatgggtttaggttatatgggggtgttaacttacggcatgcagtttgtcgattcgggaaaaacgtctgttttggtgtacaccatgcctatttttgttactgtcatcagtcattttaaattaaacgagaaaatcaatgtgtataaaatgctcggtttattttctggtctgatcggtcttttgtttatattagggggcgggattctgcatgttgatcaaaacgtcatatttggagagctttgcgttttaatcgcagcgctcagctggggcgtcgccaatgtttacagcaaactgaaattcaaaaatacagatatgattcatatgaatgcatggcagcttctcacaggagcggtgatgttattgattttctcttttatactggaaccgtcccggccgattcactggtcaaatgaagcaatcttgtctctattgtttaacggtttattctctacggctttgacgttcgtcatttggttttggatactgaatcaaatcgaagcgtcgaaagcatcgatggctttaatgtttgttcccgtattaggccttttgttcggctggctgcagctgcatgaaccggtcacattcagcatcctgatcggcgcattcatgatctgcatcggcatttttatgaatacttatcaatttaaaaaagtgtaaaaaaaggcagaggatctatatggtaatatgaaatgggagggagatttatgaaaatcgaacacatcgccatatggacgaacaatttagaggaaatgaaagatttctatacccgtttttttcacggaaagacgaatgaaaaatatgtcaatccgaaaaagcatttcgaatcatatttcatccagtttgaatcgggaacacggcttgagctgatgagacgccccgaccttgcaaaaggagaggagaacgcttccggctatgcacatatggcgttttccttagggtcgcggcaagaggttgacgagatgacgagccgctttgaaaaggaaggataccaggttgccggaaagccgcgcgtcacgggagacgggtattatgaaagagtcattctggatcctgacggcaacatcgttgaactgaccgtttgacggaaaaaagctaatgtccgtttttagacattagctttttcgtttagatggcagcatcgagctgattgattttccatttgttgttttctttcacaaacgtgatctttcttttcgcagtcaccgatccatccaatgccggtacggaaaattcataagtgcgggtattgtttttttgagagatcagtttgatttttgccttgtcccatcctaagaggttgtccccatcgccgacaggcacggccatttttcctttataagaaatgatgttgtatttttccaagccttttttaatggcgtcttttgtgaaaaccggcgtcaagtagtctgttaattttgcttttgtgctgaattcactgcacatatacgtatatggaagaccgcggtattcaaatgttttggatgggcaagttgagtttttcgcttttggattgtggccgctcatcgtattccaaaagtgctcccgtgcctgcaaggttaattgcatgacttgcttatttgttaaattccctgatgtttgatttttcgctgcgagggacgctccggcaggcaagatcagtaaaacagctaataaacaaacgattaactttttcaatggtcctctctccttaaatatatctcttatattacaatatgttacaataattacagatagattacaagaggtttgcgagaaaaattttcctccgctgttttcttatatatgacgacataaaagcagccggggttatggtttgtccaggaaaatattttatgtccattgattcgtttcccggatttctctcctcataaacatagaagcctcatgttgaaaaagtattttatattgaaaaagaattctatctgggacctcgccgggagcaggaaagaggatcactgaaacatcaatgaattatattgttaaaaatcagaattttatataaaatcaaactttatcagtaaaaaaactgtaacgaaattcgcatcaatctgtcatagcggtgacattttgctgtgttacgattttccctgttagtttcaaaagggctaacaagggaggatttaacttatgaagaagacaatcatgtccttggctgcagccgcggctatgtcggcgactgcattcggagcgactgcctcagcaaaagaaatcgaagttcaaaaaggagacacgctctgggggatttctcaaaactacggaatgaacctcaaggacttaaaaaaatggaatcagctttcatcagatctgatttttccaggtcaaaagctgaacatttcttctcaagaagaaaaatctgaagaaaagcagtacaccgttcagccaggggacacgctctcaaaaatcgcaaaagagttcggtgtgactgtaagcgatcttcaaaaacggaacaacctgaagtcagacttgattattgcagggcaaacgattgcaataaacggagaagcggcagctgcagcagcgcctgtgaaacaagagtccgctccaaaacaaaatgatcagcctgtcaacgtacaaaaggaaatcacagtgaccgcaactgcgtatacggcaaatgacgggggcatttcaggcatcacaaaaacgggagtcgacctgaatgcgaaccgcaatgcgaaagtcatcgcggttgatccaagcgtgattccgctcggcacgaaagtatatgtggaaggctatggcgaagcgacggctgaagacaccggcggcgccattaaaggccataaaatagacgtatttattccagataaaaaagacgctttcaattggggcgtcaaaaccgtaaaggttaaaattttaaactgatataaaaaatgcaggaggcgttaattgcctcctgcatttttttgtcgaacgatgtttatgctgcatgctgttccgcgcgtctgctttttacaaaaaccgaaatcgcaagagcggcggctgcaaaggcgatggctacgaaataaaccatatgaacgccttctgtcatgccttgcatgtgcagctcctgacggctgcctccggaagagtgcgcgataaagcgattcgaaacggttgtcaggatcgtcgtatacaatgccggaccgattgcccctgaaacttgattaactgtattcattatcgccgaaccatgcgggtaaagcggtttgggcacctgattcaaaccgagcgtcataatcggagccattgtcaacccgacgccgagtgtaaagccggcgtagagcatcattccgaccgccatcggcgtatcgcttgaaatattcgtaaacagcgaaaggacggcaatcacaatgatcaatccggtgatcaacagcggtttaaagccaagcttatcaaacaggcgccctgcaacaagggatgtcatcgcgaggacgaggccgcccggcagcatgagaatgcctgtataaagcggtgacagctcaagcgccatttggaagtaaagcggcaaaatcagcatcatcgaaaactgcagcatcatcacgatccacatcaggataaccgagattgaaaatatctttgaacgaaacggcctcatatcaagcatcggcacttccaatctgagctggcgcatgacgaacaatattaatccgatgacaccggccgccagtccgatgatgactttcggactgctccagcccgctgcttccccggcgttgctgaagccgaaaacgatcccgccaaatccgacggtcgataaaagaattgataatatgtcaattttcggatacgtcagttcggttacatttttcaagcggaacgccgcataaaaaatcatgaagaccgatactggcagcatcatgaagaaaacaacgcgccatgaataatgttcgacaatatagcctgagatgaccggaccgatcgccggggcaaataagataacgagcgtaaggatcccggtcatcgttccgcgtttttgcggcggaatcaaagtcagtatcacattcatcacaagcggcaatatcaggcctgtacctgaaccctggatgatccgtccggcgagaacgagcgggaagaccggagcaattccggccagcaaggttcccgctgtaaaaagcgtcatcgcagacagaaacagctgccttgtcgtaaagcgctgcattaaaaacgcggtaatcggcacggcgatgccgatcatgagcatatatccggttgacagccactgggctgtgttcgctgaaatgccaaaatcgtcgatgattttcggcaaagccacattcatgaccgtctcattaatcagagcgagaaaatttccgacgattaagattgcgataatcatgaaggagccttttctagcttgttccatttgtattcccaccctttatgaacgttttagcaaaaaaggaatttgttcggcggctgcactgagaggccggccgttttttttcgtcactgagagcacatacgcaccctcaatcatcgcttgtatcgcgacgctcagcgtctcggccgtttccggcgcatagcctgactggagcagtttttcctgatagacaagctgccagtcttgataaacctgttcacacgtttggcggagcctttcactgaacgaccacgtttctgcggcgacggatacgatcggaatatcgtcgttttcttcgatgatgtattcctcgattccgtcagccatcatctggatataagattgaaacgccttgacaggatcagcttcaccgctgatcgctgacgatatatacgctttgattctttctccggttaattgaatcgcctcttgcgccagttcctctttgccgccggggaaataataataaagcgatccccgcggcgctccgctttcggctgtgatttggcttaagcctgtggcatggtagccttgtttgcggaacaatcgtgaagccgtccgcaaaattttgtcgcggctgctcattttttctgccattctatcattcccttatgattttatactgatcggtctatataattttaacgaaaaaaaagaccttttttgaaggcctgttttaaaataaggacgatttgtccatattcggttcagcgggaatccgctgaaggcttcagaaagccggcaagcagcaggcgccacagcaatcgctgccaatatcgacaaaaggctgtcagatatgaagtgaacaaaagcggaattgatggtatagagtgcgagcgccgttaaataaacggctaaaaaaacatagccgaacatttttctgcggaacggtcttttgagttgaatcaaaagaaacaatccggccattaaaatgataaacgtcacagttattctcccttcgcaggaaagtttctcaatcctcgtatgtccggtttctttctttgttgtcttcaaatgccagatgaatgacgaataaaaacagacaggcgatgatttcgacatccagcgggatggtgatgctgtccatcaattcatcagcgagatggatggcaagccaagtaaaaaaacattcgatcataaaggtcgcagctttatgcccaatcataaagctcagaattttttccgggatttcaaacagcgcgccgaggccaaaagataaaaggatataccagaagagcgaccagggcgattcgtatgtaacgccgaaaatcgcaaaaaaaccggcgacgccgaaataataagacccgaaaaagagcgtaaacacagtgaggatcaaaagaaagatcatagtcactgcgaacatggtaccgagagtttttttaatcattaatcattcattcctaatcatgcagtgtatattcatgatatcagaaaaatatccggttgtgagttataaatgagattttggggttaaagtttgtgtggatgggggagtgaagagagcgttctgaaaaattcctaaggtgtttttcgagacctaattaatcaccatatatcatatttggagcgttttcataagggctgcaatcaagaggataggatcccaaataaaaaaggctgccaaccggcaaccttactttgttaagcatatttcgtatttgcttgttcttaaaccgacgtgtttacccgaagaatcattttcgtgccttaggtgattttcgattttggttcaattgcttttttgaatctcatttgtattgtctattcattttcatcttgattagattcaaggtattgctctaaaaattccttatcatcttcatcttctggccagagtcctaaatatttgtgttcccatacaattcttctttcataatcatcagcatctgataaatcctcatagtcgtagtcgatattaaattcaccatcactgtgaatgatcatagagagactcgtccaagtctcttgatcactattcttaaattcgtaccatagcttttctaagttattgattaattgtctccaaagatttcgataggcttctttttcaatcctaaaaaattcagggatattatgacaatataccggtgaatcatttccttcaggataataataaaagaatcctttttgcacatcttcaagaatttctccataaatcaaaatctttgaccattcctctggaatagtctcaactactgtctccgcaatttcttgatatatcgtgtttaattgattttcatccattggctacttacctccaggcttattatcaaatttcacaacttcccattcccgttttccgattttatattctatctcaaagcttgccggtctttgggaattccctttgtatactggctgtattttaacctcaactgttcttcctttttcgaggtgtttggcccacatgttctcaagctttttccattctcctttatttaagttaccatccatcggcacaaggttgtcaagctttccagacccttcgaatatacttgcaatgagatgaccgccctcatcggtttttaatcgatcttcacggccggcaattctttgggcgtatttgtttctctttgctgctcccaaatttagtttgccgctgacatttgtaatacgtcctttatgatcagttttataagtatagcctacaggcgttgtatactcaatgttcggttttaacacctttcttcttttgactcttgtgaaatggtcaccatatttcactttatggatggtttttgagtctactttaatgtctgtttttgttttggaagaaacacccgcaatgatgctgaccattcgatttcttgcttgttttgcttgatcagaaatctttttggtttgttgaattaatttatctttcaatcgagatccatctatcgtattgaacggaactttaccagcattggctaaagctagttgaggagaagcgatttggactttcggagtgagatttttaatatctttaaaatccctgacaactttatcagctgctttcttacctgcctttttcgcactctctatgcccttgctagctgtctttttagagacatcctttatcttagatgcggcttttcccatcttgcccgccttagccaacttgctaactttgtctgcacctttcgttccgacaatggatgacgcaaccattccggtagcgtatgtaaaccatctcgccctgctttctgcatcaccattgatgacgtccctcacgaaggagtcctcgatatctttctttatgatttcaaatgtttctacagggtgggtgactgtgtaggcaatgccctctagcgtttcttttggattggttatggtatctcgtattcctgtcactgtatcgacggccacatcttctattccttcttcaatgccctgcttaatacgccccatgataccactttgttttcgttttcgatttatagtgtaaaaatagtaattttgctgcttttctgtcagattttcaattccaatctcttgtgcaatctcaacaaattcatcaggatcaatgacattttcgagcttttcctttaggtgagagattttattaacctgtttgttagcttcactaacttccttttcgagttttgatctcttatcgagcttagccaacataacgcccatcgctgtttcctggtttccactcaaggtatccattttatcctgttttaaaatagaacctttctgatagccggtgatttcaattttagggcctgtgtacattttttcaagcctagcgatgtatctttgcattgtttctaagtcgttttcagcggctttgatggtgttcgtctgctccctgtcgaatgtatgtaatttttcaattgtctgattgatttcttttaaagctttcgagtaattctcgtgaaaattactgtcatctaattccggcaaatcgactatatggctgactttagcgattgtagcattcgttttagaaaccaaacgcttcgtggtgcgatcggcatctttcactccttgttccagctcattatcgaggaaggcttgcgaaatatatccattgtgttgtggctccagggaattcaatgcacttttgattttcttcaatgctgattgatattcctcgataaaagtttcaaaaaattgaaggaatggggtgtgacactctttataaaaattccgtattgcgtcgccgccttttccttttaaggcatcgttgagcgacgtgataccttccacgctttttttaatgttgacgatttcttccgattgttgctttaattgttccaccgtttgatcaatcgctttgtgcagcgcctgaacgtccagagtcttcatggcattctcctctaatactaaagttgcaatcattttagagtttaccactttacggaagggtattggtgaatacatcctgtatacccaataaaatgaacctttcgatttaggtttatatacctactagagatttcattatcctgaagccaaaatatttacaaccgctgcgactcccggtacactacataaaaacaggacaggcaggtgcaaaaatcgaaagatgaagcgggctttaactgaccaatacggcagctttacagagatggcagaaaacgaaatagaagggaccgattattcggtggctgctcgggatgcagggagcgctctgcttgtgatggctccccacgggggcgggatcgagccgggcatcagtgaaattgtcaaggcttttgcagagggcgcttcggtttatttattggaaggattgaaaaggcgcggcaataagagccttcatgtgacaagcgctcattttgactgcccgcttgccttgcgaatggctgcaggacaccggtacatactggcttttcacgggtatgaggagcctgctcatcgacatacgctcatcggagggacagatcgaaggcgcgccttgatgtttaaggagacattggagaggcacggattttctgcggagctggcggctgaaaggggctatctttcaggtacaaaccctgcaagcatcaacaatcgctgccaaaccggtttaagcgtgcaatttgaaatcagcacagcccagcggaaggcgatgtttgagcaattcacattaaagggcaggcgaacgtctcaaaatgaggtgttttcccgctatgtcaaagctttgaaggaaggagcatgcatcgcatatgggccgagtgcagccggcagctgagccggctgtttttttattttctcagcatataagccggccggctttccgcagcgaccattttgccgaggccgtttgccgctgcgtacgggcggcgggtttcccgccggtagcgtgcaagttcgtctacttcttcaaagcgtggagcattcgccgattcgctctcttgggaaaggcttgccatccacgcctcatgaaactggattccggcctgccgtttttcaaagagctcgatccgtttgacagcgaacgactccgtgactttaaagaggtcggcgatcattttagcggcttggcatcgcagctgaggaaaatccatttttaaaagcataaaagtagggacgcaaaaatggtacataaattgattggcctggaactcctgcagctccctgaacatctgattcatgtaaagctggtttccggcgtgctttaatacgtggcacagctcatgggcaaagtcctcccactgcttttcctttgaaagactgctgttgagaataatgctgtacatgccgtcatgcttaatcatcatgctgttgacattttcatagtgaatccaaatattaaaatgagcggctatgcgattcatatcaatctggtgaggttcaaaaaaaccgaacttttggtacatatttttgacgtattcttctaggtgagataaataaaacttcaatacgagacaccctttcgaacgaatgttctgtttttagcgggaaagaaaagcccgtcaaaggggctgtcatgatttcatgcagatctatcatatacgatgagcagccactttagcaaatctttcccttttttattgtcttatctattaaatcggcgctcaccaggtaatgtttaataaaaattccttatttatccgttttgtttatctccgggctttcgtttcttctctttttcttttaagtattgaatgaactcgatggcctgctgtctgctttcgggggaaaattcctgcatgtcgcggtaggcaatttgcagatccggatctgcgatttcgtcttcgatgttttttttcttttccgtgcctgtcagcagatagtctatcgtcactttatagtaatcagcgagtttttttaatgtttcatagtccggctcgcttcttccgttttcataatgggagtagcgtgcccgcgatacaccgatctgctttgccacttcttcctgtgtcctttttcctctcaggctcttcagtctgccgcctaacatagaatgacctctcttcctcaattcggcatgattatctctattatagatacaaaatgtatcgaaataaacagatgataaaaaaagtatcaaaaaagtgttgatgataagaagcgtatcatatataatcaaatcatcagatacgtattgtatcaaaaacagggagtgagaacatgtgcgaaaacgattgatcgaagagcgctctaagaggggatggacccagaagcaagtgtcggaaagacttggactctccgaggtttatgttcgcaaaattgaaaggggaacacgcaatcccggcagagaaacgatgctgaaattcgaaacgctttattcagtgcctgatcgtttgctgtttcccgatctttttcaggtctttatagatacatattgtatcaaagaaaacctgcataaaagaaggcgatgtcatgaatcttgaacatccgatggtcacacgcatccgaacacacggctatccaaaggaagccgacagagagcaaatgagaagccacggcggacttgccggatatccaaaaggaggaagcatgggtaaaattgtgatttcctacagctcagaccggtttgatcaatggcggctcggagaagccgggggattcaacgcttttacgaaagacggaaagcctgtattccaatttgatcataaaggccaatacgaacggtatctcaggctgaaccgcaaaaggcagaaggaagggggaagatgaatgtcccgcccgccggatcaaagctatcccttttcggtttactcagggcttttaacacctgttcactacgagaaaataggcaatgccatttggctttttttatggtgcatcagttcaacaacaaaggaaatcgaacgcgatggggagacatggggcatcgtgctcggcaacaagccgctgaaagcagccgaactggctcttcaattcggcgtcaacgaaaaaacgatcagaagatggctcgctcttctcgaacgaaacggctacattgcagtcacaagagcgccttacggaatgattttgtcagtcagacattcaaaaaaatttgcctacgccagccatgtccgaacagaactgcctgatcggacagaagagactggcagtgcggacaagcttgtccaatccaataaagatatcacacaaatcaacacaaaacataatatgagttccataaaaacaatagcagaacgatttgccgccctcaggtcgatgcaggaaggaaagcccgtccatccctcgtcaaaagactatcaggccatcgcccggattgtcgcccgcggagtgtctcttccgcaaacaatcaaatggcttgaacaatgttttgaggagtatgaggcgcggcgccgaagccgtcatgaaacgatcaaggtcttcagctactgtgaaaaatatatcatcggccggctggctgaagcggaagcgaaaacgaaaacaactgtcaggagggagaacaatgcccaaaagaacaatcgaagaggtcatggacgaactgagaaacaggagccgtcaatcacaggggggcaaaccggaagaatccgccgcaaaacggtatgactgtccgaagtgcaaagatgaactcggatttatcgaacggcgcggaacgatggaagtatgggtatcatgcgtctgccgcgaatggcgcaaagcgcaaaagctgttgaagacgagcgaaatcaccgaacaatttaaaaacttaaactttgctcaattcaagacggaaggaaagcatcaatctgtaaaagaggcgtatgaatgcgccgttgaatatgtacaagcttaccgggacattcaggaaagccgcagaaacagcatcgcgctcttgggacgacccggttcagggaagactcatttgctgacggctgccgccaatgagctgatgaggaagctttttgtacccgtcctgtattttccgtttgtcgaaggattcaatgatttaaaacaggacttttcgttgcttgagaataagctgaaccggatgaagcaagtcgaggtgctgtttcttgatgacctgtttaagccggtggcaggcaggccgcgggcaacggaatggcagatcgaacagacatatgccgtcgtcaattacaggtatttgaaccataagccgatcatgctgtccagcgagctaagcgttgaagaaattgtcagcatagacgaagcgctcggaacgaggctggtcgaaatgtgcggggactttctcgtcgtcctgaacgggagctctttcggcatcaatcatagactggaggggatggtttgatgtgccggctatgtaatgggagaaaatcaatccatcaggacgcaagggtcggaacgattttccgcgcttgcccgaactgctgcactgaaagcggcggtttgacggatgtgatcaaacatctggaagcgctgattgcaaaaatgaaaacaagggtgacacaaggtgcttaaaagtttaaaagctatgattctcatcatctggacagcggcaaaaagagacgcacaaattaaacgatggcacgaagaagacggaaagtgaggaaagacatacgtgaaaaacgaaagtgaggcgtacagcccatcaccatggcgcgtcgtcagaacaaataccgacgtatacatttattcagcatacagcaaagccgaaaagaaacggttttcttattccaacggaagggtgattgccaaagtcgccgactacagcgcatattccaaggaaaaaaatgcccgcttaatcgctgcagctcccgaactgttgaccgcagtgaagctcacgcttgcctatttgaagcgaaaacggcccgttcacagcgattcagttgagaatcaattgaagaatattttagaaaaagtcgtcgcaaaagcagaatttgaagaggaggaaacaagatgaaccatccggcaaagttaacagatatcaacgatacgacggttgcaagccgcatcaaaaaaggaaaggtgacggtgatcgtccttgacggaatgaacggcacggcatggcaggccgaggcgcctgagcacggcaaaaccgtcattgaaacgagaaagggagatctcgcaaggatcgaatttgaaatcggctataagctatagctctacaacttgaatatttgtccaagacggaaagcctgcggacgctgatcaggatgcacatcttaactgtgcggctgattggtgtccttttttatttcaaaaaaacggaggtacattaaaatggaagatttgcttttcgaatataaaagagcgctgaaaaacacgaaaaaattgtataagccctatcaagatgaacaagggctgacggctgaacagctgaatgataaaaaactgatcagaaacatgatgaccgatttggaatatgtgatcgactggcttgaaaacggaagagaacctggaatcagacgggcgattgacaggcgcgactcttataagcggatgctcctgaaagatccgcggatcatcgacacgttttcagaacagagtgcatttgaaccggctcaggaagtgtcagcatacgataaagcccggattgaatcagcgctgtctgcccttacggcacgcgaaaaagaaatcttcattttacataaggtcgaacagttttcctatgagcggattgccgccatgctcggcatcaaaaagtctactgttcaaaccaatgtgaaacgggcgcagctgaaaatcgcgaaacagatcgaaaagcctctcgattgtatggcataacgatatatctgtcttttgtcatacgtttgccacctataagtgaaaagagaaaaaatataacaaagcatactgttcatatggaagattcatatagcgattaaatattactgtttccgagaatgagaggcggtgaaaatgaacaatgccaaggaaaagggatccaaaaagggatgaagcttttcgtctctatcaaaaatacgggggaaacattacgaatctcgcaatcgcaagagaactcggcgtttcaaataaaaaaatcagcgtttggaaaacccgcgaccgctggcaagaggctttagccggagatgacgcgaaccgtggaaaagcagacattcacaatgaagggctgaatgaacggcagcggctgttttgcatctattatgtgaaaagcttcaatgccacccaagcggcggtaaaagcgggctattccccggccagcgcccatgtgacaggctgccggcttttgaaaaatgaaaaggtggccgatgaaatcaggcgaatcaaaaaagaaatggtaggggagatattcgtcgaggcgatggatgttctccaagtctatgtaaaaatcgcgtttgccgatatgaccgattatgtgactttcggcaaaaaagaggtacaggctgtcggaaagtccggaccgctgtttgatgaagaaaacaatccggttatgaaagaggtcagctttgtggatgtgaaacattccgacctcgtcgatggcacagtcatcacggaagcgaaactcgggaaagaagggatcgcgatcaagctggccgataaaatgaaggcgctcgataagctctcacagtattttgaccttttccctgattcatttaagcggaaaattgaaaatgagaagctgaagctcgccagacaaaaagccgacaaagatgcggaaacgggtcccgttgaagtggtcatcgcccgaaaaggtgatcaggcttgatcataaaagaagtcaatccgcattttgaagattatttgtttaactgggatcagacctttcaatttcttgtcggcggatacggttcgtcgaaaagctatcataccgctttaaaagtcgtattaaaactgcttcaggaaaagcggaccgctcttgtcgtaagggaagtgtttgaaacacacagggattcgacgttttctttattcgcatccattatcgatgagctgggtgtccaaaaggcggctcaggcggtttcttctccgatgcatatcaggtttgcaaacggcagccgaattatttttaaaggaatggacaacccggcgaaattgaaatccgtcaacaacatctcgctgatttggattgaagaatgttcagaggtgaagtatgaaggcttcaaggaactgatcggccggctgaggcatccttatcacaggctgtatatgatgttgacgacaaaccccgtcagccagtcaaactggacgtacagacactttttcaaggatgagcggaacaagcggttcattttggatgatgaggtcttgtataaaaagcgggtcgctgtcgtcggtgatacgtattaccaccattccacagctgatgacaacctgtttttgccgaaaagctacctcaaacagcttgatgatatgaaagcatatgatcccgacctgtaccggattgccagaaaagggcggtttggggtaaacggcaccagggttctgccgcaatttgaagtgatggagcatgaggaggtcatgaggcagatctccgccatttccaacccgctgaagagaaccggaatggatttcggatttgaggaatcatacaatgccgtcgtccgggcggccgtcgatcccgacaaaaaatatctatatatctattgggagtactacaaaaataaaatgacagatgataagacggccgaagaacttcacgaattcgcggttgcgaaggagctgattaaagctgatcccgctgagccgaaaagcattcagtttttcaggcagaatggttttaacatgacagcagcacgcaagttccaaggctcgcgcctgcaatatacgaaaaaaatcaagcggtttaaaaaaatattctgttctgaccgatgtgccaatacgatctacgaattgcagccgctgacctatgcgacggatcaagacggcaatctgaaggaggatcagtttacaattgatccgcacacgctttccgcgctatggtacgcgcttgatgattatgaagtaaccgatttgaaggctgagccggaagtgagaaaacggccgaacaggaaaagggggagatagcgtatgtccactcagcaaacggtaagagcgaaagtcatgaaatcccgttttcacgggcctgtaacaaaacaaatatatgaagatcaattttcggagatctacggcgatgatattatcgctccgccgtacaatttgaaagaattgaaagccattgccgaatattcttcaattcttcagcaatgcattgacgcctataaaacgaatattgcggggttcgggctcgatgtagaatacgcttttgatttcaacggggcggatgtgacgcccgatcggaaaaaagctgctgagtccgattggacaaggcttgaagatttttgccgccaccttcattttgacgaatcggctgaaacaattttaagccatatgatagaggaccgcgaaaaaaccgggaacgggtttttggaggtgctcagaaacggtgcggggcagccggccggaattgaatatctcgatgtcaaaaatatgcgggtatgcggattgacagaaccgatcgaagttgaattcgcctacatggaaaacggatcgctaaaaaacatcaagagggagaaaaggttccgcaaatacgttcagatgattgacggcaggaaagtgtactttaaagagtacggcgatccgcgcgtcatggatatgaccaccggagagtttgacaggcagactccccctgaacgaagcgcgaatgaagcgatccattttaaaatcggcagcggcgtctacggcgttccgcgctggatcggaaatattgtcaacctgtacggggcgcggaaagcggaagagctgaattatatgtacttcagacaaggccggcacgtacctgccgtcattacggttgaaaacggcatgctctcagaggcttcctacagagagctgcaggaatatatgaacgacttggaaggggttgaaaatgcccacaaatttttgctgatcgaagcggagggaatcgcacaggaaaaagacattcacggcagccaggacattacgccggtgaaggtggacatcaaatccctcgccgaaattttgcaggaagatgcgctgtttcttgaatatgacgagaaaacccggaataaaatccgctcttccttcaggctcccgccgctctacaccggtgatgcccatgaatataacagggcgacagccgataccgcccgcaaaatcaccgaagaacaggtttttgaaccggagcggaaaatattgatcggcaagctgaatacgctgtttctccgcgatttaaacattttccacgcgaggctccagctgaaaggaccggactttcgcgatccgcttgagatcgcaaaagtgctcggtccttttattcaggcaggagcagtatctgcaaatgatttgcgcgacctggccggcagagtgctcggcaagacgctagatgaatggccggaggaagaattcagcaggccgctcgtttaccaggaaagctcaaagcgtgcggaagcggaagcaggagcattgctgcctgaactgcaggaagccgtcgagacattgaaacagatcactgaaaggaggtgaacatttcgtgccgagagagcttaaaaatgccaaaatcaatttcgtcagttatgtcgacaaagcggcgaacaaaaagaaattcttcatgacgaagtcgagtgaaccgccgacatttcaaaaggaagtcaagctgattgcaaaagccgaggatgaaaagaagctcgtctacggcgttgtctacgagccggacattcaggatgcccacggcgactttatgacggctgaagaaatccaaaaagccgcccacggttttctgaaaaatgcccggaagatcgacaaggatcacaatttccagggaggcgtcggagaagtcgtggagtcctacgtagcgccggctgattttgaagtaaacggcgaaacgattgtgaaaggctcttgggtgctggtgacaaaagccggcgatgagatctgggaacagattaaaaaaggaagcatcaccggctacagcatggcgggcactgccgaaacggtcgagcacgcgccccaagccgactctgaaaccgatgagcccggcagtttctttcagctgtttaagcagttttttgccggcgacaaacaaaaaacgggagaggaagaaaaaaagatgaaacgatcagaagttcaaggaacgattgaagccgtcttggctccgcttctcaaacgtcttgacgatttggaaggggataaagcggcagatgaaaaagagcaacagacagaccaagacgcacatgtgaaggaaatcgtcgaggacatgctcgcccctcttattgcacgcattgaagcactcgaaaagatgagaggcgcctcaaagcaggcagcagccgaaaaagacggggaagaagaagttaaaaaatcgatttggagcggattgctttaatttggaggaggaagacaatgagaaatcaagagattattcgtaaagccgagatgtcgcttgcgactttgaaaagcggaggattaatgaatccggcgcaggcttctgcatttattcgcatggtgcaaaacacgccgacaattttcagcgaatcgcgcgtgattcaaatggaaaacgactcgcaaaaatttgaaaagatcggctttggccagcggattttacgagcggctgatgaaggtaaggcattggcgaaagatcaattaaccgcaccggtgaccagcacggtcgaactgaacgcgaaagaagtcattgccgaagtcaacatcacttatgacacgctcgaaaataacattgaaaaagacggccttcaacagacgctgatgcaaatgctggcggagcgggctgccgttgatattgaagaactgatcgtcaatggtgatgtcgcatcctcagatccataccttgcccagctcgacgggatccggaagcagtccgtctcccatatcgtcgatgcgggcggggagcaaatcagccggcagcttttcaaacaggggctgaaagctgttccggcaaaatatatgcgcgttcctcaggaattcagattcttcacatcgctcggccaggagattgaatggaaagaccgcgtcgcagaacgtcaaacgactctcggggatgcggcggtacagggcggactttctaccgcttttggcgtgcctgttaaaggggtctcaaatattcagccgtatgcatacggagaaggagatgcggccgccgaagcatcagacattattttgacgcacccgaaaaatatcattctcggtttctcgcgcaatatcagaattgaagtcgataaagacattcgcgcgcgcaaattcatcattgtcctgacggcaaaactggacagcaaattcgaggaagaagacgcggttgcaaaaatcatcaatgtaaaagagtaaatgctgagttcgaaccgttccaaaggaagaacagccgaccggcggaaaccgagcccggacaacagctaaaagctctggaaggatgtgatgaacatgctgatcacgcccgacgatatcatccaatattccgttattgaagccgtgaaaaaccggccgcaggaattgctgcgtcaggatatccttgaagctgaagcggaagccgagcagataacggggcaccgttttacagatgaaaaatatgatccgctgccggaaaaggcaaggctcgctttgctgcagctggcacagtactttgcattgaaaaacggtgatgaatcgcttttgaaaggctacaaatctgagaaattgggagactactcctatacgctttcaagaagcggaggcctagtgaagcccgacgtctataaactgctcgaagaatttattcttgattatgaatctgttcgattcaaggtgcgcccgctatgagctacaaaaggttattaagcgaccgctgcgatatctatcatttaaaggaagaccaggctgaggaagcaaggtacggcattcctgcgcgagacctgcagccgattcgcacatacggggaaacacctgatcttcaaaacgttccctgctattttacggaaaaaaaccagtcgatcgtccagcaagatcccgaacaggttatttatcattcatatttggcccattttccggcggaggcagatgtgcgccttcacgataaggcggtctggaacggtgtcgcctacacgctgcagcagccgcgcaacatcaaaggccatcacctcgaagtgttagcggtcagggatgaaaaactatgaaaatcaaaggattgaaacagctgtcgcagacgctggaaaaagcagggcagagcggctttcgaaatgaagctgccaagtggcttgaacaggcgggaaccgattttttggacctggtctgtgacgaaatcgtgcgcgccggatcgattgataccggcagccttttgcgctctttcaagcggggagccgaagggaacaggtgggaaatcgaaaaaggcggactcacgcttgaagtcgggacggagttagagtacgcctcatttgtaaatgacggccattggacaggcggaaaagacgaagtcaggtgggttccgggacaatggcacggcggccggtttcaatatgatcccggttcatcgtccggcatggccttaaaacggcaatgggtaaagggaacaggctattgggagcatgcgctttacatatttgagcgtttatttgaaaaacgcctgaatgaaaggctgcaaaaatggctgaattccctttaaggaggtgaagctttgaacgacgaaacgggatctgtcatgaatttcttttatcaagtctttcctgtcgtctgttatgaaaaggaaatacccgaccactttcaaataccgtcgctgtattttcctcccccttctgtttttgatgagaatgatacggtttcaacatttaaaaaagtcttcaccctgaatgtgaaactgtttcaccacgattcgcagcaggcccatgatcatgccgagcgcattgcagacgccgtaagggaagcgaggcacatcataccgctcattgaccgatcgggtaaaggcacaggggacagcttgaggatcagccggatcgagacgagaataggggattccggcaccgcgtccattattattcaatggaacagccgctactggtacaaacgggaaagcgaactttctctggaaacaattgattttacaaacggggtgaaataattggcagtcagcaaaaaaacaaacaccgaagcaaaaaaggcgcctcaagaggaacgtgaagcgctgttctacatcgaagacctgagggagcacgcgaaagagcttttcggcattaagccggaagttctcgatggtgctctttttcatgtgaaagaagagcagatttcaaaacctgaggcaagtcagcttattcaaacatttttagccaaggaggtcatgaattaatgaacggcggaacatttacaccaggcaaagaaaaagatcgtgccggcatttattttaattttaaaacgacagcagaggaacgcgtttccatcggggatcgcggtacagttgccctccctgtcgtcatgagctggggggagccgaaaacattcgtatcgatttccagcattgaagacttaaataaaaaagtagggttgaacatcgatgatccgtctcttctgcttttccgggaagcgaagaaaaacgcacagaccgttttgctgtaccgtctgaacacaggagcgccggcgaaagcccaaatcggcgaaacgctgagcgtaacggcaaaatacggaggcgagaaagggaacgacatttcgatccgcatttccgaaaatgtgctcgattctaaaaagtttgatgtcaccacctttgtcggaacagatgaagctgaccgacaaaccgtcaaaacggcagaagagcttaccgcaaatgcgtacgtcgcgtttcaaggggaaggcgcgcttgaactgacagcgggcacaaagctgtcaggcggggagaacggaacggcaagcgttgccgattacaccgcatttttagatgctgccgaaacggaatacttcaatacgatcgcactcccggtcgcagacaatgaacagctgaaagccacttttgccgctttcatcaaacgccttcgcgacaagcagggccagaaagtccaaggcgttgtcgccgattatgccggagactatgaaggcattattaatgtaacgggaggcgtcgtgctggaagacggcactgaaatcactcctgaaaaagcgacggcatgggttgccggagcgagcgcaggcgcgacttttaaccagtcgctgacatttgtcgaatacgaaggtgctgttgatgtcctgaaccgtctggatgaagaccaggtcatcgaacgtctgaaaaaaggcgagtttttatttacatttgatgcacgcgatcaatcggtcagcgttgaaaaagacatcaactctttaacgagtttcactgccgacaagaacaaaaaattctcgaaaaacaaaatcatccgcgttctcgacggagtcaacaatgacctgacccgcgagttaaaggctttaatcaaagcacgaaaagcaagcggcagcgacatccctgcatcagacgatggtttgcaatacgtcaaaacgctgatcattcagtatatgacggcgcttcaggaagccggcggcattaccggctttgattctgaaagcgatattgccattacactgaatgaagaccgcgacgggtttttaatcgatttagccgttcagccggttgatgcagcagaaaaattctactttaatgtggaggtaaaatagtatggcattaaaagcgcaaaacacgatttccggaaaagaaggccgtctttttctcgacggacaagagatggctcacatcaaaacatttgaggccaatgtcgaaaagaataaagctgaagtcaatattatgggccgccgcatgaccggccacaagacaacaggggcaaacggcacgggaacggcgacattttataaagtcacgtctcaatttgtcacgttaatgatgaactatgtgaaaaaaggcgatgatccgtatttcacgctccaggccgtccttgacgaccagtcatcaggccgcggaacggagcgggtcacgctgtatgacgtgaattttgactcggccaaaatcgccggtcttgacgtcgactcagaggcgctcgaagaagaagtgccgttcacatttgaagatttcgacgttcctgaaaaactgaaagatacgttttaaaataggagccgtatacaacgagcccgcttttcaaaaatagaccgcaacagccggtctatttcttcttttttacggaaggaaccgattcagtagtcaggaaataggaagcaaagcactctcgccaagccgagggtgctttttcattgcaaatccaaaattgaatgttaaaggagcaagcagacatgagcgaaaaacaagaagaaaaagtatatgatttatccttttttatgccgggacaaaccgttgaagccgaagaaatcaaagtgccgatctcaaagcggttcgtcgataaaaagggcaatgtcattccgtttgtgtttaagccgattacaaccgagcgcattgacgagcttgaaaaagaaaatacgacttataaaaacattaaaggcagaggccgtgtcaaggatctagacacccagcgcttttacgccagaatcgccattgaatcgacgatctaccctgacttccgttcaaaggaattaagagaagcctataaaacggccgacccggtcgaagtggccaaacgcgttctctccgtcggtggggaatatgcgaactggctcaacaaagcgattgaaatcaacggctttgaagacgatcttgaagatctggaagaagaagcaaaaaactaattaaggatgggaataaagaagcggtgtatctctatttcgcgatgcacgaacttcactattctccatcccagctccgggagctgtacgaagccccaaaaccgtttaaggcattattatacggactcatcagctacaaacttcaactcttggaaaaagaagcgcggaaaggaggtacataatccatggcaaaactgacggcacgttttgaacttgaagaccgggtgtctaagaagctgcggaggattcagaagggttttgcgattttagaaaagagagcagaacgattgaaccggcaaatcaaaattaacattaaaacggaagatcaagctttttttcggcttaaaaaactgaacaattacctgatgagaaagttcattcactccgtaaatattggagtgaatataaatgaccaggcatccgctcaactaatagaaatacaaagaagattaaaaagaattccgccagaaacaaccgttaagttaactttagcagacaatgtctcgcaaaagttaactaaaattaaaaggatgctctctaagcgtgaatatttcttatcaatctctgctgaagaccgtgtaacattaactgttaaaaaaataatcggctatcttaaaaacaatttgaaaaaaggttattcagttcagttatatgtacttgataaagtaacgaaaacagcaagcagaattgcctcgctcctaaaaaaactagagaaaacgtacattgtcacaattgatttaaacgacaaggcgaccaacaaaatcaaaaacaaaaaagtttcaggagaaacatcagaagtcaaacacgataaaaagggatctttctttgaacaaggaaaagacttgttaggcgaatggtggaaaaagtcaggatggccttggataaaggatactgggaaggaaattggcaaagcatttgtagatcgatttaaagatagactgatggaaaaattgaacaatgatatttttgacaaagtcattgataaaatcttagggcctcagtcaacaaaaggttctcagtcaaaatcaagcggaccaggccatggacaatgctgctgctgtttatatccgcagaaagatcctccgaattcagccggaaataggcaaaatgtctctgtttcaggttcaagtgaagagcataaaggctggaatctaaaaagcttatcaaggggaattcttccagccgcaaagatactcttctatttaaaaagtttaaggcccaacaaagagcccggtaaacttgcaaaattattagagcccttaaaaccaatgattgaaaaattaaagccgctaggtaaaaaactaagtccgctaggcaaacttttgccgcttacagatctaatcggcatcaacaaagataacgcaggcgaaaaaattggttctgtaggcggccgtatgttaggaacttttggtggagaagctgccggaatggcgatcggaggattggttggaggacctccgggtgcaatgattggaggagtagtgggcggctttgcaggcgggatgggcggtgaaaaggcaggcggttccctcggtaaaatgtttgacacttcccaattgaaggaagatctcatgaacacgctgtttaatggagactggtggagcgaacagtgggattcccttagtcaaaccgctacaaatacatttttaaatggagactggtggggagaaaaatggggatctcttaaagaaacagccacaaatacgtttttaaacggaaactggtgggctgaacaagccggctatctttatggtactttggaagctgcatttttagggccgttaagtaatgtttggggaaccattgcaggaacgatcagcgagacgatttttaacggagactggtggagcgaaaaatggaacaatgcagtaacatgggcgcagaatacgtgggacggagctgtctctgtttgggaatccattacaggaaccattaaagacaccgtttttaatggagactggtggagcgaaaaatggaacaatgcagtaacatgggcgcagaatacgtgggacggagccgtctctgtttgggaatccattacaggaaccattaaagacaccgtttttaatggagactggtggggtgaacaatgggacaacgcagtgacatgggcgcagaatgcgtgggacggagccgtctctgtttgggaatccattacaggaaccattaaagacactgttttcaatggagactggtggtctaaccaatggaatagcgctttggaaaggggcaagagtattttcgaaggcgcgaaaagctgggtcggagaaaaagttgaatattttcagaaaggtcgggaaagagcccataaggatcatggatttgaaggctatgccacaggcggctacatcacaaaaccgaccatctcctggatcggtgaagccggaaatgaattcgtcatccctacggaaaacaaccggggacgcgggaagatgctgcttgcccaggccgctaccaagctcggcatgcgcgttgttgacgacatgggggccgcggcgggagacgggggagcttcttctccggtttcaagcaccgcttcgtattcggcttctgtgtcgcctgctgtcggtgtcgggagtatagcagcagaggcgcaggctttcggccgggaattcaccggcggttttgacaaggggatcggctcaaacgctccttcccttgatcaatggaagcaaaaaaacatcagcaagccgtttagcagcctgccggcagaatcgtctaactacggaaaacagacggttgccgggttcgcttccgggcaaaatgcttccgcgaccggaaccggcggttttcttcaagcaaaagtaaatgcgccttatcaaacaacggtgaaaacgtcctcttcctggggtgcaaatacagtcaaaaactttgcaaccgggcaaaatgcaacaccgaccgggacgtcgcagtatgttgataaaaatatcaacaagccgttccttgattcgaaacagtcggctgcaggctgggggtcaggaatggtcggacactttatcagcggcatgaatggaaaaggcagcgaagtttctcaagctgcaaaaaacttggcgaaaaaagttgaaaaagcgttccgcgaagaactagatattcattctccgtcccgggttatgatgagtctcgggcgtttcgcgtcggtcgggattgtcaaaggtttaagctctgtcgatgtcaaaagttttgcggaaaaacaagcaggctcactggcagctgcgttttccggaatcggagccgtcggcggaaatgtaaagtcgtggctgatgcaggcgatcatggctaccggttcgccggtgtcgtggcttcagccgctttctgttattgctcaaaaggaatccggcggaaatccgcgcgcctataacggctgggacattaacgccaagcggggggacccgagcagaggcttgatgcagacgatcggccaaacgtttaatgcttacaaaggaaaaggaatgaatgatattttcaatcctgttcacaacgcggtagcggccatcaactacatcaaatcgcgatacgggtcgccatttaacactccggggattaaaagcatggcaagaggcggagcttataaaggctatgccaacggcggcctgattacgagcgagcagatcgcccgcgtgggtgaaggcggcaaacgcgaatggatcattcccgaagaacgcggcatccgcggcagatatctgcttcagcgggctgcaggcgcgctcgggatggaagtgcaagaccccgctgaagggtccggttccatatcaagtgctcaggcggctgcagccaccacgggcgggacccgatcccggcagcctgctgaaaatggcgccaaagaagtcaacatctatattaccggggacaatcattaccacagtgagcgcgaccaggaaacattgattgcgaaaatcaagcgcgctcttgtcgatgagcttgaacgggatattcatattgggacgaaaggaagcgtagcttatgactaaatccgtgtacgaattttggctgacgcaaggaaaggaaaagctgcgcctccctgtgcttccagagcagcttgacgtcagcaataatcttgcgaacgaatctgtaaaggtgtcaaagttcggcgaggtgacgtttatcaatgaaccgggagcgaagacgatttcattttcgtctcattttccgaaaaagtattctccgctctcggaatacaaagggtttctttcgccggagaacgcgattcttaaaatcgagaaatggatgaaagcaaaaaaaccggttcaatttctcgtgacgggaacgaagatcaatttcacatgcagcattgaaaacttttcgcatcgcgagggtgaaaaggatatcggcgaccgggattttgatctcacattgaaagagtaccaaacagcatcaccccggaagattaaacaaaaaaagaaaacgaagaaaaaacggccgtccaaactggctccaaaaatgtacaccgtcaaaaaaggcgatacgctctggcacatcgcaggccgtttttacggaaacagccaggaatggcggaaaatttggaatgcgaacaagcaggcgatgatcaaacgaagcaagcgaaacatcaaacagccgggacattggatttttccggggcaaaagctgaaaataccataaaacgaagcgccggatgaaccggcgtttttctggtaaatcaaaagcaggggatagcgatgatcgaattatttgtcataaaagaaagcgaatggtatgaacttgtcaccgaaagcgtcacattggaaggagaaaggtaccaggcgcctcgttcgatcgaagcgtcgattgtgatcaagcagggaagccacaaatattacagcgtgcaggaaggcgataccgttttatttaaatggaaaggaaaagaactgtttcgcggaattgtgttcagcagggtgccgaaagaatatacgcttacgtttaaagcgtacgacatgcttcagtacttggtgaaaaaccaggatgtctatgtattctcgaacaaaacggccgctgacattgtcaaacgaattgcgaacgactttcaaattcccaaaggttcgattgcaaacaccggacatacgattaaatcgctcgtctttaaagacaatacgagcctgtatgacattattttaaaagcgctgcgggagacaaaaaagcaaaccggaaaaaactatcagctgtatgccgaaaaaggaaagctgtgtttacgagcgtggcccgaaccggaggatatctgggttttggaaacgggtgtgaacattacggattacgcttacagcacgtcaatcgatgaaacggcaacccgggtgaaactgagaaagcagaaagataacaaaacctataccgcatccgcaagcgatgaagccggtatgaaaagattcggcgttctccagtacacagaaacggtttcggatgatattaacgaggcgcagctccgcgaccgggcgaagaagatacaggctgaaaagaaaggcgtcaaaaaagagctgaaaagcatacaggcaatcggcataccggaagttcaaagcggactgccggtttatatatcgattccggaagcgggcattaaagaaacctattgggttgataaggataaacacgattttacaggaacaaaacatgtgatgacgattgatgtcgtcgctaaaaacaccatacctgaaggagcgtcttcatgaaattaagcgatgcgataaaagagctggctcttggagccgtaaacgctgaatcgcctgtcgatgtcatgccggctgaagtcgtgtccgcgtctccgctcaagctgaagctccgcaatcatgataaattggtgatcccctccgacttattggtggtggccaggcatttgacagagcatacggaacagatccgaattgacggagaagacaaaacgattcgcttttacaatcaattgcatgccggcgaccacgtgatgattgcggctatgcctggagggcagtctttttttgtaatagacagagtgtaggagtaggaggtggctcggatggctctttcgccggaagtatcttttgaagatatcgaggatgacagcgatgtgattgagacttcaaaaacgtacaaaattgattttgaaacaggcaggatgacgggtgatatgatttcggggctggaagccgtggaacaaatggtttgtatggcgctgagaaccgagcgctacgcatacgccgtttacagccataatatcggaaatgaactgcaggaggttctttcagatcatgaaacgaccgacgcttataaagaaatggagataccgagattgatcgaggaagccctcatatacgatgaccgaatttcggcggtgaccgacttcgagattgagcgtcaaggcgatgccttccacgtgtccttttcggttgaaaccgatgaagggacattggaaatcgaggaggtgattggggaagatgtttgaagaccagacatttgaagagatcatggaacgcatgcttgagcgggtttcagatgagattgacaaacgtgaaaacagcgtcatttggaatgcgcttgccccggcagccgccgagctggcgctttcttatatttggcttgatcaagtgctgaatttggtttatgcggatacggctgaaggcgaatatttggacagaagggcggctgaggccggtcttgagcgctatcgggcgtcaaaagccatatggtctgcggcatttacggatggagtatcggttccccccggaacccgtttctttctggaagatttatattttaccatgctcgaagacggcaagctggaatgtgaaacagccgggacaaaaggaaacgccaatttttcggggcggcctttgcttccgctcgataccattcccgggcttgaaaaagcggttatgggaagccttgaaattcccggccgcgacgaggagacggatgaatccctgtatgaaaggtatttaatccgcgtccgtagggaagcggtcagcgcgaatcagctgcattacaaacaatgggccgaagaagtggacggcgtaggcaaagcgaaggtctttccgctgtggaatggcgagggaaccgtaaaggttgtcattacaaacgcgaaaatggagccagccacagacgcattaatcgaaagagtcaagcagtatatcgatcccgatccgggcaaaggggaaggtatggcgccgatcggagcttataccgcggttgaaagcgcggtatggaaagacgtgagcatatctgcaaaaatcatacctgaatcaggccggacgatcggtgaggccaaacaggaaattgcagaaaaaatcactgaattatttaaagaaatggcttttaaagaaagcgtcatccgtctctcgcagatcaacaacatgatctatgaatcgtcctctgtcagcgactattcggaagtcttcatcaacggggaagcgaaaaatctgcagttgacagaaacggaaattccaaagctggggcaggtgaccatcattgagcaagattgatgaaatggcttttcacctgccgccatacttgatggaaatccgggaaattcaagaaattataacggctgaagcgcctgaatttgagaggcaaaatcaagagattttcgatatgacggaccagcttttcgtcacgacggccacatgggggctggacaggtgggaaaagattttgaatgtcagacgcgaggcttcggacggcgtcgatattcgaagggcccgtctgttaaccaagatgtccaatattccgccgattacaagccgctcgatcgagcgcgcggttaatgcttttttaaaacagccgtccgcatccgtcagactgacggccggacggtatcattttttgctgagtgtaaacggagaggatctgcagtttataccttcaatcattcaaaccgtcaatcatatgaagcccgcccatttggcttatacattccggggcgggtttcattatgaatgtcggccgccgaaaagcgttcatgacaggctcgttttaagaagcaaaaacggctttttcggtacgataccggtctatttggacggacagtatctgcttgatgatgcattctacttgaacggttttcgagaaatcgacggactgccccgcaggtttaaacagcagctcacactgcgccacaagaagcggcaatacattcggtccgcctccagctttacgataaagacggccgctgaaaaccggcggaaacagcaaacaaaagctggcatgaaaaccggcattaccaatcaaaacaaaaaggtccaatccttcaaaatcagctgcaaatgcgaacatgaatttaagcaagcaggcgcgcttgaaatgagagagaagtggtggacgctaaacggcgcatttttgctcgacggtacaaagcagctggcagcagcggcgcaaaaaatcgcattgtaaaggagaaatcaaaatggcacaacaattaacagtgacaacgctttatgcgagacagcaaatggcaaaagcacgggctgagggcggcaagctcaccaaaatcacaaaaatggctttcggaaacggaggtacaaacgataaaggcgaacccgttcctctgcagggcaacgaacaggccctgaaaaacgaacttctgcaaaaggatatcgacggctttgcctttatggagccggcgaaagtccgttatacatgtacattgggagaaagcgaactcgcaggggaaacgatcaacgagctcgcccttgtcgatgaagccggaaaattcacagcggtcagaacgatgacagacaagcagaaagacggcgacatcgagttcgtctttgaaatcgacgacatttattaaaggagctgaaacaaggtggacatccaaaaaccgagacgctttgaaacaacagaccgcgcccatgccgacttgttcaacgaagcgatagatcagctgaatgtaaacgatgaacggattgcaaagcgggctgaggaagctgaagaaagggctaaaacgtatactgatgcccatgctaacgaccattcgattcacatcaccgacaaagagagggaaaaatggagcgcggggcagttatataaaataaccgaaaataacggaaaagtcttttacagaggcagttcagaaacaacagattttaacactttgacagaaaccggcatgtatctcatctataatgaaggaatcaactcgccaccttcatcaaatcggatatttttgcttgtcatgagtttcggcaataccttggttcaggcagcttatgaatcgtacaaagggacacagtcgtattttagattcagaaaatccgattcaacaacatggacgccatggcagacccaggaaacgaccagtggagcacaggccaaggttgatgctcatgaacaaaatacgaatctccatgtgaatgaagatgaacgggaaaaatggaacaatgcacagttatataaaattactgataataatggaacgcgcacaaaactgccggatggaacggatttattaacgctgccgacaggtttttattatgctatgggccatgttgttcaaaacaaccctgtagaaaacgacagctcctggtttaattacgatgtaattgaaactggcgctggaagaaagaccatccatgcgtggcggagctatgataatactttatggcatggaacagttcacacagatggacagtttcgagaatggaaaagagtagtcacaaacgccgatttaaacgttgcttggcagactccaacgttgacaaatggatggaaacagtatgggtcgcacaaagtccggttttgtaaaaatatgcttggagaagtcgaaattatcggatcaataacgggcgggacgattggctttgatattcctgcgtttacgctgcctgaggggttccgcccgattcaagcgatgtactttataggtgttgcatcaagtataggtactgggtcaataccgcaaatccaccggacactgatcgatactgacggaagggtatgcattcaatccagttcaaatacagtaaatccaaacgagtttattactttcgggtttaagtttagagctgcatagcaaaatgaatagattactttttcacagaggagggttaatataaattggacatccaaaaaccgagatctttcagaacgacggacagagcccatgccgatttgtttaatcaggttatcgaccagctgaatgcaaatgatgagtcgattgcacagtttgccgccgaagctgaacaacgttcaactgcctatacagatgcacacatttcgaacaaaggtaacccgcatggtgtaacaaaatcccaggtcggtctgggggaagtgatcaataaaagacaggccacaaaagatgagtttgacttgcatcataacgatcaaacacggcatgttactgaagatgagagaaataaatggaatggaagtcaaatttttaatattaccggggacaatggacaagcaaaggtatatataagcgccgaagatgactttcaaacgatcctacctcagtataccggactgatacattttacggcagcctcaggagctataaacggaccaggtgcggccgttcgagggatttggacttgcaacgctttaggtaactatggtcaagcgatcgcgtttgacaatgcaaatagaacctatcggaaaacaatagccgggggcaactggactgactggacagaattaatttccgcggagagtctcgaggcaaagttggcgaacttaacttggcactttccaacgcttttaaacgaatgggttaattatgcggacagcactaaagttcgttatacaaaagatgccacaggtacggtatttgttgaaggtgcaatagcaaaagggaaaattggttttaatatacctgcattcgtattgccgaaaggatatcggccgtcccgcgcttttcagtttgtaggtgtagcatctcaattgggcatgtccaatactccgcagtatcataggctgcaagtgagtgttgatggtaatgtcgtgatcgaaaactgctcaaatacagtaaatccaaatgaatatatcagtttaggatttagttttaaggccgcataaaatatgaaagagggaattaaaatgccggaagcaccagaactggatatattccaaaaagaagttcaggagatgaaagctgatcaaaaatcactcgaacagcgcgtcagtacactcgaaagaacatcagaccgccacgatcagcaaatcatctcgattaacgaaaagctgaacaaaatcgaagagaatacaacctggattaagcgcagcatcacaggcgcgataattacagcggtcagcaccggcatcatcggcggcgcgatcgctgttttttataatttattgcagaaataagggaggacatcatcatgaaacatatcgacaaaggcacggtcgtcaggacggtgcttctttttattgcgctggtcaatcagacgttgatcatgtttggaaagccggttttgccggtcgctgaagatcagattcatacattggcggatgccctgtattcggccggatctgcggcttttacgatcgctgcatcgctcgttgcctggtataagaacaactatgtgacgagcaaagggaaaatgcaaaaagaagttttacagaaaaaaggtttaacgaaataaagcttcctttcagactttccagaattgaatttgaaaaggaatgatgaagtttggtcaaagtaatcaataactttgtaaaagtcaatcaatacacccgtcccgggctgaagcttgcggcagtcaaaggcatcgtcatgcattggacggcgacgcccggggcttcggcattgaatgagcgaaattatttcaatggcacatgcattgccgacaagcgttatgcgtcggctcattattttgtcgaccgccatgaggcgcagcatattattcccgatcatgaagtcgcatatcatgcgcatgatcaaaaccgctgctatgtcagctttctgaagccgaatgccaataccacggctctcggggtcgaaatgtgcgtggaaaaagacggtaccatccatgaagagacgattcgcaatgcggcagagcttgtagcggatttgtgcaagacatacggtttgtccgcagatcggattgtccgccattacgatgtcactaacaaaggctgtccaaccccgtgggtgagagatgccggccaattgtcagctttccgtaaaagagtagattcccttttggggaggaaaaccgtttccgtatcggctgcctccaccagccagacaagttcatcgtcgggcattatcctcaaaaaaggaatgtcaggctctcatgtgaaaaagctgcaaacacgcttggtcgcggccggtttttcgctgcctaaatacggcgcggacggaagctatggagacgagacggtgcatgcggttgtttctttgcaaaagaaagcgggaattaaagccgacggcatttacggtccgtcaactgaaaaagccctctcggccgctgaagcgtcagcagccggcaagagcaagacgtggacccttcccgacggcatttataaggtgaaaaacccgctgatgaagggaacggccgtcacacaaatccagacagcccttgccgctctttattactaccctgataaaggggccaaaaacaacgggatcgacggatattacggaatgaagacggcaaatgcggtgaaacgttttcagctgatgtacggtttgggagcggacgggatatacggaccgaagacaaaagcgaaaatgttgtcccttttgaaataaaggaacttttaaagttcctttatattttttaaaaattttcaaaaaataactatcccacagccatacttgtatggtagtatggcggagagggggtgagagtcatgaaaatgaaacaattaaacccgcgttctgtcagagatcaaatctatcaggtgctgaaggaagaaatcatgaagtttcggcttgttccgggtgagcagatatcggaaaaagagatttcagaacggtatgaagtcagccgcactccggtcagagaggcttttttgcagctgtcgaaggaagggcttctcgaagtctatccgcagaaaggaacccgcgtgtcgctgatcgatcttgacctggtggaggaagcgaggtttatgcgggaaaaactggaaaaggctgtagctgaactggcgtgtgaggacttcccgcaggaagctatgtttaagctggagcagaatgtgaagatgcaggaattatcgatcgcacagaaaaattatgaaagtttgtttgaattagatgaagcgtttcatcagacgatttttgaaggctgcggaaaagcgaatgtctgggctgcgattcagcagatgaacgttcccttccaaagaatccgctttttaaggcttgccgccgattttaactggaacaccatccatcagcagcacgcggcattaacagaagcgattcgaacaaaacagaaggcaaaagccaaggaaatcgccgaagagcatttgcagctggtcatcgtcgataaacagatgctcattgatgagtttcccggttatttcaaaaagtaagcgctttaaaaggagtggtgatgtgaaagctgcggtgatgacgaagccttattcgattgaatttcacgacataccgcgtcccgaaccggccagcggtgaagtccttgtcaagataaaggctgccgggatttgcggaagtgatgtgcatttttacgacggctcaaatccatatgcacagtaccctcagatctttggacatgagcttgcaggcatcattgaaaaaacgggggccggcgtgagggggcgatccgcaggcgaacgggtcgtaattgaaccggcgatcccgtgcggaggctgctacccttgtcggaaagggaggacaaacgcctgtatgaacatcgatatgatcgggtcggttcgcagaggagggttcgctgattttatcattgttccagaaacgcatgtccatccgattcctgagcaaatggattttgcaaccgctgctttgtgcgagccgttttcaatcggagcgcaggcggttcggcgggcagatattcaaacaggcgaaacgattgtcatattgggaatgggtccgatcgggttaacgattttggcgcaggtaaaaaagcgcttcgacgttcgtgtgatcgctgtcgatcctgtaagggaaaggcttgagcttgccgaggcattcggggcggatgccgttattcagcctggtgaagaggatgcagagcaaatgattctgaagctgacaggcggagaaggagcggggattgtgttcgaagcggccgggattcccgcgacgattgagcaatccgttcgtttggcggccgccgccgggcgcattgtcattgtcggcttaacggggaggaatgtgacgattccgggtcttcttctcacaaagaaagatattgaaatttatggaacaaaacacagcgtcaatcaatttcccggcgtcattcaatttttgaatgaaaaccctgaaatagcccgggcttttgtcactgagatcatgccttttatggaaatagaagaggcgttgaaaaaagcgaaaaactgtccccatcaggtcacaaagatcattttatcttattgaatcggtgaggaggaagtgtgatgaaaatggttttcagatggtatggagaaggaaacgactccgtcacccttgagcagatcaggcagattcccggtgtggagggaatcgtttgggcgcttcatcatcagccgccgggtgaagagtggccattggaagaaattttagaagtgaagcggcagtgtgaacagcacggttttcacattgaagttgttgaaagcgttaacatccatgaggatataaagcttgggctgccgacgagagatctgtatattgaaaaatacaagcgaacgattgaaaatttggccaaagccggcgtaaaagtgatctgctataattttatgcctgtatttgactggctgcggaccgatttgtacaaaaaggctccagacggttccaccgctttgttctatgagcacgcaaaggtgcacacaatcgacccttttgcgcttgtcgatcaaatcgccaagcatcccgaattcacgatgcccggctgggaaccggagcggcttgagcatctgacaaggctgtttgaagcctatcaaaatgtgacggaggaggatctgtggagccatcttcactattttcttgaacgcatcattccaaccgccgcacgctgcggaatcaaaatggcgatccatcccgatgatccgccgtggccggttttcggactcccgcgcatcatgacttcaggagaaagcatcgggcggctgctacagcttgtcgatcatccggcgaatggcgtgacactgtgcagcggttcattgggcgccaaccccgaaaatgatatttccgccatgatccatgcgtatgccgaccggattccatttgcccatatccgaaacgtcaaagtctacgaaaacggcgattttatcgaaacatcgcacagaacaaaagatggcacagttgacatttgcgggattgtcaaagcctatcatgaaacaggtttttcaggctatgtgcgtccggatcacggccgccacatttgggatgaaaagtgcaggcccggctacggtctgtatgacagggcgctcggtatcatgtatttatggggcatatgggattcgctcaatagagaaaaacaggaggcttcaaaatgcttgaaatccatgaaaatttagcggggaaaactgcggtcatcacaggcggcagcggggtgctttgcggtgcgatggcgagagagctcggccggcagggtatgaatgttgccattcttaatcgaaccgttgaaaaaggggaactcgtggccgaagctgtccgaaaagccggcggcgcagcgattgcagttgagtgtgatgtcatcagccaacggagcgttgaacaggcgaaacgcgttgtggccgaccgattcggcggctgtgatctattggtgaacggagccggcggcaatcaccccaatggcacgacatcagatgaaacattcaactccgagcacatcttccaggacaacatcaagacgttatttgatctgaactgcgatgatgtcggttctgttctcaatttaaacttcctcggttctttcattccaacacagcaatttgcaaaaatgatgctgaatcaaaaaggggcgtccgtgatcaatatttcttcaatgagcgctcaaaccccgatgacgaaagtgcctgcatacagcgcggcgaaagcgggcatcgacaattttacgaaatggctggccgtctatctggccgaaacgggaatcagggtcaacgccattgccccgggatttttcctaaccaatcaaaatgaaaggcttcttcttgatcaaaacggcgaatttacagatagagcaaagaagatcatctctcacaccccgatgaggcgtttcggcaaaccggaagatttgctggggacgctgctttggctggcggatgagaagatgtccggatttgttaccggcataacagtgccggtagatggcggatttacggcttatgccggtgtctaaaaacacgataaaggggaggccggtacatgaagcagattgtgtgtgaaaagccttatcgttttaaaatgacggatgtgaaaatgccggaactaaaggatggggaagcattggtccgcatcaaacggatcggaatatgcgggacggattttcacgcttattgcggaagacagccatttttctcttatccaagagtgctcggacacgaactgtccggtgaaattgtcagcatcgataattccggcggaacgctcaagccgggcgatcaagtgtcaattattccttatttggaatgcggggcatgcatcgcctgccggaacggacgccccaactgctgcgtcaatctgaacgtcctcggtgtccatacagacgggggaatgcgggaatacataaacgtcccggcagaccacctgctaaaaacagaaggattgacgctcagcgaagctgctgttgttgaatgtttaagcatcggcgcccacgctgcagaaagggcaaatatcaaaaaaggggaaacggtgcttgttgttggagcggggcccatcgggctcagcgtgatgaaattcgcaaaattgaagggtgcaaaagtcatcgcgatggatgtcagaaaagagcgcctcacatttagccgcagatgggctgaagccgatgaagtcgtattagggggagaacatgcggctgatgagatcaaacggttgacgaacggcgactttccgacggctgtctttgatgcgacagggcaccctgcatcgatgaacagcgcttatcagtacgccgcacacgggggacggctgatctatgtcggacttgtcaacgaccatctggctatgcccgatcctgaaatccacatgcgggagctgacgattttatccagccgcaacgcattaagaagagattttgagacggtgatgaaagccatcatggatggcggagcggatgcgaaccggtttgtgaacggacagatggcgtttcacgatgttgttgacggatttcaatcagcgcttgctccggaaaccaatcctgtgaaagtgttgatccatctgtaagatcgcacgaaatgaaagcgttttctaaatttcggaaagaggggggttggccatgttttcaaacggccgcgggtttgtcatcgtgatgctttttttggcgggagtgattaattatttggatcgttcggcattgtctgtcgccgctccttttattcaggaagatttgaacatacgtccggcgcagatgggcatgctgttcagcagttttttcatcggatatgccgtctttaattttatcggcggctgggcatcagacaaatacggagcgaaacatacgctgtcggctgcaatggtcgtatggtcggttttcagcggcgctattgcactgacatataatttcgtttcactgtttatcatccgcgtcattttcggcatgggggaaggtccgctgtcagcggcaacgagcaagtcggtcaacaattggtttccgcaaaaagaaagggcaagagcgctcggcatgacaatgtgcggaacgccgctcggcggagccgtttcaggtccgatcgtcggattgatcgcgatccattgggggtggaaggcttcctttgtgttgatcatgatcatcgggcttgtttggacttgcttctggatgaaattcatgaaagataagccggctgattccggcagtttgtctcctgaaaaggaagcgcgtccgaaaaaggataccggcatcccgctgtctttttatttgaagcagccgaccgtgctgtttacggcgttcgcgttcttttcctacaactatattttgttctttttcttaacatggtttccgagctatttaacgacagcccgggggctgagcattcacgatatgagcgttgcaacgattataccgtgggttgtcggatttctcggtcttgcgcttgggggatttatttcagattatctgttcaagctgacgggcaaacagatgttttccagaaaagccgtgcttgtgtgctgccttttggctgcagcggtatgcattggatttgccgggcttgtcactaccgcgtttggagctgttgcacttgtcgcattatcggttttctttttgtatttgaccggcatcacatactgggcgattatacaggatatcgttcatccggacagggtcgggggcgtgagcggattcatgcattttcttgccaatacatccggcattatcggtccgacggttacagggtacatcgtcgagtacaccggagctttcacaagcgcctttttgcttgcgggagggctggcggtggcaggttctatttgcgtcgctttgtttgtgaaaccgatacgttctgaaaggctgcctcaatctgtaggagaaggcggacaggggcatcctttatgatgctcctgtagacatgaaaataacccccttctcagcagagaaggagggtgaaagtccaagcttcacggtttgttttttcttctgttcagcgttttaatgattttttcgcttcttcttctgagaagagaggtatagtctgacaggccgaattttgcgaaatcgacgtgtttgacttgttttttcagttttttcacagcatcacctaattcagcggtttagttgattggtttattgtatgtaagaaacgggaaaacggaataaggacgggagaatttttttcccgtcctcgttaagctttttttcttttatactcgccgatcagccgttcgttttgccggaaaatccgttcggtataggggctgacttcgtatttcgcgatattggttttggattgccttttaaacattttaaaggcgaggcgcttttttacgctttcctggtcttgctgaaaagcaggctccatcagtcgtcaccttcctcttcgtttggtagcagaagatcatagatgcttgttaaagaagtaaacaggagataatcaaattctgtgacaaggtcttctgaggttaacttcatgacatagtcaaaatcgtggatggaaaaaggaatgaggaccatttttccgttttcttcataataaacgtctttgcggtcaagcttttcttgaacatcgaaccggttttccatatgctcaagcaaatgatccttgctttcttctgaattatattcgcaaagtgcagcggatatattcattttttcggcaaaccgtttgatgagcttttcgatgccttctgcatacgcttctatatttccataatagatgtggatcggttcgtttttcaataggtattgaaacgttttcagcctgttttgatacgtgtggaggaggtcgttgttttcttcgagaagcattcttgtatctgtcgcgagttcagagctgccgagctttttaaagtaggcatttaagaaaataaaagcgtctgtcaacgtgaaaaaaacggcaacgatcaggtaatgaagcgggtttgtgaaaattgactgcggatcgtgcgtccaatatatcacggcgccgatgacataaagaaggtaccacgtttttctgatggcgaccgttttttcggcgagctgtttttcaaaacgccacacggcagctacgtacagagccagcgccaaaacaataagccaaacaaggaattgataaaatagcagcataacttgtttccctcttcccgagaaatagtgcagttcctatttctattgttatgccggctttcttttaaacatgaaaactcccgtcctagattcggacgggagtgtgctgattaaaagaataaatcaagtatgaaataggcaaatgcaccgatggttgccgaaatgggaagggtaatgacccaagtgatcagcatccgctttgcggtgccccagtttacgcctttcacccggtgggaagcgcccacgcctaaaatggatgaagaaatgacgtgtgtcgtgctgacaggcaaatggacgatcgtcgcgccaaagatgatgagggctcccgtcaaatctgcagagacaccgttgacgggacggatcttcatgatttttccgccgacggttttgatgattttccagccgccgacagatgttccgagtcccatggccatggcgcatgcaaactgcacccagaacgggatgtcggttgtactgtgcaagttacccgcgattaaagccatcgtaatgatacccatcgctttctgtgcatcgttcgtgccgtgcgtataggactgaatggcagctgtcgcgatttgaacgcgccgaaaccgcttattcgtttttgccagattgctgttcttaaaaatgactttgacgatgctgtagatcaaatatcctaaaacaaacgccaaaatgggcgataatataagtgcttcaataattttaataaatccgtggtatttaatcgcggcaaatccttccgatgcgatgacagctccggcaatcgctccgatgatcgcatgggatgagctgctgggaatcccgaaataccaggtcactaggttccatgtaatgccggcgataagagcggcaaggatcacgaccgatccgttttcaagcttgaaagggtcggcgatgtcgcttgtaattgttttggctacgcctgtgaacgtcatggcgccggcgaagttcatgacagcggccataataatggcatgccttggttttaacgcttttgtcgataccgaggtggcgatcgcatttgccgtatcatgaaagccgttgataaagtcaaatgccaaagcaaagatgacaatcaatatggttaatacaaataaaagatccattataatccctcgttacgcatttttcattatgatggtttctaaattgtttgctacactttggcatgaatctgcgatttcttcaagcgtctcatagatttctctgtactggatcactttaatcggatctgtctctttaccgaaaagatttttcagcgatttgcggtgcaggttatcgcagttatgttcgtattctttaattttaatggcgtgcggctgaatttctttcaggcgattttccgccagcaattcgatcgtcaccagaatttcttttgcgcattctctgatatagccgctgaatttgtcaatatgctcatctgaagatgtgatcgagaatatttccatcatggctgaaaagtgctcgatgccgtcgagtacatcatcgaggctgtttgtaagctgaaggatgtcttcgcgttcaatcggcgtgataaatgctttgttcagctccttaatcatcgtatgtacatagttatctccttttgtctcatactcttttaaggtatccgcgaattctttaagggttgtctgattcgtcactttatagttaacaaaatactcagctgtttcatctaaattttttgcaatttccgtcaaaagcacggaaaacttgtctttttttcttttcaacatttgtaaccctccattgtttaaatgagacaatgcacacatcaaaatattatataactttttgtcgaaaaaaaacaggtgcagtcgaaaaaaacaattaattttcaaatcgtcataccttttagataggcgcaagcaccagctggcatccgggattttaagatgacaataggcgatttttcctttgatatcatcgttccaaaagaacggatctcaggatcgtttcgagaaatttgggagtttaggttcaaaaaaatagaaaattgggagtttttcttattttcagtccgctttcctgttatagtagtaataaactggaaaggaaggtgatctgatgagacggttagctttcttagttgttgcgttttgcttggcggttggttgctttttcagtccggtgtcgaaagcagaaggagtcatgagcgggggagatggtgataaagtcgccgtcgggaaagacggtatggtggctacggcccatccgcttgcatcaaaaatcggagccgaagttttgaaaaagggcgggaatgccattgatgcagctattgcgatccagtacgcactgaatgtaacagagccgatgatgtctggaatcggcggcggcggtttcatgatggtctacgacggcgagacgaaggaaacgtcgatcatcaacagcagggagcgtgctccggagggagccaagcctgacatgtttttggatgaagacggaaaggtgattccgttttcagaaaggtcgagacacggaaatgcggtcggtgtgccgggaacgctgaaagggcttgaagcagcgcataagaagtggggaacaaagaaaatggaagacttgatttcgccttctataaagcttgcagaggaagggttcccaatcgactcggttttggctgacgcgataaaggatcatcaggacaagctgagcaaaacggccgcaaaggatattttccttccggacggtgaacctttgaaagaaggcgatatccttgtacaaaaggatttggccaaaacgtttaaattgatacggaaagaagggtcaaaagccttttatgatggggaaatcggccgggcgattgcagatgtcgtgcaggatttcgggggttcaatgacacctgatgacctgtcccgctacgaggtcacaacagataagcccatctggggcgagtaccacggctatgatattgcaagcatgcctcctccaagctcaggcggagtgttcatgctgcagatgctgaaattgattgatgattttcatttatcgcaatacgatccaaagtcgtttgaaaaatatcatctgctcgcggaaacgatgcatctctcctatgcggacagggctgcatatgcgggcgatccggaatttgtcgatgttccgctcagagggctgctcgatcccgattatattaaggagcggcaaaagctgatcagccttgattcgatgaaccgcgatgtgaaagagggcgatccgtggaaatatgaggaaggcgagccgaattatgagatcgtgcctcagcctgaagataaaacgatcggggagacgacgcattttaccgtcacggatcagtggggcaatgttgtctcttatacgacaacgattgaacagctttttggaacggggattttagtgcccgggtacggactgtttttgaacaatgaactgaccgattttgatgcgattccaggcggcgccaacgaagtgcagccgaataaaaggccgctttcaagcatgacgccgacgatcgtattcaaagatgaaaaaccggtgctgactgtcggttcccctggcggaacgacgatcattgcttccgttttccagacgatcttgaattattttgagtacggcatgagccttcaggatgcgattgaagagccgaggatctatacgaacagcctgacttcgtaccgctatgaatccggaatgccggaggatgtcagacggaagctcaatgacttcggccacaaattcggctcgaatccggttgatatcggcaatgtccaaagcattttcattgaccgggagaacaaaacgtttatgggggttgccgattcaagcagaaacggaacggcggttggggtcaacattaagacatcggctaaatagcggagcaaggcttggtctaaagtatttagatcaagccttcttccgtcagcggggaaaagaggatttttttcgaaagaatagaaatatattttttgaaagcgtttaccaatttataaaggaggggtaccatgattcacacgttggcaaatggattttaccgcttttgcgagtgggtgatgcggcttgcctatttgaatctgctgtggatcggctttacgctggcgggagcggtcatcttcggtttagcgccggcgaccgccgcgatgttcgctgtgactagacagtggacgctgggaaaaacggatgtcccggtgtttcagacgttttttcgggcgtttaaaaagaaatgggccaaatcaagcgttctcggtttgatattgggtctggtcggcttattgctgtttgttgattttcagattgcggccgtctattttcacgatcagccagtgtttttaagcctgttcatcagtttgtttatcatttatgccatcatcctcttatacgcttttccaattgatgtccactacgatttaaaacggattgcagtgctgaaatacagcttcatcatcggcttttcccgtccgctcacctcgtttttcatgctgatcagcgcgtttggcatgattctgctcgctttatttcatgtcacatttcttctgtttttcagcggcagcgctttaagcttcattttgacgaagctttcgtttcaggcattccgtgcaatcgacgggcgccggacagacaagcaggctgccgccccacgcttgaaatgaaggtgttcgttcggtgaaccggtatcagcatttaaaaattaaagatcaattgtttattttgatttcactgatcatggccgtttcgctcatcctgatcttgagcggcattcaatacgcgttccgggtatatgaccagcagatttacaggaagtcgtcacaggtgctgatgctatcatcaaaaagcattgaagatgaattgaaaaagattgaggatgtgtcatatcaaatcaccactgacgcagacatccaagcgaacctcctgaaagccggccgcggccagaacaaatacggacgctaccggataaaaagcaaaatttgggataagctggccgaatataccggctctaagcggtacattaaatcgattcatttgtttgatgcttccggcaccgagtactccgcaggggcgaatttaaccgaagcattgcgggagcaaaagaatgcactgatcgaaaaagcgtcgcgccaaaaaggcagcaacatgtgggagcccatgccgggtgaaaccggcgagctgttatccgtccgggaaatccgctcctatgagcgtttaaaccttgaccacctgggaacagtggtgattgtcgccgatttaaaacgggtgatcggcgatcttccgaaagactggggggaaggcgcgggcaagattgcgatgtcggacgggcgggagctgtttttttctgaaatgcctttcagccaaaccgatggcctccgattgtcttctcatgctgaaaacggatatgacattgtggaggaaaacggccagcggtttttcgtttcatatgtcaaatcagcgtataagaattggacatattggagcctgatcccctttgacgctatgttttcgaaaatttctgcgatgaagacgatcctgatttccctttttatccttttttttctgattgcggttctctttggaagaaaaatggccaggggcattacgagcccgattgagaagctggtggcggccatgaaaaatgtccaaaacggcgattttaaactggcgccgctcactcgcgctcctttagaccggcaggatgaagtcagcgtcttaaaccgcaatttctttacaatggttgaacggatcaatgaactgattgccgagaactacaagaagcagctgatgctgaaagagacggaattcaaagcgcttcaagcgcaaatcaacccccactttttatacaacacgctcgagtcgatcaactggcttgcaaaaacgaaccggcagccgcaaatttcaaagatgacggaatctctagggtttttgctcagaaatgccatcaatatgaaaaccgacgtgctgacgatcgaggaagaagctgaaatcgtgcgccactattttacgattcagcggtttcgctttgaggagcggctcgtttttgagctcgacattgagccggctgtgaaaaaatgccgcgtacctaagcttgttctccagcctttggctgaaaacgcgattacatattgccttgagcccttcattgaaccttgccatattcaaatcaaagcatataaaaaagaagagcttgtctatttaacggttgccgacaacggccccggcatggatgaagactttttggaaaaggcgagaaaggagcttgtccggacaaccgggagaggaatcgggctgcaaaatatcgacgagcgcattcagctgatgtttggcaaagggtatggcttgacgatttcaagcgaaaagaataagggaaccgtgatgatgattaaaataccatttcaaagcggggtgtgatgatgtataaagtgctgttggcggacgatgaacggattattcttgacggcatctccagcatgatcgagtggaattcgttcgggacgtctttgatcggggccgcacagaacgggattgatgcttaccgcctgattatggaaaagcggccggacattgtgatcagcgatattaaaatgcctgggatgggagggctcgaactgatcgaaaaagtgtcccgcgaccacccgtcaatccggtttattttgctgacgggcttcggccagtttgaatatgcaaaaaaagcgatgtcatacggagtcaggcattatttgctcaaaccctgcaatgagagccatattacagattcgcttcaaagcgtgatcggcgagctgaaaaaagaggaatcggcgcaaaaagtgaaaaccgatctggagatgatgaagccgcatcttatgaagcagatgttaaaagagctgatcaccggaggcggcatcgaggatgaagcgtgcctgcgctttttttcagagcaaaaggccatcaggctgatcctgttttccgtccgggacggggaggataaagattatgcacaaggcgttgaatccattgcggatgaggtgctgaacggtgctgtcatcgcctcggcccgggttcagcaattgcttgtctgtgcagtagacggaacattggcttctgctgtgcttgaggaaaaaatgaaaagcgtccaagagctttcacgccgcctgctccgatttgaaccagaagcatcactcagcgaaagcggcaatatcagcgaagcctccgcgatgtacgaaaaggcatatagaaagatcgtccaagatgaaggggagacatcggttttaatcggaaggatgcttgatctcatcgaaaaggaggcctcaaatccgaagctttcgctaaagtgggcagcccgcaacatgctgtatatgaatccggattatctcggcaagctgtttaaacaggaaaccggtgagaagttttcaagctatgtcgcaaaggtgcgcatcgaaaaagcgatcgcgaagatgaagaagtctaaaaacacggccatcggcacgctggcagaggaactggggtttggccacaatccaaaatacttcagccttgtctttaaaaaatacacgggactcaccccgtcagaatttcgaaaaaaagaagacaacacgttttaatgccgccgggtttatccggcggttttttgcgcattgacggaatctctgtttttttaacattcttctctgttttttgagtttctgggacagaaagctgaatttaaaatgaaatgtaagcacttacaaattggggagggggaatgttgatgagaagatttgtgtttgtctctttgtgcattttgctgacgctcggcctgttcggatgcagttcaaacactgaagaggcggccggtgcggacggcaaaaagaaggttaccttaagggtcgcatggtggggcggacagcctcggcatgattatacatcaaaaatcattgagctgtatgaaaaggaacatccgcatgtcaaaatcgaagcggagtttgcgaattgggacgattattggaaaaagcttgccccgatgtccgcggcagggcagctgcccgatgtgattcaaatggatatggcgtatttatcccaatacggcaagaaaggccagcttgaagatctgactccgtatgtcaaagacgggacgatcaataccgaatcgattgatgaaaagacgatcaaaggcggaaaaatcggtgatcagctatacggcttcccgctcggtgtgaatgtactgtcggtgattaccaatgacgacttgctaaaagaagcgggcgtcgagattgacgatggcagctggacgtggaccgattttgaaaacctggcgctagaggtcgaagagaagacgggacaatacggttcaaacggcatgcatccgcccgatgtctttttcccgtactacctcaggacgaagggcgagcgcttctataaagaggacggcacaggccttgcttattcagacgacaagctgtttgtcgattacttcaagcggcaggtgaagctcgtcgatgaaaaagcttcgccgacgcctgatgaaagcgcgcaggtgaaggggatggaagacgattttatcgtcaaaggccgaaccgctgcaacatggaattattcaaatcagtttgcggcgttcgcgcagcttaccgatgcgcccctgtcattaaagctgcctcctgaacaggcgaaggaaaaggcgctgtttttaaggccgagcatgctgttttcaattccgaaaagctccgaacagaaaaaagaagcggctgcatttatcgacttctttattaacaatgaaaaagccaatgccctgatcaaaggagaaagaggcgtaccggtctcctccaaaatagcggaaacagtgaagtcagaactgagcgaagaggagaaaaagattttcgaatatgtcgaacgggctacggagtacgcgggagaagcggaaccgcctgagccgatcagcagcgccgaagtcatcaagctgctaaaagacacgtcagaccaaattttgtttaaaaagatcacgcctgaagaaggagccgcgaagttcagaaaagaagcggacgccatactgaaaagaaatcaacaatgataagcggggcaagtgaaggaaggccgctcatcaaatccaggaggaagtgaacgtgaagcgaaaaaaaagaattgacaatttggcgggttatgcctttatttccccgtttattatcggatttttgtgctttaccgtcattccgatgggagcctcgctgtttctgtcttttacaagctacgatctgttcaccccgcccaaatgggtcggctttgacaactataaggcgatgctgaccgatgatgaaaaatactggggttcgctgaaagttacgttttattacgtgctcgccggtgtgccgctgcgcctcgcgtttgcgcttttcatcgcggtgattttgaacagagccgaaaagggtgtgggcatttaccggacgctcttttatctcccgtccatcatcggcggcagcgtggcggttgcgattatgtggcgcaatgtatttggcaatgacggtgtcatcaatgggcttttgttcttccttggttttgacaagaagattttttggtatcaggacccgacaagcgcattgtggaccttgattcttttgtctgtgtggcagttcggctcttccatgctgatctttcttgccggattgaaaaatattccgccgatgtatcaggaagcggcaagcgttgatggtgcaaacaggtttcagcggttttttctcattacgctcccgcttctcagcccgatcatcttttttaatttggtgatgcagaccatttcagccttcatgacctttacgccggcctacattatttcaaaaggggaaggcggtccgcttgacgggacgcttctgtattccctctatttgttccagcgggcgttcaactttttccaaatgggctacgcttcggctatggcatgggtgatgctgatcctgatcggccttgtcacattcatattgttcaaaacttcatccttatgggtgcattacgaatcgaaggaggggtagctggtggagccggtaaaagatatttcggggcgggccgcgcctgccccgcttcctgcgggaaatagaaagaaaagagccgggcgtctcgtgtttcatatcacgacggccggtcttgcgatcatccttttgtatcccgttatctggctgatcgcaagctcgtttaaagaaagtgcgagcatattcgccacatcccactcgctcattccggaccccttgatcctgtccaattatacggagggctggaaagggatcgccggacagccgttcatcacattcattaaaaattcgcttatcattgtcggcctttcgacggccggcgcggtcttgtcctcggcgttcatcgcttacggattcgcgcggattccgtttaaagggaaggcgttttggtttagctgcatgatggtgacgatgatgctgccgcacgaggtgctgatgattccgcagtacatcatttttgcaaagctggattggctgaattcattcaagccgatcgttgttccccaatttttcgggcacgcgttttttatctttctgatgattcagttcatcaggacgatcccggtagaactcgatgaagcggcaaagattgacggctgcagccgtctcggcatctttttcagaattattttgccattgatcgcaccggcgctcgcgacgtccgccatcttctcgttttactggaagtgggaggaactgatcaatccgcttctttacttgaacaagccggagctttacccggtttctctggcattaaagctgtttttagatacggaaacggcgtctaactggggggcgatgtttgcgatgtcagtcgtctcactcgtcccggtgatcctcgtgtttttcgtttttcaaaaatcgatcgtccaaggaatcagcatgagcggattaaaataaaaaggagagaagagtgcatgacaaagcttgtttttgatgaagaaaaactcaatcaagtgatcgacagaatcgttaagcggacatttgagatggatttcgaatgggattggccgggcggcgtcgcgttttacggcgtggctgaggcgtatgaagcaaccgaaaatgaagaatacctcgagcttttgaaaaactggacggatgaaaagcttgaagacggattgcctaagctgtcgatcaacggagtatccatcggccataccctcatatcgctctaccaggcgacaggagatgaccgttatctggacgccgcccggcaaatggcggactatgtgctccacgaagcgcctcggttcgcagacggggttttgcagcacaccgtcaactcagagaaacatgtattccctgaacaggcatgggtcgatacgatgatgatggcgggcttgttccttctccgaatcggaaagcttgtcggcagcgaggaatattttgaagacgggctgagccagtatcacggccatgaagaatttttgcaggatatggagaccaatctttattatcacgcatgggaccatgtggccaaaaacaacctgtcaggcatattttggggaaggggaaacggatgggcagctttaacgatggcaaaagcgctccctttaatcgatgttacgcatccgtcttatatgatcattgacggttcgctccgggacttgctgagcgcgcttgtcaggcttcagcatccctcaggtttatggcacaccgtactgacggacccggattcataccttgaagtgtcaggctctgccgggattgcatccggtttgctgtcaagaggctcgctataccacaaatccgttcagaaggcgctctcagccattacggatgcggtcgcgcctgacggaagggtggagcgcgtttctgcgggtacagcagtgatgcgggatgcgcagggttacaaagacgttccgtataaacggattcaaggctggggacaggggcttgccctgacctttttggcagatgtcgtccgctccaagtcgcgcgcgttccaatagaaattgaaaaaagaaacattcttttcattgcagtggggggaaaagggatgaaaaagctgcatcaaagatatgtttcacggcgtaaagggagtttttttaaaaaaagctttgtgatgatcctgctgattgcgtgtattcccggcttattgacgggtgcaggagtctatttgttttcggctgcgaaaattgaaaaagagctccaacatctgcacgagaaccaggtgaaacgccaaatcagccaaatcgatgacaagctggaagggcttgagatcatgctctcccagcttgcatatgatccgcgcctgatgaacggtctggccgatgccgatctgcaaacggattttcaaacgacgtacaagctctcaaaatcgctgtttttgcttcaggatcaaaatccgctcattcacaaggttgaactgttcattcaagggaaggagccgattctcttaaatccagaatacaacggactgaccgaccggaaaatcttgaaggcttatcattcgctgcttgaaggcggtcaaaacgtctattggaaagacatgagcggcgcttcatccggaatggcccttgtccataaaattccgggaggcatcttagaaccgttcggcgcgctgattttgacgcttgacgaaagagaattgggccggttgcttgagagcctttcgccgtattcaaagggaacagcgctcctttttcatcataatcagaagcctgtttcttggagcaatcgcggcaaaaccaactttgaaagcgccttaaaagaaaggcttgagaaacaaaaaaatccacagggctcctttgttatggattggagcggaggtgcgtattccgtttcatacggacgaatggacagattgaaccaggaatggacctatgtttcggcttcaccgatgtcggccattacggctccggtgctgtttttatcgaagctcatcgcgtcggtcagcatcgccgggatcgttcttgccttcattctggcatggtatgcgtcacacaaaatttattcacctgtcgcaaggctgatcaagctctgctccggagagggaaaggcggcctattttccggatgaatttcattggctcgagaagcgctgggaagacctatctgaggaaagcggcagactgaaaaaggaactgccccatgctgcaaacgttttttttcagcgccttctgagcggatactttgcagatgaatcagagaggaatttgagagatcgtctgaaaaggtggggctgggaagcaaaagacaatgtgtttaccatcatcgatgtccagctgacgggactctacgaaggaaacggatcttttacaaaaaaggatgaaagtctggcgggctttctgttgggaaacattacgcgcgaactggctggaaggacattcaaccatatttatatgacagatgtccgttcgctatcgcttgcggtgctgctggcgagcggccggaatacagccttcaaggaagaaatcgcccaatttgtgcgtgagctgacagatgtgatctacagcatatccaaactgcacgtcacagtgacggtatcaaaaaccgctgacaagttaaaagacattcccggcatttatgaagaggtgaaagaaggcaggcattacagacagttcgaaaacgccagccaggtgatcgatttaagccggcgggaagacatgcctcccgctgaatcatactatccgttcgctcttgaaaaagaggtagtcagggcgttgcggcttgaagaaagggatgaagtcgaaagaaggatcaggctgtttatccgggagctgtccgaaaaaggaaaaacggaaatccgcatccagccgggcatgatgcagctgttcgcaaagatccaagaagagatctttcattccggccttcacccctatgaattgttcagccgaaaaaacctgcttcaggagctttcggagctgagggagccggaaagggctgtcggctggatgatggagcgttgcataagcccttatcttaaagagatggaaggaaggaaaaacagacagcaaaaacggcttgtcgaacaggtgcttgagatgattcatcaggattatatgaacgatatctcgcttgaaagctgcgctgatcgggccgggacgaattcgtataccctgagcaaagctttcaaacaagtaaccggcatcaattttatcgactatgttacccggctcagaatcgaaaaagcgaaagagctgcttcttgagacgaataaaaaaatccatgacgtttctgaagaggtcggctacagacacagctatttcaaccggattttcaagaagcaggtcggcattccgccgagccgctacaggcagattcatcaggaatcttcgtgaaagggagagtgctatgaaacgaacagacaaaaaaccgaaagtgacagtatatttggccggggactcgaccgtcgcagactgtcccccgcatgaagcgccgatggccggctgggggcagatgcttccgctgtttttctcagatgaggctgcggtcgtgaatatggcaaaaggcggggccagttcgaacagcttcattgatgaaggccggctcgatgacattacggagcggcttgcgcctggtgattatgtgttgatccagttcggccacaacgatcaaaaaccgtacggaacagacccttatacaacctatcaggagcatcttgtccgctatgtggaagcggttcgcgaaaaacaagcgacaccggttttgatcacttccgcagagcgcagacgttttgatcaaaacggaaagcccgccgacacactcggggattttccgaaagcgatgaaggcgctcgctgacagcttcgacgttccgctgatcgatttatggtccaaaacaaaagcgctctatgaatctctcggaatcgaaggttcaaaacggctgtttgtccactttcagcctcatgagcaccctcattatccaaatggaatcgaagacaatacccatttttccgaagcaggggcccgtcaagtcgccaggctggtgacagaaggaatcagagagcttggtctgcctctatcggcttatctgctttgtgaaaggagcgatttccgtgccggagtgtaatggaagagaaggaagcctgatttatcaaaaccctttatcttctcctgaagatctccgcggctgggtgatggaagggaaaggaatcgttcgttttcagaacggccgcctgcatatggagaacgaacttgacgctgagcaatatggggacgatgctcattttgtttactggtgccctgagacattccctgatggaattgttgtgaagtgggatttctaccctgtgcgggagcctggcttatgcatgatattttttgcagccgccggcatgaatggcgaagatttatttgacgggcggctggcggagaggacggggaaatatccgcaatatcattccggggacatcaacacattgcacctgtcgtatttcagacataagcatgctgatgaaagagcattccgaacatgcaacctcaggaaaagccgcggctttcacctcgtctgtgaaggagctgatccgcttccgcccgctgcagacgctttgcctccctaccggatgaagctcataaaggacggggcatacgttcgtttttcaatcaacgagctgcccattttggaatggacggatgacggcaggcgtttcggccctgtttacggcgcaggaaagatcggcttcagacaaatggctccgctggaagcagcctacgccaactttgaagtgcgcaggctgctgcgcggctgaaaggaggagcggacatgcgggataaaggcgtaatggcgatgatgtacggcgcgtgtgaagcgatcatgaaaatcgcctggctgaacgggatctgggttttattcacgctgggaggaggcattgttttcggctgggcgccgagcacggctgcgatgttcacggtcgtgcgcaagtggctgctcggccggacggacgcaccgctgttcaaaacgttttatcaaacgtataaaaaagagtttttcaaagcaaacggacttgggctcatcctcattaccgccggaacaattttattcgtaaactatcaatttttccgcgtccgtgcggatttattttcgatcatgatcagctatgccacactggtggccgggctcatctatctcgtggttttcatttatatttttccgctttacgttcatgttcagctgccgtttgtccgctatttttcacaggctgcgctgatcggtctcgttcgccctttgacgacggccggaatggctgctgctggttgcttggtcgtgtatgtgctgttgacggttccgggtctgatcccattttatggtgtcagtttgtttgctcttgtatcgatgtttatcgcacatcgctgttttttgcgtctggaaggctagctgaactgtgcaaaaatgagaaaatcgggcaaaaaaatatcaattggaaaggctgaaccgcttaagaccggacttgaacacatcttttcccttcggcaaaaaagtgcaattgaataaaaatggaagccgtaatagaatcccttttgagtaagcgtttacaaaaatggtgaagggagaagatgatgaaaaaaggaaagaaaaggtggaagaacctgttggccgcgtcatctcttttattaatcacgctagtgaccggcttctcggagcaagctgaggcagacgggcggacggctgcgcaggcaaggcaaatggaatcgcttaacagggggcttgtcgctgttaaaacggggaacggtgtctttgtcagctggcggcttctgggaaccgagccgtcttctgtttcatttaatgtgtatcgaaacggaaagaagctgaacggttctccgattacatcgagcacaaactatcaggatgcaggcggggatttgaacgccgtttaccaggtgcgcgccgttttgaacggcagggagcaggctccttctgaatccgtcggcgtattgaataaacaatataaatctgttccgctgcaaaaaccggccggaggaaaaacgcctgatggggtgtcatacacatacagcgccaatgatgcgagcgtaggcgaccttgatggagacggccaatatgaaatcattctcaagtgggatccttccaattcaaaggataattcacaggacggatacacgggagatgtgctgattgacgcatacaagcttgacggcaccatgatgtggagaatcaaccttggcaaaaatattcgcgccggcgcccattatacgcagtttctcgtctatgactttgacggcgatggaaaagcggaaatcgccatgaagacggcagacgggacgaaggacggcaaagggaaggtgatcggcaatgcaaacgccgattaccgcaatgcccaaggccgaattttgtcagggcctgagtatttgacggtttttaaaggcgatacaggcgctgagcttacaacggtcaactacgaacctgcccggggaaatgtagccgattggggagacagctacggcaacagggttgaccgctttctggccggtgtcgcataccttgacggggagcggccgagttttgtcatggcacgcggttattacacgagaacagtgctagtcgcttacaacttcagaggcggaaagctgaccaagctgtggacgttcgattcggatgctcccggaaatggcgcctatgccggtcaaggcaaccacagtttgagcgtcgccgacgttgacggagatggaaaggacgagatcatatacggagcgatggctgtcgatcatgacggaaaaggcctctactcaaccggctggggacatggggatgccatgcatacagggaacctggacccgtcaaggcctggactggaagtcttccaagtccatgaaaacagcaattctccttatggcttgtccttccgcgatgcgaaaacaggaaagatcatctggggagttcacgcaggtaaagatgtcggacgcggaatggccgctgatatcgatccgcgctacgaaggagcggaagtatgggcgaacggcagtctttatacggcaaaaggcgtaaaaatcggaaacacattgccttcatcaacgaacttcggcatctggtgggacggcgatctccaaagagagcttctggacagcaacagaattgataaatgggattatcaaaattcgcgaaccgtcaacttgctgacagcgtccggagcttcggcaaataacggaacaaaagcgacgccgtccctgcaggcggacattctcggagactggcgcgaagaagtggtctggcgagcggaggacagcagcgaactgcgcatctacacgacgacagacgtgacggagcaccgcatgtatacgctgatgcatgatgcagtctatcgcctcggtatcgcctggcagaatgtcggctacaaccagcctccgcacaccggcttttatttaggcgaaggcatgcagacaccggagaagccgaacatttatacacgctgatgataaaggggagctgcataatgaagcgatatgttcgctgcttatgggtcatccccctccttttctttttcatcatgggaatgggggacctgcgcagccgaaagccgctgccgcgcatcacagtcaggatctttttctgttcgattttggaaaaggtcccgctgagaaggattatgtgaaagtgaacgagtcctccgtgtatcaaaatggtgctggctacggattttctcaggcaggaagcgctgtgtgcaaaaagacgcaaaaaaaagaagcgctcaaaaaagactattgtatcgtgaaccggacggcttttctggcagatctctcccccggcaaataccgcgtgaccgtttttgcatcatccagcggtgaattgaagctttatgccgaaggagaaaaaatggggacgatcccggccggagcaaagggaagctcagccgaaaaagcgttcaccgtttcggtggaagacgggcgcctcgatctggagtgaaggggcctcagccaaaggtgtatgccatcgaaatttcgaggtgtatcagttcgatttcggtgacgggcctcttgcttcgggttttattccggtaggcgctgcttcggcctatacccctctaaaaggctacggatttgacgacgcggcaaaggtgtcctgcacggaccgaggtacggccgacccgcttcgttcagacttctgcattccggatgggacggcgtttactgtcgatttgcctgacggtcaatatcaagtccaaatcataaccggagatgcgcgggcaaagacgaacatggacgtacgggcaaacggcatgctccagctgtattcgtttggagcggaagcgggcggatacaacgaaaaaacgtttccgattcatatttccggcggccgtctttcgatccaagccttaacggcgagaacaatgccgcgccttaatgcgttggtcattacgaagacggcttatcatgtgacggatgacaacacgacggtctttctggcgggcgattccacggtctccgattatgagcccggctatgcgccgatggcaggctgggggcaatttttaggcggctatttctcggatgaaatcgtcatcgacaaccaggcgaaacgcgcgagaagcgcgaaaagttttgtggatgaacggtcgctggctacgattttgaaccggatgaaacggggcgactatttgttgattcagttcggcattaatgacgcagggcaagatcctgcccgccatacagatccgtatacgacatttcaggaatacttgagaacatatattaacaaagcccgcgaaaaaggaggacgtcatgtgctcgtcacttctcaaagcaaacgtacctatgatgaaaagggcgttttctacaacagcatcggagaatatccgaacgcaatgagacagctgggacgggaaatgaacgttccggtgatcgatttaaacaaaaaaagcattgaatattacaacgagatcggcgttgaagcgactaaaaacgtatttatgtttctggaaccgggagaaagcccgaattatccggaaggcatccaggacagggtgcattttcacgagttcggcgccaaccaattggcaaggctcgtcacaggagaaatctccgatttgaatatatatccgctgaaacactcgctcaagaaataaggtgtcgggagatccggtctccggctctcccgttcgccattccaaaccgcaaagggggagagaggactatgggagaaaaggacagacatgcagcagctgatcgcgttcgtccggtgaaaacggcggcaaaaccgaagcaaatggaacacttaaaccgcggccttgtggcggtaaaaacaaaaaagggggtttttctcagctggcggctcttaggaaccgatccggaagaaaccgcttttaatctataccgcaacggacaaagaatcaattcaacacccatttcatcatcgaccaactttcttgataaacacggaaatggaaaatcgctttattatgtgtccaaggttctcggagataaggaagtcgagacgtcgcccaaaacagctgtctggcagaagccttacttggaagttccgttaaacaagcctgacggcgggacaactcctgacggcgcaccgtatacgtacagtgcaaatgacgcgagcatcggagatctcgacggcgatggagaatacgaaattgtgctcaaatgggacccgtcaaattcgaaagataacgcgcacaacggctataccggagaagtcatcatcgatgcctataagcttgacgggacattcatgtggagggttcatctcgggaagaacatccgcgcgggcgcccattatacccaattgatggtctatgatcttgacggcgacgggaaagcggaaattgctatgaagacggctgacggaacagttgacggaaccggccgggtgatcggcgatcaggctgccgattacagaaatgaaggtgggcgaattctggccggccctgaatatttgtcgatttttcacggggaaacgggaagggaattggcaaccgtggattacgatccgccgcgcggaaggcttgaggactggggagatggatacggcaaccgcatggatcggtttttggcaggcatcgcctatttggacggcgaaaggccgagccttgtcatggcccgcggctattacacaagaacggtgctagtcgcttacaacttccgagacggcaagctgaccaagctgtggacgtttgacagcgacaagcccggaaatgaaggctatgccgggcagggaaaccatagtctgagcgtcgctgatgtcgacggtgacgggaaagatgagatcatctacggcgcgatggccgttgatcatgacggaacagggctttatacgacagggcttggacacggtgatgccatgcacgtgagcgatcttgacccggaccggccggggctggaagtctttcaggtgcatgaagatccgcgccttccgtacggcctctcatttcgcgatgcgggtacaggggaaattctctggggagtgccggccgatacagatgttgggcggggaatagccgcgcatatcgatccccgctataaaggagcgcttgtctgggcgatcgatccaccgggcaatgaaggaaaatcgtacggcctctatacgagtaagggagaaaagctcagcgatgccgctccggcttcggccaattttgcgatttggtgggacggcgatcttctccgcgagctgcttgaccacgattggaaagaacccgcaggcatccccaaaattgataaatgggactatcacagcggcaggctggtcaatctgctcaccgctgacggaacgctgtctaacaattggacgaaagggacgccagtgcttcaggccaatttgttcggcgattggcgcgaagatgtcgtgttccgcacagtccgaagcgatgctctgcgaatttacacaacgaccgagccgactgaacaccgtttctatacgttcatgcacgatcccgtctaccgcctgggggtagcctggcaaaatgtcgcttacaatcagccgcctcatcccgggttttatgtgggaaccggaatggacaagccgccccggccgaatatttataccgttccttgtaagagaaatgaagaatgaaagagaacggcggttcagcatgcgctgggcccggggcaccggcagaaatattcaacttacaaaaaagtatgattgtaatcttacagcctgttccataaaatgattggtaagcattttcattacaaaatgaaaagggggatccatatggggtatcaggcgagtgatgtacgctatgaaaatatgaaatacaacctctgcgggcattcaggattaaaactgcctgctttgtctttagggctttggcacaatttcggagaagcggcttccttgcaaaatgccaaagcgctgttaagaaaagcatttgacctgggtatcacccactttgacttggcgaataattacggtccgccgcccggttctgccgaagaaacattcggaaaagcgctgaaaaccgattttgccggctaccgcgatgaaatggtcatcagcacgaaagccggctatacgatgtggcccggaccatacggcgattggggatcaaaaaagtatctcgtggcgagccttgatcaaagtttaaaacgaatgggcatcgattatgtcgatatattttattcacaccgccctgacccccatacaccgctggaagagacgatgggagcgctcgcccacatcgtcaggcaaggaaaagctttatatgtcggtttgtcgaactacagtgctgaacagaccgaaaaggcggctgatattttgcaagaatacgggattccgctcctcatccatcagcccaaatattcaatgttccacagagaaccggaaaaaggcctgctgcaagtgctgcagaaaaaaggagccggggcgatcgcgtttacacctcttgcccaagggcttttaacaacgaaatatttgacagggattcccgccgggtcaagagccgctgatgcgaacagtccgtttttgcaggccgagggcatcacagaagacgtgctcggcaaggtccgcaagctgaatcaagtggctgccgaacgcggccagtctcttccgcaaatggcgatagcctggctattaaaagacccgcgcgtcacctcggtgctgatcggcgcgagcaaaaccgaacagatcgaagaaaatgccgcggcgcttaagtccgctcgattctcagctgaagaactcgacacaattgataaaattctttcataaataaggagtggtcgtgatgacaatcagcatctatttggccggcgattcgaccgtgcagcattataaggctgattcgcctcagggaggctggggcgaatttctccagtcttatttatccggaaatgtacaggtgatcaaccgggcaatcgggggccggagttcaaaaacgttcgttgaagaaggaagacttgcatctattttggatgtgatcaaacaggatgattggctgttcgttcagatggggcacaatgatgcgtcgaaagacaaaccagaacgctatacagagccgtatacgacgtataaacaatacttgaaaatgtacgttgacggcgcgcgtcaaaaaggggcatcgccgcttctcatcacacctgtcgcaaggctccattacaaagacggcgtctttttaaacgatttcccggactactgcattgcgatgaagcaggtcgcaagcgaagaaaacgtccgcttgatcgatttaatggacaaaagccttcagcattttgcggaaaaaggatacagcgaagtatttaaatattttatgatctcggaaaatgtcaacgactatacacattttacgaaaaaaggggcccgggaaatggcgaagctcgtctcggagggcattcgagagcttgggctgccgtttgtcaaagagacggtatgaagatgaacggaaagctgtaccatggcgcttgcttttatcccgaattgtgggatgaggatgtgctggatgaagatatcaggatgatggagcgaatcgggatcaatgttgtcagaatcggggagtttgcctggtcaaggatggagcctgaaaaaggaaggatcgatgtcggattttttgcagacgtcatccgaaagctccgcgacaacaaaattgaaacggtcatgtgcacgccgactgcgacgccgccgatctggctgacccacgggcacccggaaagaatgcatgtgaatgaaaaaggggagacgatgggacacggttcgaggcagcatgcctgcacaaaccatccctatttcagagagcgggcccggctgatcatcaaacatatcgccaaagagatcggagaactgccgggattgatcggatggcagcttgacaatgaattcaaatgccatgtcgcagaatgcatatgtgaaacgtgccgcacattatggcacaaatggctggaagaccgctatcagacgattgaccgtctgaatgaggcatggggtacgggcgtatggagcgaaacgtatcagtgcttcgagcaagtcccgcagcccggaccgaccccgtttttgcataattcttctttaaggacaatgtatcagctgttttcgatggacaagatttctgaatttgcgcgtgaacaggctgaggtgatcagagcatactccgatgccccgatcacccataatagcagcgtcatgttcggcgttgatcatgaagaccttttcaagagccttgattttgcctcgtttgatacgtacgccagccaggaaaacagtcaagcctttttgtttaattgtgatttatggagaaacatcaaaaaaggacggccgttttggattatggagacgagcccttcctacagcgcttcgcttgaaagctatgcggcgcctcatcaaaacggctatttgaaagctgaagcggtttcttcttatgctcttggcggagccgcgttctgctattggctgtggcgccagcagagagccgggtctgaacagccgcacggatcagtgctcagcgcatggggggagcctgatgtgggatatgaaaatgtgctcgaagccgagcgggcaagacgagaggttgaacacatcatgctggctacggctcctttgcaggctgaaacagctgtcgtctattcggaccgtgcgaaggtgtttttgaaaacggagcctcatcggggtcttcattacagaacgctgatcaccgagttttatgaccgattattaaagatgggcattcacagggatgtcattcttgaagggagcccgctggacggctacaaactgctgtttacgccgtttattcattatcttccccctgcttttatcaaaaaagccgaagcatttgcacaaagcggcggcatttggattgcgggtccgctgacgggcggaagaacagagcaccatacgattcacactgattgcggattggggcctttagaaaaatgttctggtgttaaaacgctgtttacattcccgatggatgagcggaactcaagcggaacggcgtttggcgtaaaggcgccgctgagcttgtggagcgctgtttttgaagccggcggcaccaaggctgtcgggatgattgagaaaggcccggcgtcaggcaaagcgttcatcacggaacacaaatgcggaaaaggcaaaatcgtcatgctcgggtcgatgccggcaggcgaagcgggggacatcatgatgaaaaagctgatcagccattatgccgaagaagcgggcgttgagcagaaaaccgatgtcactcccggaacagtcgtcgcgccccggaaaggagcagacggtcttgtctgggtcgtgatcaatatggacggcaaaggaggcgcagtgacacttgacggcaacggaaccgatcttttatccggcaggcccgtaaccggacgcgtaacactcggcccgcacgactaccgcgtgattttgttatcagagaataaatgaatcgccgcaggctcttgcccgcggcttttttggtttgttttgcaaaaaacgatgattcctgcaaaaaaggagttggcatcccgctatcataagcaaaaaaggaatattgacggtcaataggctaaacaggaaaatattcactgaccaatcggttgaacagaaaggaggaacgcttgtgaaagcacaggctgaactaaaatggctgaatagagcgcctgcttcgttcggcggggtgacttggggagtgccttgggcaaaaggagtgctgcaaaaaggggagacggccgtcatcgcttcggaaaacgccccgtatttgcaaacatggccgcttgcatattggcctgacggctcgattaaatggacgggccatgccgcagtattcccagaagaaagcggacgccgatttacattgcaaaaaggaaagcccggcgcgccgaaaaccgtcgtccgtgtcagcgagcagaaagacgaaatcacggtgaatacgggcgcgatagtctgcaagctcggaaagtcggggccggcactgatccgttcgatttccatttccggggaaatgatggcgaaagaaggacggctcatcgctttaaaagaaaaaagaagcggttcagatacacaaagcatgtattatattgaacggtttgagagcttggtcaaacgtgcggcaatcgaacaaaacggtccggtcaagacagtcatcaagattgaaggcgtccaccgcggcggaggcatcgatgtttggctcccttttaccgtcaggctttctttctatgccggtgtcccgtccatccggatcgtgcacacgatcttcatcgactgtaacgcagaaacggaatggatcaaaggactcggtttagagatgagcgcggttttgagcggagcgccaagaaacaggcatattcgctatgcagccgacggaggaatttacggagaggcttctcagctgcttgtgacgagaagatttaatgaaacaaacgggttctatgaacgacagatagccggacagcctgtcccggaagagtcggaagtcgtgcgtgatgcagagaaaaacgccgtctggaacgatttcaagctcattcaggattcccctgttcactggcgcttaaaaaagcgaaccggcaaagactgcgcctgggtggacgcgattcatggggggagagcgaaagggctgatgtatgcaggcggggaaaatggcggcatcgcgctcggcctcagaaacttctttgaaaaatatccatcatcgcttgaagcgcaaggtcttgccggcggcgaaacaaaattgacggcatggttctggccccctgaagctgaagcgatggacttccgccattattcaaaaggcactcacgttgaaagcgcatatgaagggtttgccgaaatgaggtcgacggctgtcggcattgccaatacgagcgaagtcaacctcgcctgtttttcaaatccgccgagtaatgaagagctgaacagagcggcggacgaatggcaaaatcccccattgcttatttgtgagcctgactattattatgacacccgcgctttgggtgtttggagcctgaaagataaacggcgcccgctctcagctgcgcttgaagatcagctggacgaggctctcaagttttacatgaacgaagtcgaacagcggggctggtacggctattggcattacggtgatgtgatgcatacgtacgatgccgtccggcatgtatggcggtatgacctgggcggctatgcatggcaaaacacggaactcgtaccgaacctctggctttggcagtctttttttagatccgggagggaagacatcttcagaatggcagaagcgatgactcgtcacactagcgaaatcgactgctaccatttcggggattataaaggcctcggttcaaggcacaatgtcctccattggggctgcggctgcaaggaagcgagaatcagcatggccggcctccacaagccttattattttttgacggcggatgagagaacgggggaagtgttaaccgaggtgaaagatgccgatcgagcgcttgagatgcttgatccgatgagagcctattatccggaaaaagagttccctgcccacgcgagagttggccccgactgggcggcgttctgttccaattggctgacggaatgggagcggaccggtgatgaagcgtaccttgataaaatcaaccggggaatcggccggctcaaagcgctgcctcttcgtctgctgtccgggccgactttcggatacgatcctaaagcttcagatctgcttcatatgggtgacgggaatcatggcggctatcatatggtcatcgcctttggcgccccgcaaacatggatggagcttgcagaactgctggaggataacgaatggaaggagatgctcggcgaattcggcgaattttatttgctggctgatgaagaaaagcgcaagaggagcggcgggaagcttcacgatgatttatttcactggccgatgttctccgctgccatggccgcttatgctgcgaggcttcaccaagaccggaagcttgccgaaaaagcatggcggctgttgctggacgaaaaacaaagccatacaccgctgccgatcgctccaaaacaagtccatgcgtggaacacgatcacggaaatcccttgggtcacgacaaactgcgtctcacaatggtgcctcaacacaatagccgtgctggagctgctcaaggatatgccgcctgatcaggacatgcaagaaaagatcatcaaagcaatgaaagatcatcccgctcgcgtgtgagggcaaaaaatgaaggttgccggaaaaatgtaagcgttttaaattcgagtggaacaatgaaacgatcaaaagggggaattgtaaaatggcaagactgaagctgaagggaaacaagtggctcgctgcacccgctgtctttttgctccttatcgggtgcagtgcaaatgagacgtcgaatcaagacgggaaaggaaaagagaaggatgccattcatattatggctccgctcctctcgccggaaagtccgggagaaaacagtccgtctttaaaagcgctcgaaaaatacacgaaaaaacaaattaaagtgacatgggttccgaactcttcctataatgataaattcaacatcgtcatggcctcgggggatttgccgcaagccattgtcgtcacggacaagtcgccgggttttatcaagtctgtcaaatcaggcgcgttctgggagctttcaccttatttaaaagactacccgaaccttggaaaggccgatgagaaagtgatgaagaacagttccattaacggcgagatttacggcatttacagggcgagggacctcatccgcgcttcgattatcatcagaacggactggctcgaaaatgtcggcctggagatgccgaaaacaatcgacgaattttacgacgtactgaaagcgtttaaagaaaaagaccccgacggaaacggaaaggacgatacgtacggcatggtagtcccgaaatggatggggctaggcaacgggagcccatgggatattatgcagacatggttcggtgctccaaaccgctacggagtagacgaaaaaggggaactcattccggacttcacaacagaagaatatatggaagcgctgcgttttttcaaaaagctgtatgatgaggggctgatcaataaagacttcgccgtaatggattcagcgaagtggaacgatccggtcgtcaaagggaaagctggtgtgatcgtcgataccggttcgcgggcatcgcagatacaaagcgcaatggaggaagccgatcccggaaacaaggatgtgatcgatgtcatcggaacggtcaaaggcccgaaaggaacgtatacattcccgacatcaggatacgccggaatgattgccatcccgaaagcgagcgtcaaaacggaaaaagaactaaaagaagtgctcggcttcttggacaaaatgaacgatgaagaggcacagatcattgccaataacggcgtaaaagggcgcaactataagcttgaaaacggtgcgtacacgtcccttgaaaaaaacaacaaaaaactgctttacgagcacgagggtcttgcgcagttcagcatgggcattccggaacaaagatactatgtggaaaagcaagaatcaaagctgtttaaacaccgtgaacagattcgcaaagaaggggagaaaatcgccgtattcaacccggcagaatcgctcgtttcagatgtatacacccaaaaaggggcacagcttgacaacatcatcctcgatgccaaaacacagtttatcatcggcgacatcgatgaaaaaggctttcaagacgccgttgagctttggtataaaagcgggggcgaagatttgatgaaagaactgaacaaacgctacaaggagactaaatagctcaggtctttaaacagcacacgaaaggggggatgcggcacatggaaatcaccgcaaaaacagggaagcccgctgttaagacagaaaagaaaccgactgggctagaggccgtaaaacgggataaatggctttatcttctgcttgttcccggtgttttatattttctcatatttaaatattggccgatgtggggcgtattaatcgccttcaaggattattcgccttatctcggattttggcagagcgaatgggtcggattcgagtattttaaagatttctttatgaatcctgacttcttccgtctgctccgaaacacgcttatgctggccgctctcgatttgatctttgcatttccggccccgctcattgtcgctcttttactgaatgaactgcggcacgccatctataaacggtgcattcagacgtttatatatgttccgcatttcgtctcatggacgatcgtcgtcagcataacgtttgtctttttcacggttgatacgggcgtgatgaataaagtgctgcaaagcataacgggccgagagattgcgtttctctcagatcccgaatggttcaggccgatgattgtgctgcaaagcatatggaaggagacgggctggggaacgatcctgtttctggcggcgctcgcttcggttgaccaagagcagtatgaagcggcagtgatggacggtgcaggaaggttgaggagaatgtggcacattacccttccggccatcagaagcacgatcgtcgtgcttctcatcttaagaatcggcagctttttgaacatcggcttcgaacagatttttttaatgaccaattccttaaaccggagcgtagctgaaatcttcgacacatatgtctatgttgtcggaatcacgcagggcgcatacagctacagtacggcagtcggtcttttcaaatcggttgtcgggatcatcctgatattctgcgccaactatatcgcgaaaaagtttgaccaggacggtctgttttaatgaatggaggtgaaagggatgtccggtgcggaaacgatccataacacaaaagcgggccgggtgttcgattggtttaatgtgatctttctcggctgctgcggactgataaccgtcttgccttttctgtatattatcgcggggtcatttgcgacggaggccgagctggcggaaaggagcttctttatctttcccgagacgttctcgcttgacgcgtaccgctatattttttcaacgccgacatttatcaggagcatgggggtgtctgtgcttataacggtcgtgggaacgatcgtccagctcttttttacatttacgatggcctatcctcttgcaaaacggcacatcaagggaaggaatctgcttttgaatctcgtcatttttgcgatgcttttcagcggaggaatgattccgacgtatatcgtcgtcaaatcactgggactgctcgattcctattgggcgctgattttgccgatggcgatcaacccgttcaatctcattattattaaaaacttttttcagcagcttccgaaagagcttgaggagtcggccaagattgacggctgttcagaaatcggcgtgttcttaaggatcgcactgccgctgtctaagccgattattgcgacttttgcgctgttttatgcggtcggcatttggaacgactttttccatgctttgctgtacatcaatgacagtgcgaaatggccgctgcaaatggtgctgcgccaagtgacgattctttcggatctgacggggacgacgaatgatatgatggaaacggtgccgcctgaacaatcgatcaaactggccgtcatcgtcattgcgacgcttccgattttagccgtgtacccgtttttgcagaagcattttgccaaaggcattctgatcgggtctgtgaagggataaaaaaaaaccgccgggctcatgtgccggcggcttcggctcaggcagctgagccgtttttatttctttttttcatccaaaaataaaccgggagaccgacgagaccgatcaagatcgaccacaggcagctgtagaagtctgtgatgagcgtgctgacaaggacaaacaatgacccgagaatcgccgctacaggcaggtaaggatagagcggcacgctgtaagatcttccttggccgttcttccgtctccgcaaaataaataccgcgaaaaacgccatgacatagaagatgtaaatcataaaaatcgaaacctctgacagcttttcaggattgctgatgatcattaaaatgacagcgataatcatctggacgatgactgcgatccaaggcgtatggaatgccggatgaacatgcgagatccagcgggagaaaggcagctgttttttctcagccatcgcaaagatcacgcgcggaaaagacagaacctttccgtttaagcagccgaagatgctgacgataattccgatggatatcagcttgccgccgagcggcccgaacagcatggtcgcggctgtgcttgtcgcattttcgccgagcttgacaatctgatcggcaggaagaatgtgaagcagcgccaagttaatgaacagatagcaggcagtgacgatcagtatgccgcctgtcatcgctttcggaagcactttttccggattcttcatttctccgccgagtgctgcaagaaggatccagccgtcatacgcgaatagcgtcgccaataccgccgccccgaagttttggctggcgatgctctccgtgaccgaactgaaaatatattcatcgccctgccatagaccgaacacaatgatacatacaatgggaatcagctttccgatcgttgtgatcgtctgaaccgctccgccgtattttgttccgacgatgttgacgatgcataaaaaggcgacggtgatgatgccgatgagtgcagtccaggatttatcccaggaaaacaagttggccacaagcgagccgaaatataatccaagtgcgccgatgatggccggtccgtagatgatgatctgcacccagccgcataagaagccccagaactcgccgtaaatttcttcaagatatgtgtaaagaccgcctgttttcggaatctgtgcgcccagttcagcgatggtcagcccgccggcaagcgtcaagattccgccgagaagccaggcgaaaagagcgatttgtgcgtttccggaataggaaagcacgctgccgggcttcataaacacgccggaaccgatgatcgttccaatcacaagagatagcgcaaataacaagcctatctctttttttagtccgtttgcttctgcattcattgctatgcctcccattgatgtgatctctttcatagaaaactatttttatattgtaataccttttttaaaaaagaaaaattaaataaattttctgattttcgtatttcttgtatatgttaaacatttcaaggtcgtaaaccccgggataaccatcaataaccgaactttaatatatgatttttgatatattgttagtttttataggagagggagggaggcccgaccgggaagacggtttggttgacttttcaaatcaaatcgcctattttggagaaagaataaatctcgaattcgagatatttaattgggagatgatagaatgaacgtaaatggcattcaccacgtatctgctttaacagcaaacgcccagcataacctggatttctatgtcaaagggcttggcatgaaactgataaagaaatcggtcaatcaggacgatccgaccatgtaccacttgttttacggggatgaagtcgcgtctccgggttcggatttgacatttttcgagattccgatgcttgcccggagacgggaagggacgaactgtatttcggccgtatcacttcgggttcccggtgaacaagcactcgaattttgggagaagcggcttcatgagctcggcacagagatttgcggcatcgagacgcgtgcggggcggagcattctccgctttttagatcatgaaggacagaacatgatgtttgtagctgatgaaaagggaaaagaccatggagtgcctgtgaaaaacggcgtcattcctgaggatgctgcaatcagggggctcggcccggtcgaactgactgtcagggacgccggtccgacggcggcggtgctgaccgatattctcggctttcataaaatcggtgaggaacaggctgacgaatccggccaaacgcttcacatatttgaatcgggtgaaggaggagcaggcacggaggtgcatgtgaaacagtcagatgacggcagaagagagcgtcccggaagaggaagcgtccatcatgtcgctttccgcgtcaaagatgaagaagaacttaagcagtggcatgagataatcagtgagaacggcttttcgaattcagggattgtggaacgctattattttaaggcgctgtatttcagagaaccgaacggcatactttttgaactgtcgactgacggtcctggctttgccgttgatgaatcaattgatgagctcggccaaagccttgcccttccgccgtatctcgagcatcggcggaaagagattgaagcgcggctgaaaccgatccgataaaaaaacgaggtcccgaaaaggacctcgttttttatataggctctgttaaacgtaaatgttgatatttgataactttccataatattggtataatcagatgagaacaaacattcgatgagaggctatcaaggtgagcgaagcgtttgcaacttgttaaagtatatcggcaaattaccacgagctgaaaaagaacaagtgtaccaatgggttaaacgctatgctgaaccttcttccattgttggtgttcgattataacagagacatatgacagtttgcgactcgcaaaaatgaatgtgcagtcctaattcaaccattcagtaggattgttagaaagcgctgaatagaaatttataaaatgttgggttattaaaaatgaaaagtgaggtttgtatatgaatactgtcagccaagaaatccaagatttgtccattaaatctttggaatcaacttttaataaactaacaaatgcttataaaagcacgacagaaaaaggttcaaacacaactcttgtcaaaaagagactaaacgcagtgaaaattggtttagaaagcctaaaaggtacttggtatggagaagatttcggctataacgaagaaatcatattgactactaaaaaagttttaaaaggtatcattccatctattgaaaaacaaatagcaaaagcaaaagaaggcagtcctcaaaaaacattaaatgagcgtcgcctgactgcactaaaactggcaatcgaatctttggagaaccgtcttatataagacggttcttaaattgtttcagaatcgtgtgagttacataacaagattgaaggaaaccgtttttactacggcttccctttatttttgcgtatttaacaacatccaaatctaacagagtctttatataaaaggcatccggcacagccggcggccccgtaaaggggggcatgctgttaagatgatgcggattctttctggtcaagggtgatttgttttgtcatggttttgccgtttcgaatgagggtaacctttaccgtatccccgatttttgcatcgttgtaaagaaggttgcgcagcgcgcttcctgtatcggtttcttttccgttaaagctgacgatgacatcgttctctttaaggcccgctttttcagctggggagcctgaagcgacctggcggatgtagacgcctttgtttaactggctgccgcttaatccgagggtgcctgtttgatagttttccggcacctgctcaagatccatcatgccgattccgatgaacgggcgctcaatttttcctttagacatcagctcttctgcaatcggtttgacatcattgcttggaatcgcaaatccgatgccttctactccgctttcactgattttcatgctgttgatgccgatcacttcaccctttgtattcaaaagggcgcctccgctgttgccggggttgatggccgcgtcggtttgaatgacgttcatctcggtttggcctgcggatgtatctacggaaacggtccgatcaacaccgctgatgatgccttgtgtcaccgtgcgggacagatctttgccgagcgggtttccaatagcgatcaccgattcgcctgctttcaagcttgacgaatcgccgaaagaggcgactttttccacgtgatcagcggaaatttcaacaacggcaaggtctgtcaacgaatcgctgcccagcaatttaccttccacttctttgccgttggacagggaaaccgtcagtttagacgcgccttcgacaacgtggttatttgtaataatgtatgctttgccgtttgcttttttatagatgacacctgagcctgtgcctgtttcttgttcgcttgagctgctgctgttgctttcaaaaccgaacataccgctctctgtttgtttttgatagtttgaaataccgacgatggcgggagatacattttcaaccattgtagaaatgtcggacgaattggtgctggacaatttttcggtattcgctttagtggaagaagccgatgagttcgacgtctcgtttgtttgcgtctggacggatgtattggccgtttcgtctttgctatgctggtatgtcgtgacgccgagaacgaggcttcctccgatgatgccgctgagaatcggcgtcatccacgagagtctccgcttttgctgttctgctttttttatcgcctggtcgggcttttgatcggagacgatgagttcgttttttgtttcaagctgatcttctctattatattccatcattttcacgctcctattgctatcatatcctttgatgccttaatcataaacaaagactgtgggataaacatgaaaacattgtgggaaattgtcaaagaaaaaggatagaatatatagggtgctatttataatatgacatgtcagaggtgttctaaacgttgaacaagattggatttatcggatacggaagcatggcacagatgattgcggtgaaactgctagatcaggggaaaatcagggatgacatggtggtcgtcagctcaaggaatgacgggaaaacagaggagctgaaaaagctttatccgaatgtcgcctgtcaatcagctgatgagctcgccaaacagtgcggcctgatcttcatctgtgtaccgccgatggcggtaaaagaaacgcttgaaaaaatacagccgtttcttcaggaggatgtccacatcgtttcgattgccgcgggggtcgagcttgaccggcttcacgactggacaagcggacaggtgacgagatacattccgacactcacatctgaagccgggatcggcgtttcgcttgttgtccacggcgagcgggtcgctgaggcggacaaaagccggctggaagaatatctttccgccttcagcacagtcaaacagatcaatgagagagatattgacgctgcgagcaatttaacaagctcttcaccggggttcatcgcttcgatttttgaagaatttgctcaagccgccgtcagaaacagcagcctcacgaaagaagaagcgtttcaatttctgattcattcattgctgggaacaggcaagctgttaatggaaaaagacatgacgtttgctcaaacgcttgatcgggtggcgacaaaaggcggcataaccgcagaaggtgcggaagtcattcaagatgccatgccggaagtctttgacgagctgtttgccagaacgatgaagaaatatgaagtcatcaaagacgctgtccgccggcagtgaaccgcggcattcatcgacatatccggatatccgcaagctgcctgaccaggcagcttttttatttgcattcgacaacattcatcaaaattccaattttatattaaatttctaaaattaccaattgttattgcatttctattaaaattctaatataatttgttagaatattcccaaaataataaaaaatttgagacgtttttaaggggtggttttttgtgaagctgtatatgtctgttgatatggaggggatttccgggcttccggatgatacgttcgtcgattcaagcaagccgaactatgagagaggccggaagatcatgacggacgaggccaatcatgtgattgacgaagcgttcaaaaatggatgcagagaggtgattgttaatgacagccactctaaaatgaacaacctgttaattgagaggctccatcctgaagcgcggcttatttcgggagatgtcaagccgttttcgatggttcaggggcttgatgatacatacgacggagccgtgttcgtcggctaccatgcgagagcgtcgatgagaggcgtgatgtcgcacagcatgattttcggcgtcagacatttttacatcaacgatcaggcggtcggcgagctggggttcaacgcctatgttgccggttattacggcgtcccggtcatcatggctgccggtgacagcgaggcggcagctgaggcggaggagctgattccgaacgtaacgacagcagccgtcaaagaaacggtctcccgttcggcggtcaaatgtctgacgccggagaaagcggggcggctattaagagaacggatggcatatgcgattcaaaaccgcggtcaagtcaagccgctcacacctccggacaggccggtgctgcggatagaatttgccaattacggccaagccgagtgggccagtctgatgccgggtgctgaaatcgaaccgcaaacgacgactgtccgctatcaagcgaaagacattcttgaagcctatcaagcgatgcttgtcatgaccgagcttgcgatgagaacgacattctcctaggaaggtgggatgaaaatggcgggttacatcatgaagcggctgctgtggatgctggcaaccattttggtgatcacgacattgacctttgtgatgatgaaagtgattccgggctctcccttcaatgaagaaagaaatacgaacgaagcggttcagcgcaaccttgaggcttactatcagctggatgagcctctctttgttcaatatttgtactatgtaaagtcgatcgttacctttgatttcgggccgtcgatcaagcagccttcgcaaagcgtgaacgacttgctgtcaagaggatttcccgtttcgtttgagctggggatgacggcgcttattgtggcggtcatttccggaatcgcactcggaatctttgctgcgctgcggcaaaacggcatcatcgactatatagcgatgaccattgccgtactcggcatttcggttcccaactttattatggcaaccttgctgatacagcaatttgccgttaattggaacatattccctccgtcgacatggacgagcccgcttcatatggtgcttccgactgcggctttggcgatggggccgctggcgattatcgcaaggctgacccgatccagcatgatcgaagtgctgacgcaggattatatccgaacagcccgggctaaagggctttccccttttaaaattgtcatgaagcacgccctgaaaaacgcccttatgcctgttgtaacgattctcgggacgcttaccgctgcgattttaacggggagcttcgtcatcgaaaaaatctttgcgattccgggcatgggaaaatattttgttgaaagcatcaactcccgcgattaccccgtgattatgggcaccaccgttttttacagcatcatcctcatcatcatgttgtttctcgttgacatggcctacggaatactggatccgcgtattaaactgcataagaaagggtgagcttatgagccttccagtccgcacagaaaaagaagcgtcttcaggcagtgatatccctgttgaatggtttgccccgctgaaacagaagcaggatgagcgtgaatccgtcgcaaggccgagtctgtcatattggcagaacgcctggcggattttaaggaaaaacaagctggcgatggcgggattgggcgtgttaatcttcctgttcttcatggctgctctcggaccggttctttctccgcacagcgtcacccagcagacgctatccgagcaaaacctgcctccgtcgacggagcattggttcggaactgatgagctcggacgcgatgtgtttacaagaacgtggtacggagcgaggatttctctgtttgtcggtgttatggcggctttgatcgattttgcaatcggcgtcatctacggcggcatcgccggctataaaggcggcaaaacagaccacgccatgatgcgggtcatcgaagtgctgcacggactgccttatttattggtcgtcattcttctcatggtcatgatggggcctggactcgggacgatcctcgtcgcgctgactgtcaccggctgggtcggcatggcgcggatcgtcagggggcaggttttgaaggtgaagcatgatgagcatgttctcgcatccaaaaccttcggagcgaaaacggtaaggatcatcaggcggaatctgcttcctaacatgatgggagcgatcatcgtccagatgaccttgacggtgccgtcggccatttttgccgaggcatttctcagtttcctcggtttgggcattcaagccccgtttgcgagctggggtgtcatggcgaacgacggccttccggtgatcttgtcgggacactggtggcggctgttttttcccgctttctttatttcattaactatgttcgcctttaatgttgttggagacggactgcaggatgcgttagatccgaagctgaggaggtaatgtatttttgcggaaaaaagtattggaagtcgagaatttgcatgtttcatttacgacatacggcggaacggtcaaagccgtccgcggcgtgagctttgagttatatgagggggagacgtttgcgattgtcggcgagtcgggatgcggaaaaagcgtgacatcgcaaagcatcatgcggcttttgccgaagttttcggcaacggtcacagacggtgcgatccgctttaagggaaaagacttgcgccacctgtccgaaaaagagatgagaaagatcagaggagccgaaatctcaatgatcttccaggatccgatgacggccctgaatccgaccttgaccgtcggagaccagctggcagaagcgctgttggaacatcggcccgtgtctaaaacagacgctcgaaaagcagtcatttcgatgcttgagctcgtcgggatcccgaatccgaaagagcgtttgaggcagtatccgcaccaattcagcggagggatgaggcagcggatcgtaatcgccatggcgctcatctgcgaaccggagattttgattgcggatgaaccgacgaccgcgcttgatgtcaccattcaggcgcaaattcttgagctttttaaagacattcagcggaaaaccggggtatccatcattttaatcacccatgatttgggcgtagtcgcacagacggcagacagaatcgccgtgatgtacgcagggaaaatagctgaaacgggagcgaggagggatattttttaccgtccgcagcacccgtatacaaaaggcttgctgcactccgttccgaggcttgaccttgaagatgcagacctcgttccgattgacggaacaccgccggatttgttttctccgcctgaaggatgtccgtttacggcgcgctgttcccgcgcaatggaagtgtgcggcaaaatccatcctgccgttacagaagtctcggcgggtcatcgagtgtgctgctggcttcaggatgaaagggcaaaaagggctctgctgacaacataatcataaaatcgatttttcaaatggggggatttgatgaaaaggctgacgagcgtgttggcttccgcatttgcggtcatcctgctgttcggatgtacggcaaatgaacaggcggggcaggaaacgaagaagaaagcgaaagaaacggctggagaacaggttctgaggctgaacaacgaaaatgaaccgacatcttttgatccgccgatcggctttaataatgtctcatggcaggcgctgaacaatctgatggaaggtttgacaagacttggcgcagaccatgagcccgaagcggcgtccgccgaaaagtggaacatttccgacgacgggaagacatatacttttacaatccgtgatgatgccaaatggtcaaacggagaccctttaaccgccggggattttgaatatgcgtggaagcgtctgctcgatccgaaaacgggctcctctgccgcgtttttaggctactttatcgaaggcggtgaggcctttaacagcggaaaaggttcaaaagatgatgtcaaagtcaaagcggtggatgaaaagacgcttaaggtgacgcttgaaagtccgcagcagtcgtttttaagcattgtagccaatccggcctttttcccggttcctcagaaaatcgccgaagacaatccgaaatggcatgaagaagcagccacattcgtcggcaacggtccgtttaagctggcagaatggaagcacgatgaaagctttacgatggtaaagagcgatacgtattgggaccgggatactgtgaagcttgataaagtgacatgggcgatggtcgatgaccgaaataccgactaccaaatgttcgagtcgaatgaacttgatacggcttatgtcccggctgaaatgagcgagaagctgatgggctctgatgaggtgaaggtgtttgatcaggcgggtctttatttttacaggttcaatgtcaataaagagccgttccagaatgaaaaaatcagaaaagcgtttgcgatggccgtcgatcagcaggaaatcgtcgattacgtcacgaaaaacggtgaaaaaccggcacgcggatttgtgtctccgggaatcaaagggccgaacggcaaggattttcgcgaggaaggcggcgatttgctcaaatataacgccgatgaagcgaaacagctgctcgaaaaaggcatgaaggaggaaaactacgaaaagctgcccgccgttaccttgacatacagcacaaaaccggagcataaaaaaatggcggaagcggttcagcaaaaactgaaaagtacgctcggcgtcgatgtgaagctcgccaatatggaatggaacacattccttgaagaacagaaggcgctcaagttccagttttcccaaagctcttttctggctgattatgcggatcctatcaacttcctggaaagctttcaaacgggtaacgcaatgaacagaaccggctggggcaattcagagtatgacgagctgatcaaggcggcgaaaaatgaagctgatgaagaaaagcgcactgagctgctgcatcaggctgaagaactgctgtttgaagggatgccgatcataccgatccacttctataatcaagtccatttggaaaaggagaatgtgaaaggcatcgtccgtcatcctgtcggctacattgaactgaaatgggccgaaaaaacgtcatgaccaaaattgtccgtctgctattttctttgtgcatactgccgcacaggagcggacggacttttcataaagggggatgtctctgttgaatattgcgcctcaaagattaatgaagggagatacggttggtgtgattgcgccggccagtccgcccgttcctgaaaagcttgaccgggccgtccggtttttaaaagagcttggacttgaagtcaaagtgggacgctcagccgccgaaagacacggctatttggcggggagcgatgaagagcgtctgggggatctgcacgacatgtttgaagaccgttcggttaaggctgtcatctgtgcctgcggaggttacggaacggcacggattgccgggaaaattgactaccggctcatcaaaagccgcccgaaaattttttggggctattcagatatcacttttttacatacagcgatcaggcaaaataccggacttattacatttcacggaccgatgctcagttctgacatcggcaaagatgacgtgcatccgcttacccgccgctcctttcagcagctgtttcaaaaaatgacgctctcttatacagaggaactgtcgcctttggaaacgctcgtacacggcgcggcggaaggggagctcgtcggcggaaacctcgctcttctggtgacgacgctaggtacgccttatgaaattgatacgaaaggaaagcttttgtttatcgaggatgtcgatgaagagccttatcgaatcgaccggatgctgaatcaattaaaaatggccgggaaattatcggacgccgccggcatcctgctgtgcgattttcataactgcatcccgaaaaaacgcgataagtcgctcacattaaaagaggttttccaagattatatcgcctctgaaggaaaaccggcgctgtccggctttaaaatcggccattgttcaccgaatatcgccgtaccggtaggagtgaaagccgtccttgacgccggcaaaaaacggctcaccatcgaaccgggaatttcttaatgggaaaggaggccgccatgaagattgccgagattacgacaaaccgcatcgccgttccgctgaaaaaaccttttaaaacagcgcttcgaaccgtccgcaccgcagaagccgtcattgtcaaagtaacggctgaaaacgggatgacaggctggggagaagcgcctccgactgctgttattaccggtgagacgcttgacagtattgagggggcagtcaacacgattctcgcacccgccctcaccgggtgcaacttgcgaatggctgaggcgatatttcatgatatcgacaagctgattgttggaaatacaagcgcaaaggccgctgtagaaacagccgtctacgattgcttggcgcagctttgcggtcttcccctgtatcaattgctgggcggatacagacgggagatcgagacggattttaccgtcagcgtcaatgacccggaagaaatggggaaagacgcggcccgctatgtacaggaagggtttcgcacgctcaaaattaaggttggaaaaaacgacatggcaacagacctcgaacggatcagggaaatccgcaaacaagcgggtcccgctgtccgaatccgcgtggacgccaatcaaggctggacggcgaaacaggcggtcaaagccattcggaaaatggaggatgaggggctttcgatcgagcttgtcgaacagccggtccaccggctcgatctcgaaggcttgaaacaggtgacagatgccgtcgatacgccgattatggcggacgaaagcgtgtttaccccaagggatgcttttcacgtgctgaaaacgagaagcgccgatctcatcaatattaaactgatgaaggcaggcggcatccgccaggcgctgaaaatcaacgccatggcagaagcgtgcggagtggaatgcatggccggaagcatgatcgagacaaggctcggcatcacagcggccgtccacttcgcagcaagccagaaaaatgtgacaaaattcgattttgatgcgccgctcatgctgaaggaggatatcgttgaaggcggcatccgctatcatgcaggaacgatcacgataccggatgctcccggactcggaatcacgaaagtctgccatgaggggggagaggacaaatgagcctttatacgacagccgtctcagtcgccaatgtctggaccagtccggaagcgccgcgcacaattgaccggatgatgctgtcaaaccctgtacatgtgagaagctggcttgacgaattgtcctacgaggagcgccttgagctatgtacggcaaaccttgttcaaacgcaagtgcttttcggcgaagatgtccaacttataaaggagcggggagactgggcgttcgtcatcattccgggacagccgtctgcaaaagacaaacgcggctacccgggctggattccaaaggactgcctggtcgaaaaaagcccggcgaagtctgagacaagcgccgttattcaaaaaccgacggctttcttatatgatgacaagaaaacgaaagttattgagctgagctttctcaccaagctgcccgtcttgtcttccggcggcgtctggtttgaggtcgatacaccgcttggccgcaaatggctgaaaaaagaagatgcggatctcgaaacacctgtaaaaggcagcggagacgatatcgttcaaaccggtcaggcgtttttgaacctgccctatctttggggagggatgagcgggtttggctacgactgctcaggatttgtcttcaatatgctgaaggcgaacggccgctccgcgccgcgcgatgccggcgaccaggcgaaaggcggaaaagaggtatccttcagcagcccgaagcggggcgatttactgtttttcgcatatgaagaaggcagaggacgggttcaccacgtcggcatttactgcggaaacggagagatgcttcactctccaaaaacgggcaaatcgatcgaggtcatatctcttaaaggtacaatttatgaaaaagagctgtgtgccatcaggcgctatttttaaataaaacggggggattggcatgcaaaccggcgctttattgaaagtcagccgtctgaaaatgcactttgacgccggaaggggcaaaacggtcaaagcggtcgacggcatttcatttgatattaaagaaggagagacgttcgggctcgtcggagaatcgggctgcggcaagtcgacatccggaagagtgctgatgcgtctttatcagccgacagaaggcgaggttacatatcgggggaaaaacatccaccatttgagcgatgatgaatcattccagtacaaccgcaaaattcaaatgatttttcaagacccgtatgcttcattaaatccgaggttaaccgtcagggagattatgacagaacctatggaaatccacggcctctacggagggaaaaaggcgcgtcttgaaaaggcggacgagcttctggaagcagtcggtctgcacaaaagctttgccaatcgctatcctcatgaattcagcggcggacagaggcaaagaatcggcatcgccagagcgcttgcgcttgaacctgaattcatcgtcgccgatgagccgatatcggcacttgacgtctccgtgcaagcgcaggtcgtcaaccttttaaaaaagctgcaaaaggaaaaagggctcacgtttttatttatcgcccacgatctttccatggtgaagcacatcagcgaccggatcggcgtcatgtatctcgggcacatggtcgagatcaccgacagcggccggctttatcaagaacctctgcatccttacacccaggcgcttttatcagctatcccgattcccgatccggatgtggaagacaagcggagacgaatcatactgaaaggcgagctgccaagtccgatcgatccgccgagcggctgcgttttcagaacgaggtgtcctgccgcgatggacatttgcgccgccaaaaagccgatgttaaaagaagccgacgacggtcattttgtcgcctgccatctgtatgacggagacgcaaggaaagaggaggccggcttgaaggtgacgctgcaggcgaggtgattatagaaaaaaggagccctatttacagggctcctcagcgtgccggcagcttttccacatttgttaagtcgccgattcgaaatggaataaggatcaggcgccgcctttgtaacattcagtggaagtacgctcaatcggcagagtacagcatctgaatgatccgcctgattttatgatctcggataagtcgatttcgatgaccgtatagcccctttttctgagctcctgattcacgtggcggttaacaggcaggctgatcacggttttattgccgatggacagaacgtttgtaccgagttggaactgttcatcatccgtaatttcgatcatctcatagcgctttttcaagacgtcgtattctctttctcctaaggcttttggatagacaagcgcttctgtcggcgaaagaatgttgaagacgcaatccagatgaaggaacgtttcttcaaacggaaccggtatgacttcataagagggaagcctgcgcttcagctcttggacggccgagaacgtcgttctgtggctgatgccggcatatatggtattttggtcgacgaggatgtcgccgccttcgatttgatagccttcattaaatgcggtccaggagatttgttcttttgccagccattcctgcaggacattttcttcgccctggcggatgtcggctgaaagctgcgcggaaaacacagtgcctccgatcgtaaacccgatatcgcgcgtgaaaacctgttccggaaattggcttaaagcaggcagaatcacgacttcaataccccggctctccaattcttttatcaatgtattatgctggcggacggccagcgttttatcgatattatccttttgaaaatacttctgtgtttcattgatcacttctgcaatctccatatactccggtctgcataacaccactttttttaagacgtcgtattcgcttgtacagcccgccccgcggttttttttcgataatgctgagtccattttgattcccccgtcctctctttagtcatttcattattccctacccgcagcgggaaataaaccttttagccagaaaatctgacagtcagccggataaaaaagtttagacaaatgaattctaatagtgtttaatatagaaaaaatccactttacaaacgcatcttagtagacatcaaaggagtaatggatgatgaatggacctgaaaagagatactgcaaagaatcaaaagttgtcaaaacaagcagggtatttccgcttgatacgaacaatcacaacaccttgttcggcggcaagctgatgagctatatcgacgatatcgcttcgatttcggcagcgagacactcgaggtgtgaaaccgtgacagcttcaatggattccgtcgattttctcgaaccgatccgccaggaggattcagtctgccttgaatcttatgtgacatgggtcggcagaacgtcaatggaggtattcgtcaaagtcattaaagagcatttgctgacaggcgaacgaaagcttgcggcgacatcctttttaacctttgtggcgcttgatcaggacggcaatcctcaggccgttccccaagttgtaccgcagtctgaagaagaaatcatgctgcacgagaccgcccggcagcgcgccgaagaacggaaaaaccatcgcaaacacagcaaagcgctggcccaggcgctggctgttgacaaaccttggtaaacatacgaacaaaaccccggctcaagcatcagtttgccggggttttgctgtgcaatgaatacactacccaatatttgttcaaaataaattacaaaaaacggaaagaagttttgggtgaaatgcttgaatttgtatggacttttttagccaagcctgctttagtgttctctatagcttatattcttttccgaatcgcagggaagaaagccgtttcgcaaatgacgaacttcgaccttttgctgacatttgcgattggaacgatcatcagcgaaccgattcttacttctaaaatttcaatgtccatttattacgcgcttacctttctgatcttctatttgttgattgaaaagctgtcattacacaataaatggcgatggtttcttgtcgtcagtccgaccgtgctgatccgaaacggcaatattgataaaggaggattaaaaagagagcggctgactgtcaatgaactgctcggcaaattgcgcgaaaaaggctatgccgacccaaaagatatcgacctcgccctgattgaagaatcgggccagatcagcgtgattcccaaatcggaagcaaggcctgtacagccgcgggacctcaacttggagacgaagcggaatttcgtgccgattccgctcattttagacggcgaaattatcgaacacaatttaaaatacttgaaaaaaacgaaagaatggctgtttcaaaaattagaggataaagggattgagcaagcgatgctgccaaccattacgctcggcaccttgaacgaaaaaaatgaaattataattgatacggaagatcccggcagcccgttaacccatgacccgtatctctataaaccggggcaagaccattaattttcgccgaataggcgatttttttatttcctgctatttcagaaaaatattaagagtctgtttttttattcgttgataaaaatgaacagggcatttgtcataaaatttgaaaatggtgtcacaaaaaataggaggaaaatatgttgttttctgtatttttatagcatatattagtttttgtgaaaaaattttgatggtaggtgcaattgatgaaaaggttttttagtgtaataattttaggcgccctgctgctgctcgggacatctgcgccaatcgaagcggcagactacggacgcgacgtcctcggctcaaaagacggctggggcgcttatggaaaaggaacgaccggaggcgctgacgcttcttctgatcaggtatatacggtcaaaaaccgcaagcagcttgttgaggcattagggggagacaataaaaagaacagcgaaaatgatacgccgaagatcatctatgtgaagggaacaatcaatcttagtgttgatgatgacaacaatcctttaggctatgaagattataaagaccccgaatattcgatcgaagcgtatctcaaagcttatgatccgaagaaatgggggaaaaaggagccgacaggaaagcttgaagaggcaaggctccgctcgaaagataatcaaaaggaacgggtcttgatcagagtcggttcgaacacaacgattatcgggctcggagatgatgcgaaaatcgtcggcggaggcctttatgtcaaaaacgcggaaaacgtcattatccgcaatatcgaattcgaaaacgcgtacgatttcttccctggctgggatccgacggatgggagcagcggtaactggaattcagaatatgacaacctgctgatcgaaatgtccaaaaatatttggatcgaccactgctcattcaatgacggagatcagcctgatgagctgactgaaacgcatttcgggcgcgaattccagcatcacgacggactgcttgatatcaaaaagcagtcggatttcattacggtgtcatacagcatattttcaggacattctaaaaacacgattatcggatcaagcgacagctacaaagcagacaacgggcatttaagggtgacattccaccacaatctctacgaaaatataaaagagcgggcaccgcgcgtccgctacggaaaagtgcacatttacaacaactattttaaaagcacgaaagacagctacaattattcatggggcgtaggctattcttcaaaaatttatgctgaggacaactactttgacctgccggaaggaacgaagcctcaaaaactgatgaaggtctttaaaggtgacgctttatatgaaaaagatacgatcgtaaacaaccaaaaaagcgtcgcaaaaattgatgttgtcagcacatacaacaaagcaaacaatgcgtctattaaaaaatcggccggctggaagccgacgctgtttgaaaaaatcgacgacgcagaagatgtcccggcaatcgttgaagcgcacgcaggcgcaggaaaactgaagtaatcaagcaaagcggacatgcagatgatgtccgcttttttgttcaggtatcttgcaatgcaaaatagtgtatgttatcattcgtgtatcttgtattgcaagatacataaaagaggtggcttatgagttcaacgcaaatgctgaaagggattttagaaggatgtctgcttgccgttatatcagaaggggagatatacggctatgaaatgacaaaggtgcttgcgggatacggtttttcggatatcagcgaaggaagcatctatccgattctcctccgcatgcaaaaggaaaaatgggtggagaccgaactaaaacggtcggcgagcggcccgaagagaaaatattacagacttacaccccttggagaagcggagcttcaatcgttcatcgaccgttggaaagcattatccgggaacgtcaatgcactgctcgaaaaaaaactgaaggagaagtgaaactgtgctatcaaaggacatgcaaaacgtattggacgagatgagaatctacttaatgtcttcaggaaaaagcgacaaagaaatcgaaggaatcatgaatgagctaaccgttcatgcctgggaaggagaaaaggacggaaaaaccgtccggcaaatttttggggattctcccaagtcatatgttcaagcgctgtcaaaagagctttcatcaaggccaggggagatcgccaagttgttctttgccattttaatcggcgcaatatcctattttatattcagcgacgccgtgaacgacagcctcgattattctgtctatacgctggcaggctatccgctttatattttgctggcagcggctatgttgccgcttttgggccggattacagcatttaaagggaagaatacggccttcatgtatacgatggtgtacgccgctttgacgttttttccgattttggccattatttttattgaccggcaattcgggacaccggttttttcgtttgatgggggaagccgctggctgattatggccctgtcgtttcttgtgatcgtatgtttgtctttcaggttgaaagccggagccttgtccatattgccgctgcttttagccggaacgcattttttgtttcagtatatgaactgggattcagcaggagccatgatggcagaaacttatattccctatatcgggctgcttctcgtcatgtttattgaaacaaagcgtgccagaaatacggctcaatatgaatgaaatacagaagagcattatattttttaaggtgaagactcttgccttttggcgatcacaacgtttatgatcagagcatgaaaggtggccgatatatggatatgatgtggggctatgtactcgtctttattttggctgcgattccgtggtttgaagtgatcggtgtcgtgccgctagcgatcattgccgggcttaaacctgttccgtccgctattatcgcgctattcggaaatctattaaccgtactgctgcttatttttttaattgacaaagtgaaggtatggctagaaagaagacgcggggagcggagagcggagacggataagttctcaaaaaggaaaagcagggcgaaaaaaatatggctgacctacggcattccgggcctttctttcgtcgggcctttctttatcggctcccacttaaccgcgtttatgtgcatgggctttggggccaagcgcagacaaacggcgctgtggatgacggggagtctcgcagtatggacaacggcgtcggctgtcgctgcctactatggtttcagtttcctcgctcctgaaaatgaagggctgctgaaaaatatctttaaacaggaggagtgaagatatgccgtttttgaaagatttatctccagatgaagagatggcgccgacagtcgggctgcttttttcggcggtcaatgaaaacatcgaacggctgaaatcaatcgtctccggcatcagccgggaagagctggaatataagggtgagcatggcgacaaaaacagcatcgcccagctgatctatcatttaatcaatgtcgatgtccgctgggtttacaggctgaaggaaagcgaaattccaagagagctggaagagaaatacggaccgatgacggatgaaaacggacgtttgccggaggtgacaggcgtccctttgaccgtgttaatcgagtggcatgaagaggtgctggagatgttgaaacacaccgctaaaggcttttcggaaaaagacttgctgaagaaggttccgtatgagggagggttttcgacgatccgctgggggatctggcatatgtctgatcataaccgctatcaccaggcgcatattcaggcttgcttaaaagagttccgcatgcaaaacagttgattttttcgtatgatttggtatgatgctaattagcaaacttcataacgttaaagttttctagggttccgcacattcgtatgtggcctggtccgagagaaaacacatatgatttgttcatatgcacacggagggataaaagcccgggagtatcgtttccatcgatagcccgggttttttcttttgctgaaaatgaaattggagggattgtgatgagatggggcagtgtcatacttgcagccttgtttgaaattggctgggtcatggggctgaaacacgccgattcggcacttgaatggatctgcacggcggccgccgtcgtgatgagcttctatatactggtgaaagcgggggagaagctgccggtcggaaccgtgtatgccgtatttaccggtctcgggacggcgggaacggtcgtctgcgaaatcgccttgttcaatgagccggcaaatatcgccaagcttgctctgatcggtgttttgctatgcggcgtgatcggtttgaagcttgtaacaaatgaagagaaaggggaggcgtcataatggaatggatctgcctcatcgccgccggtatactggaaatgcttggcgtgacgatgatgaaccagtttcataaagacaagcgggtgagatggatctttttgttgatcatcgggtttgccgcttcttttttcttgctttcccttgcgatggagacgctgccgatgggaaccggtacgcagtgtggacagggatcggcacggtcggaggtgcgcttgtcggcatcctgttttacggagagccgaaagacggaaaacgcatctttttcatcgcgctcattttgggatctgccgtcgggctgaaacttattagctagagtcgggttgatgcaaataggcgttcgtaaattgatttttcaataaactccagtataatgaaaagatagtttacgaattacaagcaaagagggtttttacgaaaatgaacgcatatatgaaacagcagttatcgcaatatcaggaaatcaataacgataaggcccgccttctggtcagctgtccggatcagcctggaatcgtcgccgccgtttcttcatttttatttgagaacggtgcgaatattattgaatcgaaccagtatacgacagaccctgaaggaggccggttctttctgcggattgagtttgaagttcaaggcatccgcgaaaagatcgaacagatgaaagcggcattcgcctctgtggcggagtccttccaaatgacgtggagcatgaatttggcgagcgaactgaaacgcgtcgctatcttcgtttcaaaagagcttcactgcctgcatgaactgctatgggaatggcagagcggcaatttgatggcggagattgcagcggttatcagcaatcatgaagatgcaagagaaactgttgaatccctgaatattccgttcctttacatgaaagcgaacaaagacattcgtcaggaagtggaaaaacagcagctgaaatggcttgaagagtatcgtgcggatgtcatcgttctcgcccgatatatgcagattttaacgcctgattttgtctcggctcatccgaacaaaatcataaatattcaccactccttcctgccggcttttatcggggcgaatccgtataaacgggcatatgaaagaggcgttaaactgatcggagcaacatcgcattatgtgacaaacgaattggatgaagggccgatcatcgaacaggatatcgaacgggtcgaccacagagacaatgtggaagcattgaaaaacatcggccgaacgattgagagaagcgttttggcaagagcggtcaaatggcacttggaagaccggattatcgtgcatggaaacaagacgatcgtctttaattaaattgtttgatctgcctcttgacagaggcgtttttcctaggcataataataaaaaatcacgagcgttgaagagggccagtaagcagttctttctgtgaaagagagtgaaatggcatgctgaaacatttcaccacatgaaacctgccgaacctgcctcggagtcccagggggaaaacctgggcgcataccctggcgttaaaggggaaagaggagtgcgctttattttctcgcgcattcaatgaaggtggtaccgcggaaagctcttttcgtccttttttacttggacgaaaagggctttttttattggccttctgccagatcatctcggagggaaaaaacgtgaaaaaacaacggattgtcattaaaatcggaagcagttcattaaccaactcgaagggcagcatcgatgaggagaagatcaatgaccatgttcgggcgatagctgctctgaaaaaagaaggccatgaagtcatcttcatttcgtcgggggctgtcgctgcgggatttttacagctcggctatcccgcaaggcctgtgacgctaaagggaaaacaggctgcagcggccgtcggccagagcttgttaatgcaaacatacatcgagcattttgcagaccacgatatcaagcctgcgcagatcttattgacgagaaacgattttgccaaacgggagcgctatcgaaatgcatatgcgaccgttatggaactgattgaacgggggcttgtcccgattattaatgaaaatgattcggtatctgttgaagaattgacgtttggggacaacgacatgctttccgcccttgtaagcggactgattcatgccgacaaactcatcattttaacggatattaacggcctctatgactcgaatccggctgaacatcccgatgcccgccgttttgattacattcccgaaattacggacgaacttttgggctgcgccgcttccgccggatcaaaagtcgggacgggcgggatgaagtcgaagcttttggcggcaaaaaccgctctttcactcggcgtcaatgttttcataggcgccggagagggagatgataagctgatccagattttaaaaggaaacggggacggcacctatatcggccaatccgacctgtcttccgtcaacaatcataggcagtggatcgcctttcattcacctgtttcagggaagattaccgttgatgaaggggctgagctggcgattaccgaaaacggcgggagcctgctgccggccggcgtaacagcgatatccggagattttccgaaaggggcggttgtcgaagtttacggaccgaacggcttggccgggaaaggccaaacgctgtactccgccgcagagcttgaagaggtaaaagggaagcgaagcgatgagttccatcatgaagaagggatagaagtcatccatcgaaatgattgggtaagcattaaagaataaggggatgaaagaatgagcgaagtgattgaaaaagcaaaaaaggccaaagtcgcaaaggaagaactggttcatcagccgactgaaaggaaaaatgaggcgctttcctttatcgccgaggccatccgctttaagcaggatgagatattggcagaaaacgagaaagatatcgtccgcggcaaagaaaaaggcttttcgcctgcgctgcttgaccgccttgccttaacgccggagaggctgaatgatatagcagacgccgtcatgctgctcacaaagcttgaagaccctgtgggggaaacgcttgaaacgatccgcaaagacaacgggcttttcattgaaaatgtcagggtcccgctcggagtcgtcggaatgatctatgaggctcgtccgaatgtaacggtcgacgccgcaaccctttgtttgaaaacgggaaatgccgtcatcctgcggggcagttcgtcagccatcaacagcaataaagcgctcgtccgcgtgatcagggaagcgctcgaacgctcggcgcttccagaggatgccgttcagctcattgaagatacaagcaaagaaacggcaaaacagctgttcactttaaacgacggcttggatgtgctcatcccgagaggagggaaaaacctcatcgatatggtggtgcgggaatccacagtgcctgtgcttgaaacaggcgcggggaactgccacatattcattgatgaatcggctcagccagacatggctgagcaggttgtaatcaatgccaaaacgcagcgcccttctgtctgcaatgcgattgaaacggtgctcatccataaaggctgggcggaagagcatacgaaagcgcttcttcaaaagcttgaagaagcgggcgttgaaatcaggggagacgaagccgtatgcacgatgctgccttctgcggttccagctcgcgagaccgactggggaaccgagtttcttgcgccggttgtcagcatcaaaaccgttgccggaatcgatgaagccatccggcacatcagacagtacggcacacgtcattcggaagcgattctgactgaaaatcaggaaaacgcccggtatttcttaacgtctgttgacgctgcagctgtttaccacaatgcttcaacacgttttacagacggctttgaattcggctacggcgccgaaatcggcatcagcacgcaaaagcttcacgcacgggggccgatgggccttaaagcgctgacttcttctaaatatatcattaaaggaaacggacaaatccggatatgaaagtgtggcatcctgtctcgaatgaagacaggatgttttttgttgtgttatcacttttaattttataaaattaaattgttcacaatataaattaaaggagacgataaatcatgaaaccgctatttacctcgcaagccactgccaatggtggcagagacggacaagtcacctcatctgaccgcgtccttgagctggagctggccatgccgggaacgccaaaagccaaggaaaacgaaaatgccaccaacccggagcagctgtttgccgccggatacgcggcatgctttgacagcgcattgcaattgaccgcccaaaaggcgcgtcttcgaatggagacagaggtgacggcgaacgtcagccttctgaaagatgaagcagatggaggctataagctcagtgtcacactgcaagtaaaaggaaccggcgttgaacagagggagctcgaaaaactcgtccatcaagctcataccgtttgcccgtattcaaaagcaatttccggaaatgttgatgtcaaccttgaagtgatttcttaaaaaagaggcgccttcgatatgaaggcgcctttttgctgtctttacagcacatctgtttttttcgtcaatgaagcaagaagggattcaagcgtttgcttcaagtttttcagttcgccagccgacagatcggtctgggcgatcatgtgctgcggaatgctgcttgctttttcttggagtgcctggccgcctgctgtcagtctgacaattacagaccgttcatcttcaggtgaccgctctcttgttaaaagcccgtgctgctccattctcttcagcatcggcgtcagtgtgccggaatcgagataaaggagcttgcccattgttttgacgcttaattccccgtgttcccataataaaaggagcgcgaggtactgcggatacgtaatattgagttcatcaagcagaggcttgtaaagcttcgtcatttcacgcgagcttgcataaaggagaaagcaaagctgtctgtcaagcctcatatgttcaaattcgtttgccatcgtttcaccaactcttttttatgttcctttttattgtataagattttgcgttcttttcccattgatcggctgaaaacccgaaaaaacaaaaacggatgtttaaaaaactcattttgtgaaatataaagagtagaggaaaaaacgtaaggaggaatcaggatgactgcattgtttacagcaaaagtcacggcaaaaggcggaagatccggacatgtcaaatcagatgacggggttttggaccataacattgtcatgccaaatgaaaaaaaagaaggcgaatcagggacaaatcctgaacagctctttgcggcgggatacgcggcgtgcttcggcggcgcattggaacatgtcgcaaaacaaaaaggcattgacatcgattctgaggtcgaaggccatgtgagcttgctgaaggatgagagtgacggcggttttaaaatcggcgtcaagctgatcgtcacagcaggcggggtagaaaaagaaaaagcgaaagagctggtcgaagccgctcatgacttttgcccttattcaaaagcgacgagaggaaatatcgacgtcaatcttgaagtaaaataaataaacgggaaagatgaaaacgagaaagcaaacaaagcttgtttgctttcttttttagaaaggagcagcatatggcatatcttaaaaaagcgcttgtgttctccgtgctttctctcgctattgtccttgcaggatgcggaaccggagcggcggagaagaacaacggcaatcaatccccggctgatacggccaagcagaaagcacctgatttgaaaacatattcccttgacaaaaatatccggtctgaagaagattttgatttgataggcaagtatgttcatgctgaagatgaccaaatcacgctcgaaataaaggataaggaactgattgttccgaaaagcagccgctttcacagcgaagaagaccatgatgacttaatcgggaagcttgtgaaggtagaggtggatggaaaaacgcaagaagcggaagaagccgagcttatgccgcagtcaaaagccgaccaaaatggcgtatatgaggaggagaaagacggcagccgaaaaatcatcgccacgtttgtcagcgagtcggagcaaaacattacaatcaaaacaaaagcaggggaaaaaacttatcagaaaacagccgattttgagagggatgtcgccgaagcacctgaaaaactgaaagggaaaattgtcaggcttgaaattgaaaaggatggaaaagcagaaagccttgatttggaatcggaagatcaaaagcttgaatggtatgagccgtctgcttcaaaataaaaaaagcttcctgatgaaggaagctttttttaatattccactttttgatcggtcttttcccatgtgagaaaaggttcaagctttgcttgaaggtccattttataaaaaggaattttccgttcgcttttcgttttggtgatttcttcataaataaaagagtcgtcaaaaccggccgatgcggcatccgaatgctgagcggcgaagtaaacttccttcggtctcgcccagtagatggctcccaggcacatggggcacggttcacagcttgtataaagaatgcagtcgttcagctgataatcgccaagtgcttcacaggcgagccgaatagccgttacttccgcgtgcgcggttggatcattgcttgttgtgacattgttttttccctcggcgataatttggccgtctttgactatcacagcgccaaaaggtccgcctgtgccgcttttcacgctctccaccgcaaggtcgatggcgcgctgcaaaaatgcttcatgattcatttctgtatcctccttggttgtcttgccttcttattatagctgatggacccggcaaaataaacacatgtcagaatattcagcatatttgatttcaaaccgcacatcgcatacaatgaatgctagaataatgaacgggggatgatgttttgcttacattgtatattgcaagacacggtcagacggaatggaatattgaaaaaagaatgcaaggctgggaagactccaatttaacggctttgggactggcaaacgcaaatgccctcggcgaacggctgaaagatgttcaattccaagccgcatattccagtccaagcggccgggccgttgattctgcgcgggctatgctgcagaaccgcagcattccctttataacagacgacagattaaaagaaatctcgatcggccgctgggaagggaaaacgtatgatgagatcaaacaaagtgatcctgacttgctggaagcgtattttaatacgcctgaaacatatatgcccgatgaaagcgagagcttttacgattttgaaaggcgggtcagtcaggcgtatcaattcattctccgccgccatcgggaaggcaatgtcctcattgtcagccattccgtgtttatattgatgctcttgaatcttataaaaaagaggccggtcggtgaactatggaactcaagctatgttcatgacacagctcttgcggttgtaacggtttccgaggatggaagcgccgcgattgaaagagaaggagacggtgaacatagagtagaagcaaagaatgccacctggtaggcatgccaaaaagcctgatgttggaatcaggctccgaggctcctagccggaatatattttggcactgaagctgtgaagcgtgtcggcggtaatcgttttgttttttgaaagacaaacggttttgacatctgccgcatctgcttccgctttttttccgaaaagtaagactgtaagagaaagcgggccttttgcgatttgctgatatgccagaatgcaaaggttgtcggcgattgtgcggctgatcatgcggcgcgccgaccacagctgctgctgtccctcttcatcaaactgaatatatgctgcggctcgtttttttgtaatgagtcctgacagaccgttttgtttgatctgcttcatgagagcgagcggttcagacagcggcggtgcggtcagtttatagctgccaggggaacatttggctgcagccaaagaagacatgatcggcaggtagccggccaaatgcccgccgctgtgaaagagcttctccgcaagcatctgatcggtctttttcatgcggatttctgtaaagtgcaggagatgctgcaaatcatcgagcgtgtgtaaaaatcctttgagttcatgttccatttcggattgcgcctgatcgatgccgcatgttcttgctgttttcacgctggagaaaagaacatgaaaatgacggttcaaaaggcgtattaaatcgctgattcgctggtgggaataacgaaattggcgggcgagggcgtgcagatcattgatgttcagccggatcgtcatatcagctcctcggctttcagctgaagccgttcaatttcttcgtccgcctgctctttaatggtcctcagcttgtcatacacgcgcgattccgcccggtcgagatcgtccaaaagcgcgtcatacatttcgcgcgcctgtccgcgccatccgttgatatacgtttggtgtgcttttaaaatagaagaactttcctgcctcagctcatcaatggcggcattcacatcttttacgtatagctgaagagagtgaatgtcttcctgatatatttttcgcttgatttttcgttctaacgctattccatcgtcaatcactacatattttccttcccttccatcatctactacaaatatgttaaaagaaaaggatacggaaggaaatcgtacgaatgaatcaaaagtcttaatgttttttgggcggacataccttgtataacggttcttttggcctaaaaagggctggagccatgaaaagagccgcccgtgtgaacaggcggcgtttgtagtggattttttgtgaaattaaacagtctgagccagtttgcctcttgcttgtttggctgcttcaaccatattcttaagcgctgcgatcgtttcctctggctgtctcgtttttaaaccgcagtcagggtttacccagaagcgatcagccgggcagactttcagcgcgtcttctatgatcgtgagcatttcatcgctggaagggacgcgagggctgtgaatatcatatacgccaagaccaagccctttcaggtaagggtgctgttccagataatcaagaaatccgccgtggcttctgctgtgctcgatcgtaatgacgtctgcgtcaagatcttcgatcgcgtctacgatatcttcaaagttgctgtagcacatatgcgtatggatttgcgtcgtatcttccacagatgaagtggacagtctgaacgcttctgcagcccatttgagatactcgtcccaatcccgttctttaagcggcaggccttctctcaaggcaggttcatcgacctgaatgatttgaattcctgctttttcaagcgcttcaacctctttgcggagggcgcaggcgatttggaaggcgatctcttttctcggcaggtcatagcgggcaaaggaccagtttaaaatggtaacaggccctgtcagcatgcccttgactttcttcgaggtcaaggattgggcgtaaaccgtttcttttaccgtcatcggctctttaaactcgacatctccgtagatgaccggcggccggacgcagcgggaaccgtatgactgaacccaggcgtatttagtaaaggcgaatcctccgagcttttcgccgaaatactcaaccatgtctgtccgttcgaattctccgtgaacgagaacgtcaagtccgagatcttcctgaatatcaatccatttctttgtttcttcctgaataaatgcttcatactgctcgtcggaccattcttttttccgccatttttgccgcgcgctccgcacatccgccgtctgcgggaagctgccgatcgttgttgtcggcaataggggaagtccgagagagtcattttgaatccgcagcctttcttcaaaagctgtcgggcgtttaaagtcttcctcagtcagcttgcctctttcttcggcaaaggccgaatttgtcgctgcaccgtactgtttgagatcttgaaggtgtccgtgcgcttcatcgatttccgcttggatggccgcttttccggaaacaagtccgttcttcagcagtgtaagctccagaagtttctcttttgcgaaagataaaccgttcaagagatcgtcggcaagatgttcgcccgggtgttttgcgacagggacatgaagcaggctgtttgaaggctgaatccagacttcgtcaacacccgctctctggatcagttcaagcgtcaggtcgaggcgctcttcgagattggctttccaaatgttgcgtccgtctaaaatgccggcggcaaggactttgtctttaggaaaaccgtgcgctttcaggtgttcgaagtttttccctttatcatgaacaaaatcaagaccaattcctgcgacaggaaacgatatcagctcttcataagcatcaaccgagtcaaagtaggtttgcagaaggatgttcagttcagagacttcttctgtaatcgtctgatagatttctttgacagcagccgcttcttcaggtgaagccgtcacaagagcaggctcgtcaatttgcacccatttgacgccttcctgctcaagctctttcaaaacctggatgtaaagaggtgtcatttggttataaatatctttaatatcctgttgttcatagccttttgcaagggctacgaaagtgtaaaggccgagtatgacgggcttcgtttctgttcccaatgctgcttttgctctttggtaatcttgaagcggtttgtttctcgtcacgcggtattgtgcacctttttcatattcaggcacaatataatggtagtttgtattaaaccattttgtcatttcactcgatacagcatctttcgtgcctctcgccattgcgaaataagtatctaacggatcgtttatatccttgaatcgatctggaatccagttgaacatcaccgccgtgtcaagaacatggtcgtacattgtaaagtcggaaaccggtatgatatcgatttgctgatcaagctgagtctggagcgctgctaaaaattgttcatccatttctttcaaaaaggtctcgcggtccgtgtttcctttccaataagcctcaagcgattttttccattctctgttcaagccgattcttggaaagcccaagctgctcgtttttacattagtcatgtctggtctcctccttttagtgttcaataaaaaaagacactcacacttcggacaatgagaaggtgaatgcctgaaaacagcatgttgcgaacgagaaataaacgtagcgattgttacgtcaactcgaacacctcctatcgaccgtaggtttatggtgcgtcagaacaggcaggtctcctggctcatgaatcgacggttatttcccccttcccatatagaaacagtgggttttatgaaataacctcctcattcacagtggcgggaccgcgttggattttcaccaaacttcccttttaaaatctaacctcgttagattaccatgttcccggcgatgaaattgtttagtagattatataccgccgcgatcttttagtcaaaataatttttgaattcttgcaattaaaaagattcagctttatacatggccatgaaaaaggccgccgacattgtcggcagcctcctttagactgttaaagggaaagaagttttgcttcgccggctttttccgccagtacctccggcgctgacaaatataagaatccgttgccgatcagcgcttttgagtaatcaagaggaagggtgcggcggattaactgagcatacagttcgggttctgtcagtttccgtttaaacgcctcttcttcagctgacttgatgagagcgagcgcgccgctgacgtgcggtgtagccatcgatgttcccgtcagctttccgtattgatggtcgggcaatgtagagaggatttcttctccaggtgcaacaaggtcaatttctttgttcgcatttgaaaattcggaagactcacgcgtcaatgacacggatccgacggcgatgacttcgttgtatgcagcagggtatgagtactcctctgtacggtcattgccgtcgccttcgtttcctgcggcgcagacgacgagcactccgctcttcacggcgtttgtcaccgcttccttcaactccggaacgtcggcaggaccgccgagcgacattgaaataatgtcggctttttgctcaacggcgtagttgatcccgttgatgatccattcataatccccgctgccgtcttcaccgccgagcaccttgacgattaataggttcgcttcgggtgctacgccggaaatgcctccgttttgatcgtttgcggcaatcgtacccgccacatgggtgccatgtccattataatcatgaaactgatcttcttttccgttgtcatcatcagtgaagtttctgcctccgatgattcggtccgccaaatctggatgggttgcgtcacagcctgtatcaagcactgcgacagtgatatcttttcctttaaaaccttgtgaccacagctccggtgccttaatcgcatcgattccttccggcagttcattcacgtccatcagctttgtgtcagtgacataaggaattaatcgcatttgcatttcaaagccctccctgttatatgctgctttagatgggttacaaggtgcgtgattctattgtaaaacattcactttgtaaaaaaaaggttcatttgtatgaattttatgaaaagttaaaaaatatagataacagaggatataagtcgaataattgcgaacaatgctggaattgtaagcgaaaagacctgtgaaatcggtggaagggcgagagagtcactagatatatgagatttcgcttcaacatattatcccggcaaaaggatatcctattaaaaaaaggagtggatacagggtgaaagaacaagaagacgaaaaaagagacgaattatcaattgagcaggcggagtttgtgccgcatccaaaatatgaaggagaatacgcgcttttactgcacgaaaactatcacctgctgtcaaaggacgaccttgagcaggaaagcgaaaaataagaacggagctcggcacctgggcgaaagagctggtttaattttgacgaaaacgggaatcaacacataatagagagcatgaaagttgcttttcttattgacagttaccctttttttctgtaatctcattgtgtccggtaaatacagctcttcgttaggtgaggctcctgtatggagatacgctgctgcccaaaaatgtccaaagacgccaatgggtcaacagaaatcatcgatctaaggtgatttttaatgcagctgcatgctgcctatgccatacagtgctaaagctctacgatggaaggcgttagggttttattttgtatggcttttaacaccttcatttcgatgaataggtgtttttttattttttgaggaaaatgaactttccgtattaatcaaggaggtggtagtatggattctccccattcgaggcggtttaaacatacgagaaatattttgcagcatcacacattgattgatgaggagatccttatacttcaccccttttgctatggtgatataaggatctcctgaaaagggagggacagattgccatggtaaaaaacatgacatatgatgaactgattttacgcattattattttgctgagagacggaaaacgaaaagagttccaaagccttttagaagaactgcagccttatgatatggcgattctgtttaaggaaatgcccgaaaagcaccgcggccggtatctgtcttttttaacggtagaagacatcaccgatctcatgggcgaacttgacagagaagagcagctagtcgttctgaacaaggtcggcaaagaaaaggcgatccatgtgatgaataaaatggacaacgacgaccttgccgcgctcttcgaggaaatggaccctgagctgaaagaccagcttctatccagcatggaagcggaagaatccgaagcggtccgagttttgatgaactacccgcctgaaacagcgggaagaattatgacaaaccgctatgtctggattccgcagcattacacggtaaaagaagcggtcgtcaagctgaaaagctttgcggaaatcgcggagtccatcaactatttatacgtcatcaacgaacaaaaacagcttgtcggggttatctcataccgtgatctcattttggcagaacccgatgagaaggttcaggaattaatgtttacaagggtcatatcggcggacgctcttcaagatcaggaagaagtcgcaaggctcatcgagcggtacgactttctggcgattcccgttgtagaaaaaaatcatgagcttgtcgggatcgtaacggttgatgacattatcgacatcgtcatccaggaagcgaatgaagactatgaaaaattcgcagcatcaggtaaggcgatcacgtttgatacaaaatcgtatgtcgccgcataccgccgtctgccgtggctgatcttgcttttgttcatcggtttgatctctggcagcatcatgagctattttgaagacacgctgcagcaggttgtcgcattggccttttttatgccgatgatcgcgggaatgacgggtaacactggaacacagtccctcgctgtcgtcatcagagggctgtcaaaagaagagctcaataaaaaaacgattttccgcttgattttccgggagcttagagccgggattattattggcatcgtgtgtgcgatcgtgattacgggaatcgcgatagtatggcaggggaatctgctgctcggatttgtggtagggacttcgctttttgccactctgatcatcggaacgatggcgggaacgatcgtcccgatcatccttcacaagtgcaatgtcgaccctgcgattgcatcgggtccgctgattacaacattaaatgacattttgtcgctgttgatctacttcggtattgcaactgcattcattcattcgctgtaagcagaaaagccctccttatccggagggttttttgcttgccagaattcgtaaaagcctttatattttaggcagagatcagggggggattggtatgagaaggattgcagctgtgctgatttgtttagccgttgcaatgattgttgccggctgtcagaatgaagatgaaggaaaagacaggcggctcgtcgcagttgagaatatgcttgaggcgatattggacgatgatttatcaaagatgaagcgcttgtacgtggagggcgcaaacccttctccggaaacaatcttgaaagacaagcagaaatggggaatttccgggcttcatgctgatgattttcaaatttctgaagcgagcatccatgtgtttcatgccgcttacaagatggaaaataccggtcagcccggaacgattgcgtttcggatacgcaatgatcccgataaaggcgttatgattgatttcattggatacataaaggaagcgaaaaagcaggaaaacaggtgacgaatcatccggaggaaaaatacggtcttaaaggcgtatgtcttgcacctcagttctcaaaacgttaatataccaatgttcaagccctcatccggtcgctcggaagagggcttgttttttgtttaaaattgatttttgaccacattttgaccacgtttaaatgaatttctcataattccatgtactttttaaatgtttcggccgtttttgcttttgcggttttcgtgacatgtgtatagatgttcatagtcgtttgaatttctttgtgacctaaacgggcttgtacttcttttatggatgcgcctgcttcaaaaaggattgatgcgtgagaatgcctaaaaccgtgaattgtgattctgtgaagcttatttttagtgatcatacggtttaaaaggtcgtttggatatgcaagccttagaggacgcatatcgccccgtataaggacatatttagcttctgaggtgattccattagacaagagcatttctttttgttgtgtgcgccattttttaagtatttgggctgtttgatcatcaattgtgataattcgcttggaatgatattttttcgttgtttggatgacttctttaccgttttcaaaaaacattgtttgtttgatgtttattgttttctcttttaaatcaacgtctttccattccaaggcaataagttcccctttgcgcataccagtgaaaataagaacataaaacatgacataatcttgtggggcgagttgagaatgcgctttttcgagaaaggttttgatttcgtccttttcccaaaagttccgtttctcttcttcctgcgataaaaaattctcttcttttttggggatcacaacgaattccattggattttttgtgatgtattccatccttagagcatatttaaatacaaggttagcttgaatttttacattttgaacagaatcaatatcctgagctatcagatttatcaccttttgacaatatgctcttgtgatgtcttttatttttaatttcccgaagtgcggcaggatatgctttttgaaattcgatagctttctatatctggtgctgcgctttatcgttttggaatgaacatcccaccattctttaaagacatcctcaaaagtaatgtcatttcgggcaagagcattattatcgatttccttctggaattccgcagcggctgcgacagcttcttttttggtcttaaagcctcggcgtgttgttgttttcctattgcctgttttgggatcgataccaactcccattttaaaaagccatttatagcccgttttggttttgtactgctgaaatgaagccatattatccccccaatcctatttaaagtttcttttaactaacaataagatgaattttgttaaagtacatgttaaggcgtactttcgcaaatggttcagtgactttaaacatcttagaaatgaggtgagcgtcaaaaaaatgattttgtggaattttcattccatgaagcataaaagtggggatgcaaaagtgatatgagaagtaattggcttgtctctcctgataatctgaccaaaactttggcattgtttttttatctccttcatgtctgtaaaggtggcatagttcatgagcaaagtcgtcccactgctcgaaacgggttttccggctatctaatataatcgtatacacgtcattatacttgaaagaacaacttgggataggcttaaaataaacacttatgcctaacaactcagctatacgctcgaaatcaatttgctctggtgtaatgatactgatgcttctgtacaagttttcaatccaatcttctaaatgactttttgtatacaccaagaagaacgcctcctaagcccatttatcaaattgaggtaattcttatttaaaacaaaggaaacatacgttctgttatttagtgaaaagaaaagcccctcatagggctcttctttatgctgccgtcgtcgttgttttatctcttctagcaagtcccataactcccgagataattagaagaatagcgggaagtaagtagaataagaaaatgcaaatcaggccaccgataccagaaataataagcaaaattccacctaatttagctttttttctaacaatcaccgaagcgataattccaaggattgagaggaagatagcaccccaacctaaaccaataatatcgcttgtgccagatgaattaaaagaggcatcgagtccgccgacaattaacgccaaaaaggcaccaataaaaccgaaaattccgcctattagacctaaaacaaattcagtagttcttttcattttgaattctccttacttaactggcacagtgaatgatactgctttgttattcataaagtcttcagtggttacatcaccaaaattcaacttgatttctttaatgttattgatatcaagctcttttccttctggtacggcaaactccagcaccccgtcctgtttaacgccaccttgaacttctccaccaacttcgccatcagtcaaaaacatattggctgataattgcatgtctccgactactgcattaccttgatcaggatagaagttgaggactttgctagttgtgttttcaatgttgataccgacgttaactttatctttcataattttaacgtctcctaaattaactttcatccctaaagcatcagtcttttgactacttgcatcaacttttttagaaccatcatctttcttctcttctgtctttttgtcttttgaatcctctgttcctgttgatacgtcatcagttgagctgcaggcggctaaggccagagcgaggccgaaagataaaaataaaactaaaaattttttcaaagataaaacccccagttcatattatgtacgacttttataatagtctaattatcatcatttttcaacattatgttacaaaaatttcaatatattcactggtgtatacgggttttcaatgtgtgaatctcgaattcagcatcagctactttgcgattaacatagatgacgccttcttcaagggcgctaatctcatcaagtagaaggttatccgaattgatgttttcggtatgctgaaaatcgattttgtcactcaatgttttgatgtcatctttggtcgcgacatttctttcaaggttggttaggcggctattaattgcctgaatctctttcaagattatttcaaattctttattttccacataaaaaacctcctgattttttataaaagagattataaaaggaacataaatgagaatgtaaaagagaacaacacttagaacccttgtgtatcaagggtttgtcggcatcggaaaaaccgatttataaatgagaatatacatgcaatataaatccaatgtaaatcttattagtaaacaataataaacaatataaacaatagatatatatatataagtggacggtctttttgctttcaagatttttttcttaattttagttggtggattcatcagaatacactttatcttgctcttgttttactattcctcgaattaagtaatcaagagataccttataaaaatcagctatttttataagagttttgtaaccagggtcattgtctccggtttcatatctcgcataggtagagcgatttattccgagttcttctgataatgtttcttgagagagcttaggtttttgtttatttctcaacatttttaacctttctcctaaagtcataaaaataactcctttaaattccactccatgctgtcactccttgcttagtcagatttctttttcccgccttctttcagttgctccgtaatgatttcaagggcagcatctaaaatctcctgtgtaatttctccatcacgagccgcgatgaaggttttagggtcatttagaatcctctttgcttcgtcttcaaagattttatcttgaaccttcggatcagtgcctcgaagtaagtagtcaattgaaacatcgaaataatcagctattttaattagaatttcatattccggttctcttctattttgctcatacatactaattgtgctttctgcaagacctaaatgttcccctaattttttttgagaaagattcggcctcattttcctgagttctctaagtcgatctccgaatttcatattcatcacctttatagataatatcacgattcgtgacgctttacaaaaaaacttcacaatatgtattgactttacgaatcgtgcggtttaatataatagacaagaacaacacgaaacgtaaaggaggagggcaattgaataaaaaggttattggtgcaaagttgatgaaactaagaggcgataaaacccggtctttagttgcaaatgagcttgaaataagcgaaagtacattagctatgtatgaatcgggtcaccgcacacctcgtgatgaaataaaggttcgtatagcaaattattacaaaaaaacagtgcaagaaattttttttgaagatcaacttcacgaattgcacggtaaatcccacacagcgtaggaggctgaccatgaatcaaaagaagctagatcaattaactgatttgttgaatggtatgacccagtctgaatggaatcgcgttaaacaacatgttgatatgttgtacagttctaaagccgccaaagtggagtttgacgaatcagaactattagaaattaacctgaaacgcgaatttaggatctcttgatctgaatgaacattgggtgaatacgataatcggcatttcgataatggatatcaacataatcctgctgatacatcgtgtgttcatctttagtattaggactccaaatactcgcgccttcgtcccaccatgtgagttgagaagagtcatatctaccaattttacagttaggatcactggtcaagtcaacccattcaccacaaagacaagcataaatttgagtagccatattgatcaccacctttctcagaagattttaccacatgagaaaggttggcagattacaaaccacagtataggaggcgaacattttggctaatctcggtatctcacttgataacttaccgaacgaaacggttttcgagattgttaaagcgctttgcgaaaaagcttatcagcaaggcgtggaggacggtgcaaaaaaatatacgtatcctccaatattaaaaaacactcatttgcaagagattttccaaatcaaatcggcagcggtgacaagactaaccggaatcgagtctttcccgaaattgaaaaccattcaagctagatatccgcgtgatctcgtttttgaatggatcaaacaaaactcaacttgggtcgaagaaaacacaaactattttcagaaaggtgtgtcttaaatcaatccctacaatttaatgataatcctcggccgcaacatgtgtcaggatatcatattaccaaaggagcagcctgagaatgttttaagcgccattgaccttattacaaagcttatggatggtcggaaagtaaaagaatttttcacactgttccccccaatcaaatactacactgacgacggaacatggaattatgattccacattagaaaaaatgaatagcttaggcgagcgattcacaagtgatagcttccttgaattactggtgtcacattgctatgaaaatcgttttatcaaacgtttaggagtaggttttatgtctgccactagcgagatttataaaagacaacacggaatgagcgtaatggaaaaatactgtattgaaaacggcatccgtgtttatgaaaagaaaggtaatgaaatcaaacctaaattttatcgagttaaataggaggatcgctaaatgaatcaattaatgaactctgaaatcaaaatgacaagtttagatttagcagaattaacaggcaaagaacacaaacacattatgcgcgacattcgagaagaaattaataaattaggaaaagaattaggtgagtccatttttggactgtcctcttataaaactctacagaacaaagaattaccttgttacacattcggcagaaaaggtgccatgcaattagctttaaaatacgatgccacaacaagatttaaagttattgaaagaattgaacaattagaaaaacaacaacagccaaaaacgccgttggaagttttacaaggaaccatcaaccaactggtcgagcaagacaaacgaatgaatcaactagaaggtcaagtgaacaatatttcgaacatcgtatccatgaacaatgtcggctggcgtgaaaaggtaaatgtcatcttaaaaagaatcgcgaaaaactggaccggtgtcgagccataccgaagcgtcatgaatcttagttatgagcgtttggaacagcgggcaggctgtaaactcgacatccgtttgaacaatcgaaaagaacgcgcgctatcgcaaggcatgtccaaaacttatgtaaagaaaatcaacaaattagacgtgatcgcagaggaaaagcgcttagttgaaatctacatccaaatagtcaaggaaatggctattcaattcaaagtaaacatcaatgactttaaacttgatgaagttgtttaaccttacgacttaatcatacatccataatctgtacagaaaaatagagaacataggacaaaggagagttcaagaatgccggaaatagtgtctaaatcactggcgcatctacttgaaacgaagaacatgacaaacgggcaactcgcccttgatctaaacgtttcggagtcgatggtcagcaaaatgaaaaacggaacaagaaaaatgccgtgggatgtggcggaaacgtcactaaagaaattcgatcaaccatttttcgcaatgggaatcatgaacaaattcagcgatggttgctcgccgcccgtcttcactggtgaatcagtcgagcaacatcgactggcttttgaagagatcatggtcacacaggcgacagaagccatccagacacttgcagatgtgagttttgttaagaatccgaagctgatctctttggaagaaagggagcgcattaaagtggtcataaaggaacttctggacgtggaggcatgggctaaaaacttagcggccttattggcgaaggaatacaacatttcactcaaagagtgctacaaaaaagcaactatcacatggaaggcgaaagggtggctcgaatgaatttaaaccattttttgaagtctgacagggagaaggcggaacgactttacaagtcattgcaatttctcgtttcagaactattggcggatgccgtcaaagagggtgattttgatgggtgtatagaacttgcgggtagcatagtcgatcacagcagagacttaaagaaaatgcagcaccctgaaaaagtagtggaactacacgaaatcgcgtcagagttcgccaaaagagggctgaacgttgtgcctgttaaaccgccagcaagagggattcactaatgctccattaccttcacaggccggcaacagcgtcagaggttagggaatggtgcgcgagaatccgaaactatcctgaattgcatctgtcgtgggatcaatacgtcaaaaggagacatcaaaaatgaatcacagaaaatatgaattggcatcttcctttttacgaaatgccaagaacatgaattactcagaacaggatattaaaggagcgattcgactgctgtatgaagaggtttcttcggaagaaaaggtgatgttaagtctatacaaatacctaatggcacggaaaggagcggatggaaatgaacattgaacacccaattatcacagaaatcaaccgttacggctatccaaaggattatttgcggtatgaagaagaggaagaaaacgaagacgacgaggcataaaaaaaagaacctttaaaaaaggttcaacaagatcaaataccaagtgttgaattaattggctggtggaaaggcgtagataaactttccaaatacaaattatatcagtcttctgcctgaaaaacaatatagaaggtgaaagaatggctaaaatccttacatctaccgaaggaatggaacgacaagcatggttagaagcgcgacggcgaggcattggtgggagcgatgtttctgccatactcggacttaacaagtggaaaagtcccattcaattatacatggataagatcggcgaaagtcctttagaggataacgaaagcgaggcggcaaggctcgggaatctattggaggacatcgtagcccaggaattcagccggaggaaagggctgaaagtgaagaagcggaacgccattttacaacatgagaaatacccgtattttttggcgaatgttgaccgcctgattgtcggccggaaggaaggtcttgagtgcaagacggcgacagtttacaagcgtgatgaatggacggcagacagcgtgcccgatgcgtattttgttcaatgccaatggtacatgagtgtaaccgggttcaaaaaatggcatttggccgcccttatattaggggatgttgtgaacccttggcgattccatgagatcgagcgcgacgatgaattgatacggatcatggaagaaaaggcggcttatttctggaatgaacacgtttctaaaagagtgccgccgccgtttgacgggtcgcaatcatcaaaggatttactggcggccatgtacccggagcatgtcgaggattcggttgatctgccgggatactttgatagcaagattgaagaatacgagcggacgaaagagaagatcaacgaactgacagagaagaagcaggccattgaaaacgagatcaaagggattctcggtgaaaggaaacacggttttgttgctgacaaaaaagtcacttggtcgaggttcccggttgaacgctttgacaaagaaaaattcaagagagaacaccctgacatctacaggcagtatgtgaaagagggtaacggttcaagattttcaatccggtaatgaaaggggaaaacggtatgacacaagcagagaaattgaaaaacgacatagcgaagcaggagcaaagaaacgaggttgctcaagatgataaaccaaaaacaattcttgatgcaatgatgaaacataaagaatcgtttgaaatggctttgcctaaacacttggacgccgacaggctgattcgtttagcggttacagagttcaggaaaaacccaatgcttaaagaatgcacgcctgagtctttgcttggagccgttatgcaagcggcgcaagttggattagaaccggacgcgctggggtcggcctatcttgtgccttattacaacaagaacaagaacgttaaagaagttcaattgcagatcggatataagggcttgatcgaattagtcagaagatcaggccaagtaacaagcattgtagcaaatgaagtctatgaaaatgatgaatttgatttcgaatacgggataaacgaaaagttataccataagccgacgatggatgcagaccgcgggaaactcaaatgtttctatgcttatgcccgatttaaagacggcggccatgcttttacagtcatgagcgttgaacaaattaatcagattcgcgataaattcagcaagtcgcaaaagaacggaaagcattttggcccttgggctgatcattatgagtcaatggcaaaaaagacggttatcaagcagcttgtcaaatacatgccgataagcgtcgaaattcagaatcaaataacgagggacgaaacggtgcattcaagcttcaaagaagaaccaaaaccgatttacgcgtttgaagaatcgccagacattatcgacgcacccatagaaaattaagcgaagggcggcgcatcatgatgaacaaaattgtctgcaaatgggcgtttgaattgcgcaaagtcgaagttgacaagtgaaacgggtttacgggtatgagcactctgtgaaaggaagtaggtgagcggcgtggatatgcaaggtatggggtgtgttgtcctcccccgtcttccctttaaagatgaacgtgacgagataatttacgatcatttgtttaaaagggcggaatacaggcaaggcaaagagcttgatataggtcaaacaattatcaagatcacacaccttgccgagaggttcaactggtctgctgttcaaataaagtactctctggatcgaatggctaggcagggatatttaaagatcgacaggctacctcaaaaacgcggcttcattgtaaccatcgttaactatgcagagtatacgcgtttcgaaaattataaaaagaaaaaagcaccggtatcagatccaacggaaggaaaggaggaagacaagaatatgaagacaaacccatttcagttttttgaggacgaagggttcggcttattatcctcatttttggcggatatgcttaaaggtctgatagacgattacggtgaggaaaaggtgcttgatgccatgaaagaggctgttaagcgaaatgcccgcaatatggcttatgtccagcgcctcctacaatcaaatgaacttaaaagcaaggagtggggaaatgactatcaagcaaaaaaagcaagaaaacaaagcgatcagtataaacacggcatttcaaaaggtgatgcaaagccttcgggaaaaatcagcccacttttcggccccggacgcatccggagaaaaggctgagtacgaatgtgaaacctgtaaagatcatggcattgtgttttatcgggttcataaagatacgaaatggaattatgacgaacggttaaagcaacttgtgccagaggaaatggtgccggaagatgattttctttctggaaaggtttgtccgccggaaaaggcaggggaatggaaggatacctattccaaacaatgcgactgtgtacggcgaaagagaatagcccgacttatggcagccagtggcattacagaagaatttgaaaagcttatattcggcaattttaaaacggaggggaaaccaaaattgataaaggatgcatatgattgcgctgttgaatacttcaaggattttgaaaaaatcaggggggatcgttcaaacagtatcgctttgcttggtcaacccggcagcggcaaaactcatctgcttacagccattatgaataatctcatcaagaagaagtccgtccactgtttgtatttcccgtatgtagaaggcatgggggatctgaaaaaggactttgatcaattggaaaccaagcttgatgcgatgcggaaagtcgaagtgcttttcattgatgacttgttcaagcctgtatatgtaaccactagtgaagggcgtatcaagaaaccacgggcgaccgaatggcagattgaacaaattcagtccatcgtaaattatcgttacctgaatcatctgccgttacttgtttcttcagaacttacaacagatgagttgctggacattgatgaagctctcggctcccgaatccatcaaatgtgccgggattatacggtaatcatcaagggggacatgatgttgctgaatcatagattgtcagatttaagtgattagcaaacatttcattaacaaaaacaccgaaacctaaaggctccgatgctttatgaactgtgggtaattcaattatagcacactgggggcggtttgagtgaaactgaaacctattactatcaatgatgatcttagttttactggaacgatggagaaaggcaaagtccgcgttattgtggtggatgggaacaacgggacggcgcacgcaatggacgccccggaacacggaaaatcaattattcaaacggtaaaaggcacatttaaacgtgttgattttgaaataggtctaaaagtcgagaaagacgattgaaggaggattcacaatgtgcagcttatgcaatggcaaaaaggttatcaggcaggaatccggcagcatggtcgcattccatgcctgcccgaattgcaagattgagaaacaggatttaactgataccatccagcggcttgatgcgatcattcaaaaacggcagcaggagaagagcgcataatgtttaggagattcgcgccgggtgactgggttgccttcaaaaagaacccgcaaaaagtgtgcgggtacgtgcttcattcagaaggcagcaatattttggttctgaaaatgaacggattcacagcaacatggcacgaagtaaccttaacgaaactatcaccaagaaacgcaccaaaatacacgcaggcggacgtcagagcactaatagacctcgccctagacgtaaaggataggcaatggtttgaagagcttacaagcgaattaaaacgcattcaggaggtagaggtatgacaattaatttaaaagtgatacaggagaagccgaaagggctttctgtggatgatatacaggatggattcttccttgttaaaggtgacaatgcgtgggtgatcagaagccacgctagagacttctctttaatcgatttaggaacttttgaaatatatgccaaaaacggatttagaggatttcattaatagctggattgatataaaaattttaagcccgaaacaagtcaatttaaatatcggtttccagtggagagattaaggagggagcggcaaatgaaaaatatcaaaagactcatcgtccggctgatcgggcggaaaaagaaggaacagaaaaaagtgtttgaatggtgggatttgatatgagaatcatcaaaaaagaagtcaattcacagtacggcggactattcaaaaaggtatttattcgaaaaatggttaaggaaaacgaccgcgaattgatccaagaaacaagcacgacctacatcgtgggtatcccggttagatcggtgacggaaacgcgaccgccgagtttgaaagacgcttttaagcaggcgtggggatcggcgaaatgaaagaagtcaaagcgctgctgtcgatcatactacaggccggatacagggaaaaacagatcaaacaatggttacaagatgacgggaggtaaggggaatggacattatcaagattcgttacacatttaggcataaaggtagcggcaacattgaaatgaaaaggtacaacatcgggcaattggaagaaagagcagccgccaagctgtctccagtcttctcagatgaatatgaattgatcagccgggatttatacaccggattgaaggataatactgaccgcgagatttacgagggggacattattcattgcgtgcactggttctttgatggaaacgaaatagaagaacactttactgcttcagttggatttcgggatggatcatttactttggagaatattaatagccgttattattcagattatacatttgaagaaaacgggaaaggtatttgctggattggggatataaattactgtgatgaagattatgaaatcatcggcaatatctatcaaaatcctgatttattattggaggcgacggaatgagagagcgaaaatatcgggcatttgtaaagcagtgtaacaaaatgatttattccgaaaattcttacccgaaagggaacagcgattatagattcgtagcgtcagaagatcataaaaaaggtttaggggttgaatatttcacaaatcggacggagtatgtcaatcaatacggcggggtggtcctcttgcctgattggagagttttcacagatgaagaggcaccggtcacagaatacaccggattgaaggacgaaaccggccgggagatttgggagggtgatatccggaaagactctctcggtagaattttcaaggttgttttttacgacgatctagccgcattttatggggaacatcccggtgggttaattcagtgtcttgccgattgtgggccggattcggaatatctcggaacagtctatgaaaatcccggtctattggaggcggcggaatgatcacccttaacataccagtcgaaccaatgggagccgtccggatgaccgggcgcgggaaattcgtgaataaaaacgcacagcggtatttagcttataaggatttcataaagctgcacgcacagaagcagatgaaaggacagcagctttataccggtcctactgtagtaaaggtgcttttctccatgccgattccaaaaagttggtcaaagaaaaagcaacaggaggccatttcaacggtacacatcaaaaagccggacatcgacaatttagtaaaaggtgttttcgacgctctgaataaaacagcgtggcatgatgataaccaagttttcatggtcataggagccaaagtttacggaaaagaacccgggatcgaggttcaaataatggggctggcagaatgggaaaatttaagcgcctgatcatccgttataaaaaccaatacgggcggactgtggggcatgacaccctttggaagggtttagatagcctcatagagttaaaacgtcgctacggctttttaaacgaagatttggagcatgtcgagattgacggcgaggaatgcgatttaaaaaaggtaagggctgcgcttgagaagcgcgggtaaaaaatttcggctgagaatgtcgattcctgtcgaaaatagacgaaaggtggaagggaaatggctgttaaactacaccgccatatctggtgggataagcatggaattgttgaattttcgagcacggtcggcaaggaacgagtaataactaccaacggaaaattagaaatcgaaatacttttaaccagagattccaacagatcgagagtggtgcggcgcattatggatgcggtggaagaaatcatagaaaaggagaatgcaaaagatgctgaatagaacggtacttgtcggaagattaacaagagatcctgacctaagatatgtcggggatggtaaaccggtagtcagctttaccattgcagtcaatcggacatttaaaaaccagaacggagaaacggaagcggactttatcaactgtgtcgcatggttgcagcacgctcaggaagaggttattgatttagcggtataccttgaggcggctatacaaaaattcgatgaattagagaagaaatttgatgaattagagagggagaaggcatgatcatagcattcaaaatcatactactgctcataattatcttatcgtttttgggagcggtcggagagagggaaaacaaaaatctacgggataacatgacagctatctgcataacatcaataatcggttctctcgtcgctttcatcatgatttaagggggaaagtagggtgaagggtttaaacgtgatcaagggctttttaatcgctcttggcggggtatttatgatcgggtatcagtgggtataccggccgacactcggagagtccgccgtaataattttgttcacttcgggattggtgtttgcgatgttggttagagactggttttatggcttgattttggttctgatcagcgctttcgccgtcgtcctgtatggatatatgtatactcgaaaacttcaaacaactgcttgtaatgctattagtctctttgccaatggtatcagcaatattcttgcacgtggcggagcatgatgcagagaaataaacatcggcgcgagccgggaaggggaataactcatgaaaaaactattcaaaaccattgttacactgtcactcttgatttctggaacgcttttattctcacaatctgcggcggctgtttggtcgccgtggcaaaaggaagcattcggccatacagcgaggattttcaccgacgacacgaattactattcaggagcaaaaacagttgactggcgggcggaaaagaagggttctggaacgctttactacacggctggcgtctataaaaaacgttcgggcggcggcttaactgatacaaaccttgtgcagcggggatactttaagcactcaacaccgttaaagtctttcagtgtcaacgagattcgcaagcgcaccgggaaaggatcatatgtcattcagatcgattgctacacagacgcgaagaaaaacaactatgtcgggacgtttgaatccaagacgttttatatcaagtaagggggctgcagccctcttgaaagggaaaatgtaaaatgcaatttatcgaattgacgttaatcggccaagccgggaaggagaaacgcgggcagatgaataaagaacagtttacatttgaaatggaattgaagggcggacttaatggcgagaaatcggacgagaaaaaacgtttggaaaaaataaaagagtcttactcaaattgcgtcgatatggctttgtctgaaggtgaaacgttgccctattacgatatagaagtagctgatatgaattttcttatcgaacaggctgaaaaggggctgaccgtgacgaggagcgccgggaatttacgcgctttacatgaatgtgtaacagccatgcaaaaaatcaaattcatatgccgaagggcgaaaaaaacctacatcgaggaaaaggacatcgatgacattttgaaaatacttgaagggaaagtatgagaggccgtagccgggaaggagaatgaaggacaaaaaaccgccatgcggcggccgtcaggaaacatttaaacttgattttatggtatcatagaagtataacgaaaacagaaaacaaaataaacgtccaagacggaaagcctgcggacactgaacttacagcatttacgctgtttgtttggtgtccgttttttatttttgcaacttttcagtcacaccccgcgatcactagggtgtcaaaaggaggctgaaaacatgaaaaagaccaaaaagaacacgcggaaaaagcaggaaaagctcactgaacgggatttaaggaacctgatggatacaaacaggcctatctataaaagagccaaaggcggggcattcagacaacgataagggggcgtatgaatgaacaagcaagaaacaatctggtgtattaatttaacgatttccttggtggcattttggtttttggtatttgtattaaagattaacattagaaccattcatgaacgggtgtggatctatttccttattacatttgtaccgatcatatcaaaagcgatttaccgaaagctctttagccaaaatagaaagggcgggaattgatcatgtataaaaaagagattgaaaaactgatcagtagttatcactggatggcaaaagaggttcagagattgcaaagggtgctttacggttctgacatccctatgcgaagctggggtgtcgctcaatatgggttagaagctgccatgccaaagggaagccccggcaagagtcaggccgagctgagggatatggacataagagaggaacgtctatacaagcgtctagaatacttcgaagaacgtgtatacgcgattgaggcggcagcaagaacgatcgaaggggaacagcataaagtgatttatgattgcatgatggaagggatgagctatcgagccattggccttcatcttggcatatcgcgggaaaccgtcaggcggatgaaagacgagatcatcaaccagttgtgccaaaattgccgaattgtgcagttgttgaatccgaaaaaatccgtcgtgtaaaatggaaggcaggacggggaggtaggttccccggtttaccacttcacaaaattaagagagaaagagcggcactgcgaatgcgcggggtcgctttttatgtttgttgtgatatgcgtccggtgagacttgggagaacaatcggataccgccaagcacgggcgcggctcagagcaaataaaggagaacaaagtcatgaaactgctacgaataaaaataagcgcttggttggctgtgcacctttggggcattagtccttcaagatactttgtcgatgacgaattcagagaagcagttgatcactttcagaaaagggggttttgaacatggggaaggttacaggggtgtatccggggcctaacaacgggctgatcagatggatcgaggaaaactttggagagatcgacggatacgcggcaacgttcaagatgaaagacggtacaacgatgacgatttacgacgcattaacgccagtcgaagccgtcgggatggccgagatcggtaaaaacgtgattcaggaagcaattaacgaggatgaatttgtctcgagaccataaaggcggtaatgattatgattctacgacaatacttacaggacaaacgagaagaagaacgcgagaaggcgagagaatcggcccgcaaaactcacaagtgtcatgggtgcgtgtgggggacatgggccggaaataaatacgtctgtccgtttgggcggtgcgtgaaaccgaaaccatcgcacgacgaaaattagtttcgaaacaacacaatccagaagggggcggcgggtgaatgtagatggctgaaaaacacatccaagcacaaaaagattacgtcaaaggaatgaaatacaaagaccttgccgaaaaatacggggtgtcagtgaacaccatcaaatcgtggaaacagcggcacggttggaaaagaaaaaaaggtgcacccattgaaaaaggtgtgcacacaaaaaaaccgggtgcgccaaagggaaatataaacgcactcgggaacaacggcggggcaccaaagggaaaccaaaacgcgaagattcacggattttattctaagtttctcccggaggaaacgcttgaaatcatggaagagattcaggaacgttcgcctgctgatatgatatgggatcaaattcaaatacaatacgcggccattatacgggcgcaacgcatcatgtttgtgcaggataaggacgatatggcaaaagagctgaagaaaacgaaagaatcggatttatcttccgaagaggagtttgaaatacaattcgcatgggatcgtcacgcaaccttcctgaacgctcaatcacgggctatgggcgagcttaggagcttgataaagcaatttgacgcactggcccatgaagaggacgagagacggcttaaacttgatcaaatgcgcttgaacatcgataagacgaaagccgaaatcgagcgactgaacgacgatgaaaacgactcaacatttgaaattatcatcaaggataaaggtgaaagatgatggaaaaagaagtgaatccccgttttagggactttctttttgattggtcgcagaagttttattttctcgttggcggttacggatcatccaagagctatcatgttgctctcaagctgattttgaagatgctacaggaaaagcggacagccttagtcgtccgtgaggtctacgacacccacagggattcgaccttttccctgctcgaagaaatcattaccgacttagggcttgaccataaaatccggtgtgtcagctcaccaatgcaaatacgattcccaaacggcagcaagatcatttttaaagggatggacaagccggcaaaactaaaatcgatcaataatgtatcaattgtatgggttgaagagtgttcagaagtgaaatatgacggatttaaggagctgctggggcgcttgcgacatccgactttaaaattacacatgattctgtccacgaaccctgtcagcaaagggaactggtcgtataagcacttttttaaggatgaagccaatcagttttttgtccttgacgacgacgagctttacaaaaagaaaacgatcataaaaaacaacacctattatcatcactcaacggctgatgataatttatttttgcctgaaagctacatcgagcagctggaagacctaaaaagccacgatccagacctttaccgcattgcccggaaaggtcgttttggcgttaacggaaagcttgtcctgccgcagttcgaagtgatggagcacgaaaaggttatgaatgcgatcagagcaatcgacaggccgatcttaaaaaacggtatggactttggtttcgttgattcatataacgccttggttcgcatggcgatcgaccacaatcaaaagattctatatatctactggcagtattacaaaaacgatacgacagacgacaaaacagcggaagacctgaaagaccttaaacgcgttctgatcaaagctgatagcgcggagcctaagacaattcgattcttccggcaacaggggttccgtatgaaggccgcaaagaaattccaaggctcacgactgcaatacaccaagaaggtgaagcggttcaaaaagattatctgctccgatcaatgccctgacgttattagggagctgaaagatttgactttcgcagtggataaagacggaaacgtcattgaagacgaattcaacatcgatccacatactttctcggccatctggtacggcttagatgattatgaggtatcaagtctcaaggggcacggggtaacaaggaggtttagagattgataaaattcttagatcaaattagaacaaagggcatatcgggggaattgatttctcagattatcgaagagcataaagatgaccatgaccgcatgaagaaattgtacgaccgatacaaggcggaacctgccggcgtgccaattcttcaacgtaaagccgtggattatgaagactttgagacaggtcgcatcaagcggattgatcataaggtaaacaacaagctgaataactctttcgactcggaaattgtagataccaaagtcggctatcttttcggccatccaatcgcttatgaggtggatgacaaatcaaagtccgggaatgtttcagcgatcaaacagttgattgaggatttcactttgagaaatcacgttcctgacgaggacagcgaatgggggaagatggctgcaatttgcggttatggcgcccgccttgcttacgtggataaggaagggaaagagcgcattaaaaacatcgacccttgggaagtcgttttcataaccgatggcaatattcacgaaccggaatacgcattgcgctattacgagacttgcgacggacagctaaaagccgaattttacgattctaccgatattcactattacagcacgaaggacagcgcagtgtttgaagaagaccgcatacaaccgcacatgttcaaaggctgccctctattcggattagccaacaataaagagttaaaaggcgatgctgaaaaggtattgtctcttattgatgcctatgaccggacaatctcggacgccagcaacgagatcgagcagtaccggcttgcgtatcttgtcttgaaaggactaggggcagatgatgaaaccttagaaaagttgaaagaaaccggggttctacagctgctagaagagaatgacgaggtcagttatctcacgaaggacattaacgacgccattatcgagaaccatttaaacaggctggaaaaagatattctccgtttcgctaaatctgtgaattttacagacgaatcattcgccggcaatgtttcaggcgtggctatgaaatttaaactgatggcacttgagaataaaagtatcacgatggaacgaaaaatgacagcagccctccgatatcaatttaaaatccttttttctgcatgggggacaaaagggaaagcgagcgaagacgactatttaaaggtttggttcggcttcacgcgtaatcttccggtaaaccttcttgaagaatctcaaatcgccgggggtcttaaaggtctggtcagtgaagaaacgcggctttcattgctgtcatttgtggatgatgttcagtatgagattgacaagatgaaagaagaacaggacgaatatacgcggcatttaagcccgttagatgacagcgaagataaggcgccgcaggacggtgagccagacgatgaagaatcagaatgaaatagataaataccttgacgaaatgatcgaaaaggctgaaagaaagatcgatcaactgtttgccagacgtatgaaagagatcaaaaaccaaatcgccgcaatgtatgacaagtacagcaaagacggcgagctttcatacaccgaattgaataagtacaaccgtttcagaaaagaaatggagcgcatggcggccgagattcacaaggattatcgagagcttttgaaaatgatcaatgacttaatggaaaaacaatacgttgagaattacctgagatcagcctatctttacgagtttgaagcacaagtaaagatgggctttactattcctacggtcgcagttattgccgcggcgttggcgaacccaatcgaaaagttacaactgccgaatgttcttgaagcggctcgtgatgaaatcataaacaatatcagtattgaagttgctcaaagccttctggctggtgaaagctacaccaaaatggcaaagcgtattgaaaatcgcgtcaattttagccgtgcaaaagcccgcagagtggctcggacggaagctcatagggttcaaatagcagggaggcttaaaagcgctgagaaggccgcagaaaaggctgatatgaaaaaattgtgggacagtacgctggatacaagaacaagaattgcgcaccggaagctcgacgggaaggtcgtgcccttcaacggcgtgtttaaatcgatatacggaggcgtcgggaaggctcccggacacatgcacaacccgaaagacgacataaattgccgttgttcgatcattttccttgtgaacggccagaaaccagagagaaggatatccagaatcaacggcaaaaacgtcgtcattccatacatgacctatgaagagtggaaaaaacaacttgaaaaggcggggtgaacatggaatatttacaatttttcgttccctttatttcgttttttatttttatctattgtctgggttttttcaagggaatagaacacgctgaaaaaaaggaagaagaaagagagcaattccgacaatttttaaagggggattaatcctgtgccaaaactaactgttatattgggcggagaagtcatttgcagacataacggcatggttcatgttgctgttacgtttgatgggtcattatcgagcatttttgttgtgagtgaagcggattatgaaagggtgttcccgaatggctaaattagagattaaattgacggaagaagcgcggaaaaggaaagaagagaatcccctgtcaagtgtcgggctgaaattttccgattatgatgttttaatagacggccacgagccaacgcatttgaccgacttaaagctttctatgagagtaggagagcttaatgaagctacagtcacatttgtagttgacgaaattgacgttgacgccgattttttagcggctctcgaagcgaagatcgaagccgacaaggtagcggcggcatcacccgaagaaacgacagaagacacgacagacgcagatcattcggacgaggggagcgaataacatgccgaagtacattaaaaagcctgttgaggttgaggcgtttatatttgccgtagatgatacacctgagtggtttttagaaaaaacaaaaaatagttattgtgaatttcactatgactcgaatggcgtcagatgcatcctcccaacgtcggaaggttcagtaatgattatccgtgcaggagattttgtcataaagggcgtcgagggcgaaatctacccgtgtgaatcgagtatttttgaaaagacatatgatcgtgtagaccccttgaaaaaagcccgcaaaatggcggagctgtccggaatgcttacgaaaaacggctttgatttcaccgagaaaaaaagcgaaattgacaataacgaaatggcgcgcggtaaattagaatcgttaaaacgtgcctttgaagaggggaggataaagtcgtcatcggttacgaatttcccgatcaaagacaactacggacaatggcaatacggggaagcagaatataccttccgtgttgagccttcggcaatagctaaagaatttgtcagggaagtgctgtctgaaaagcctgtgacgatgtcccttgacggcgaggaagtagggaaagcgtgtttcaaagaagtttcaaaggtaatgaagcggcagaatatgaggtcgaaataatgtccgaaatactttgtatgttgggctttcacaattttagaaactacaagcacctttttcacccattcagagcagagggaacacgctcacgatgcggaaagaaagatgtttatttgtaaattagaaccacagtcgccatgtagcggctttttattttgtcctgagcatgacgttaaaaggcttttttattatgcactcataacaggcgcgcactgtagagggcaaaggaggaaatcaaaatgaatttagaagaagtcaaacagtttcttgatgcaaataaagagaacgaagatgtaaaggcttatctggaagaactttctgccgtgtcagccgacaaggtgaaaggttttctggaaacagatgaggggcaaaagttgatccgtcctaaattggatcagcacttcaccaaaagccttgaaacatggaaagccaacaatcttgatgaacttgttgatgccaaggtgaaagagctgtatccggaagaaaccgaggaacaaaagcgcatccggaaactcgagcaagagcttgagaagcagcaaagagaagccaagcgcgaaaagctcatgaacacggcgatttcttacgcatctgaaaaggggctgccaactgatcttgttgcttacttccttggggatgacgaagaaacgacaaaaagcaatcttggcacccttgaagaaaaattcagtgcttttgttaacaaagcagtcgaagacaaattcagagcaaacggcagggatgtggagccgggcggcggcggttctggctccggtgaaaatttaaacattggttcgcttgcagaacaagcaagcatccgaaaataaggaggaaaaaagattatgagttttgatccgaataacgtattgatgcaagatgcagtcaaaggaaaagtaccatctgatcaaggaacattagtattaaaagactttatgacacaatcagcagtcacaaaactagcaaaatatgaagaaatggataaaaccgagaagacattcacttatcttgcgtctggccccggggcttactgggttggcgaaggtgagagaatcaaaacttctaaggctacatggttagaagcgaaaatgacctctaaaaaactcggggtcattgtcccagtcacaaaagagtttttgaattactccgtgaaagacttctttactcaaatgcggccagcaatcgcggaagcattcgctattaaatttgaccaagcagcactttttggcattgattcaccattcggaaaaggcacttctgtattcgaaagagcagaagcagcaggaaacactgttgttttgaactctctaggcaacctttacgatgagttaaacgcagtcatggcactcactgaggacaatgacaaagacgtgaacggctttactactacacgtcgtttcaaacaaaaactacgcggcactaaggacggcaacgggctgcctatttttaatgatgcaagaggcggcgcgacatcagaggcattaggtttgccgattggctatgtcgattctaagtcttgggattatacaaaagcacatctattggctgccgattgggattttacccgttacggaattcctcaaggtatggaataccatatttcgcaagatgcaactttaacaacggttgtcgatgaaaataacaatcctatcaacttgtttgagcgtgatatgtttgctctccgagtgactcaacaagtcggatttatgacactttctgacgaagcattcgcagctcttactccggaagcagaagcgggggcgtaatagatgagtttcacatcgaaaaactacagaacaagcggcggcgataagtgggttatcggtggagaactagaagtcaaagcgggcgcgaaggtatccggcatgcccgcaggcaccccggggccggacagtatcacttccgaaatgatcggagaaggacaggtcagaaaccgaaatatcggtgatgggtctgtaaatagccgtaatatcgggaatggcagcgttcaaaataatcacattcaagctaaggcggtcacgctggacaaaatgggcgatgatgtaacggccaaatttacagatatcgaaaaccgcctcaaagcactggaaggctcaggaggttcttaatttgaaaatcacagacggttctatagttttgagcgtgtcagataaggcgtatagggttgtctatgcgccttttggctttgaaagggtagaagagtccgaagaagttgctcaggagactgacgcgccatttgatctttttgaaatgagcaaagagcaactgaccaaagtaaacaaaagcgacatcataacctttttggagcaacaggaatttgaatttgatccaaacgccaaaaaggacgaactgatcaaagtcgttttgggtgaagaatagggggacatctgaaatggacgtccagactatcaaaacaatgcttgggataactacagataggcacgatgcctatttgaaagaggttatccctctttttattgatttcgcaaaggattactgcaataacaggtttcttgttgacggcgcggaaaatctgccggcgggcgtaaagctgtttgtcgcaaaggcgatcgagtttaatatggcgccatcgaatttgagtgcccgcagcatgggggatgtttcttactcctatgaaacggagctgccggaatccgtcttgaggcatctgaaaccttacagaaggctgagggttgtctgatgatgtacgaagagtttccgcacacaatcacattccaaaagttcgaacagatacccaatggcggaggcggctttaaaaaagattgggtggacgcgattaccgactgcgaggcatttgtcgattcgctgaccggaaaagaatactatcaagcccagcagcttgagaacccggtcgaatacaacgtctattttccctatcgggaagacgttaaaaacgacatgcggatcatttggaaagaccgaaatgacagggttttggtcattcagtccccgcctatcgatcaaggcggccaaggtgaaatcttgtgctttaaatgccgttcaggggagaacattcgctgatgaacaggattacaaggcagatgacgagggctgttaattcgttcagtgaccgggtgcatgatcgagtgaagcggatcattgctgaaactgcggaaattattgctggtcaagcggtggccgcggcgccagtagatgacggaaaccttaaaaattcgatagaggtcaattactctcatggtggtttcaaggcgaaaatcaccgtcggggcttcttatgccgtttacgttgaatttggcacgggcatatacgccgaagatggaacgggccgcaaaacgccttgggtgtactttgacgagaaattagggcgatatgtgttcacacgcggaatgcgcgcgcaaccgttctttttccctgctgtggaagcgggcgcccgttatttcgaaaggaagatgaaccggcgatgattattcaaaataaactagcttcctggaaccttcaaaaagcgatatacaacaggttatcgacggatgcggcgcttaatgaagtgataaagggcgtttttgacaatccgaataaagacacacctttcccgtatgtgtccatcggggaagacacgtcaacgccattcgaaaccaaagtgacatttggcgaaaacatcacaactgttatacatgcgtggagccgggcagaggacggcaggcgcgaggcaaaggaaatcctttctctcgtcatgcaggccctgacaaaagaacctttagaggtggaggggttcaaaccccttcaactcagttttttgcaatcacaagtgatcacggatattgacgggatcacacaacacggaattttgagaatccgaatttatatcaataattaagggggctatcaaatggcggtatcaggtaaaccgactaccggtaaaagtatcatttatattgtacaagctgcaaatgcgccacttggatcagatgcgttaatcgtagggaaccagacagaaggaacatggacaagggaacaagaaacggttgacgagcaaacaaaactaggccgtatcgttggatacggggcgaaaagtgagacattcgaactttctttatacgcacaacgaaaagatggcggacaagaagccttagaatggacttatgataatgaatccgagttgaaagtttggcgtgtagacaccagccaaaagaacgacaacggaaaatatgattgccgtttcggctggacgattatcgaaaacattgagtttagtgagccgacagacggattcgtcgaagcaagtacatcattgccggttcttgttcgtacagtgccgggagaaattgaattgccagacgactttatccaatcagctaatgaaattctattcgaaaaaccgggcgagactacaggcggattcgagaaaagaaagcagcccacttctactccctgaggcgccccaaaatctacagtatacagctacaactaatagcgtgaccgtggattggaaggctgtagatggggcgacttcatacaaggtatacaggggatcggaaaaagtattctacaaagaagtgacagaaccaaaatgcacgctcacagacattacgccggatactaagctcacagtgaatgtgacggccgttaacgaggtgggagaatcgcctatgagtcagatagaaacacgtacagagccagaaacaagtggctcataaaaaaaacgattcaaaataaagatacagggcatccttccgggtgcccttttttataggaggaatatgacatgccaacattagaaatcgaaggaaaacaatatgaagcacgctgtgatttcaaattcgaaaggacagcggaagaaaaatataacgaaaaagacgagagcggaaacaaacaaggcggcttacgaaatgtatatctcggcctacttgagcaacgcagttcactttacttaatccggttctgggattgtgcactttctcacttgaaagataaaaagccatctgttgaaaaaatcgaagaagcgctcgcgaaagttattgaggatgaaggcgcaaaaggtgccgaaagactttacaaagaagcgtttcaggcggtggatcaatccggttttttcgcagttcaagtaaagagaatctggcaagacttcgacgttctcaagaaggagatcaaacagagagtcggggagacggaagcggaattcctgaaacggaagcaggagcgcgaggacgccaaggaaatgatggcggaactcgaaaaactaaggaaagagatgaacaagtaaactatgacgcagttattttgaatgctgctcgttatcttaatatacatgatccggagcttatactttcgtggacaccacacgagtataagctctttttaaaaggcgcgcaatatcggcagatcgatgaaatggaattgttgacgaagaacgccctattccatcgatacgctttgaataaaaaagggcgtgtgacccctaaaaagatgtttgacgctgacaaagcccggaagatggtggccaacgaggaagacggctggcgcaatgcgcggagccttggcgttaaccctaatgccctaaaacgcgcgacagatgcccttaaaacgatcacccttccggatttcaataagaaagggggttaaggctatgatcgaacgcctcacagcgattgtcgatgcggaaataggcaaatttaagcgcaaaatgggcgaagttaaggcgttagcccgaagcatcccgaatagaatcagcgtaactgttaaagaaaattttaaagaggccgagcggcggctgggcgttttcgaaaacaggatggcgcggcttagcagggtgataaacgactttcagactgtgtttggaaacgcctttagcggcatgaaaatgtcgatattcccggctcttgtgccggcgatagcgtcattaacggcggctttggggtcattagggccggtcatcggcgtggcttccggcggccttatggggctagcgagttcattcgggacagcggcggcaggtgccggagcgtttggagctttagccatttccaatattagcggggttttcaaagcgtcttccgacctggcgaagctccagcaaaagctggacgaaacaacagacctgaaagagcgtgccaagatcatggagaagatcaaggcgattcaggaaagtcttggcgcagaagaacggaaggcgctcgacaccttggaggacttcaaagcaaactggcgcgagatagctcaagaaacgcaaaaaccgatcttgaagacattcacaaactctttgaatagcttcaaatccgttcttaacacactgcggccgatgtttaaatctgtcgcggcggctggccttgaactatccgagagcttccaaaagtctttgaatgctcccgatgtacagaagtttttcgattatatgaataaaaacgcaggcccgcaattcgccacgacagtaaaaacgatggggaactacttgcgcggctttttgaatttgctggttgcttttggaccattggggcaacaaatgtcacaaagtatgttgaaatcgtccgaagcattcgcgaaatggacggcaagtctctcaggctcagataaatttaagtcgtttatccaatacgttcagcaaaacggccctaagctgctgacgatccttaaaaacatcggatcgggattaatcggaatgtttacagcgttcgcgccgatgagtgcggacatgctgaccggtcttgtaaatcttacagcgcgctttaaagaatggggaaacagcctgagcgaatcgaaaggcttccaagaatttatcaattacgtgcgacaaaacacaccgacagtgctgtcactgatcgggcaactaagggacttgattgttaacttaggtgtcggcatggctccgttgggttcgcaaatcctgcaaatggtcacagggttcttgaaattcactaattcgatgatggaaacaaaccctattatcggtcaaatgatcggttatctcattacattcggcggcctgttcagagcgttaacgcctttaactgtcgctttttcagcagcttttaaatggaaagatgcaataagcacggtgaaaaaattagggacggcgataaagtggattggctcagtcattgggatggtcggaaaagcatttttgaccaatcctattttaatggttgtggcagccattgcggcagcggcttatctgatcatcacgaactggaaaccgatatccgagttctttgtgaatttgtgggaaggaatcaaaacaaacgcgatagcggcgtggaattcaatatctgagttcttttccggcctttggtctggaatagtcgaacttgcgtcaacagcatggggcagcctgacgtcgttcttctcaagattatggtcaggaatcaccacgacagcacaagcagcatggactggattcatgaatttagtaaagccaatttgggacggaattgtcgcggttttcggcccgacttttaacgtcatagtcacaacgttgtcaaacatctggaacacggtatctagcacggtatcgtccgtgtggaatacgatcaaaacaacgctgatcggcgtcgtcacgagcattgtggacggtgtgaaaaatcatttttcgattttgtcccaaactctttccggcatctggaacggaattactagcatcgcaaaaggcgcatggcaagtcttaaaaaatgcgatcctcggcccggttctgcttgtcatcgaccttgtgcaaggcgattttaaaggattcgcaaaccatttaaagcaaatctggacaaacatcagcaacggggcaaagcaaatctggaacgggatcaaaacggttgtgtcatcactcgttaaaggtttagtcaacgctgttaaaaattattggaatacagccaagactgtaacgacaacaatctttaacgggatcaaaagcgtccttagctcaatctggaacggtataaaaaataccgtggtgaatctcgccaaagggctgtggaacgcagtcaaaaccacttggaacacgttcaagactgtaacgacaaccatttttaatgcagtcaaaaccgtcctgacaaccgtctggaatgcggcgaagtcagtcgtcataaatgcggcaaaaaacatctggtcgagcgtcaggaataacttcaacaacatgaagaatgttgttacaaccgtcatgaagaatgtcaaaaccacgatccaaaacctttggaataacgccgttaaattcttgaaggggatcgatctgaaacagatcggaaagaacatcattcaaggattgattaacggtatcggaagtatggcaaatgccgtctggcggaaagtcggcgacatcgcggacggggttaagaagaaaatcaccggattactcaacattcactcgccatcacgatggatgcgcgatcatgtcggaaaaatgattccggctggtgtggctgttggtatcgataaagcgggcggccttgtagaaaaagctactcagaaactggcgcagctcaccatgtttacgccagatcaaacgacattcgcctatgacacagccctcagcagtggcacattaaacgatgtccgcggtcagatcgaggcagaggtcagtgatttcgaaatttcagaccgtccgatcattattgaaatggacggccgagaagtcggtcggggcacgtacaaatacgtgaaagagttccagagccgtgaagacggaaggaggacgaccataaaccgatgatcgattacaaaaagatactgacaacggcaatagatgacgcattcggccaaacgattcaagaagtagactattggatcaaattcaacggttacaccctgacggatcactttttcgtgatcaacgacagggggcgcggcattgttggcagggaactgaatttagtttccttgccgggtgtcgatggcgctaaattaaagggcgtaagatacacggaacgcactatcgagattgacaccttatttatagcggccaacgatgcggaattacgaaagatattagaagaaataaattatatccttgcgacagacaaggaagaagcgttgatcttttcagatgagccagaccgaacatattacgccgtattcagtacagcgcaagagagtgaagggcaaaacggcgtctataaagtgacactgacatttgtatgcccgaaccccgaaaaggaagcggctgaaacggttgtcacaactgaaacaaatagccctacagtggtaaaaaacgatgggaaaagggcggttacaccgactattacatgcgttttcgagtcggacgcatctacctatgaaattcagttgttgaaagaagacgaaacaatcgaaaagcggataaaagtaaatttcaacttcattaaaggggacacccttgtaattgattttgaaaagagaaaagtgatcatcaacggcaaagtaaacatgaatgcgctgcttatgctctcaagatggtttaatatcccggtcggagaaatcaccgtgaacacaacacacaaaagcagtatttcatttaacaaggcgtatatgtaagggggtgcgtttatggccgatatgtggattttggacgacaaggacaaaaaacaaacaatcatatcaagcgaagcaaaagaagcatgtcgtttctatgatgcgccatttcgagaagaactgaatgtcggttcttctttttcttttgtcgcggacgcagatcacgaggatagcgttcatataaaaccggagaatcaggtcgttttcgaggacaggagaggaagaaaacgcaatttcgttataaaagagctggaagacgccgacgacggcgcgaatgcccgcattagggcctattgtgagccggcactgtcagagctatacgatgagtttgtgaccgacatcaggccgcaaaatagaacagcccagtacgttcttgaccgtattcttgagggtacaaggtggcgcgcgaatgttccggtcgatcttggcttgcattcaacgaatttttatcgcatcagtgtcatggaagccatcaaccagatattgcagatatggggcggcgagtattatgacgaagttgttttcgatgaaaatgacaatatcgttgatcgagtgatccatattctgccccgacgcggccaagataccgggaagcgtgcggaaatcgataaagacattcaggaaatcaccagaacggtactgagttacccggtaacagccctgtacggttacggcgcaagccttgaaaccgaaggcggcggcaacacccgttatattgatttctcggatgtcgaatgggtcaaagcgaacggcgacccggtagacaaaccaaaagggcaagaatgggtcggcgatcctgaccttttggagaagttcggccgaataatgtatgacggtcagacgaagcggcaccggttccagaaatggcaagacgacagcatcgaagacccggccgaattgcttagaaaaacatatgaagcgcttatcaatcatgaaatggtgcaagtcaattattctctaaagctggaactgcttgaatacatttcgggttatgagcatgaggcggttgatcttggcgatacaatgatcgcaattgacgacaattttcgacaccctatcgaggttcaaactagagtcattgcaatagaatacgatctatctgatcccgtgaatacggcacaggtagaaatggggcaatttttagacctgtattcaaccgaaaagcggatcaaagagcttgaaacgacaattgacacgaatcgcggcaaatgggacaacggcggcgacccgataatcggcgacgggagctttcctgataaagtgccgcctgttccgtcaaatattaaagtcgaatccttattccaaggggtttcgatcacatgggactataatccaagttcatatatagcggcatatcagattttcgcatcgccgaataaaggatttacgcctttggatgaaaatttgattttcagcggtaaattaagcggatacgagcatacgccgggcgttgatcaagtttggtattatcgaatgcgaacgatcaatacacacggcacgccaagcccatttacgcaagagttcacaggcgttaccagaaggattttgactgatgacatcgttttcggggcggttacggccgaaaaacttgccaatctatcagtcacggccgaaaaactttcacagaaattcgatgaatccaacattttgccgggttcagtattgcgtccgggtgaattaggtaacgtcaacggtgcatcatggagcgtgaaagaaggggaattcaacgaagtaactgtcactagaaaagcggacgatacgcgggccgggtttggttttagtgctttctatagatcaaccctgaggctgactaagggtgaaaaatatacattatcattcgaggttaaaaggaataacactcttaatatcaattttatttatttaaaagatgacagtggacaatatcaattggatgcacccgattttaacgacattagctctttcccttccgatgaatttgtaagggttgactatgtttttcagtcaccgatcacaaccgaaacagcccggctgtggttaggaggtaataaagtcggagacgaaaacccttccgtcacctatagaaaaattcaaattcgaaaaggcgatgtaagaaaagaattcgccttcagtccatacgacgtgatgctgactgaacaagcagtttcatcggccttaattgcgaaagcggccatccaatcggcccacatccaagaggcggccattacgacggcggccatcgcaaacggagccattacacgagcaaagctgggaacggctatcattggaacggctcagatcgaagacggggccatcacaaacgcgaaaatcgccaacctttcagccgacaagatcaacgccgggacgatcaaggggattacaattgaaggttcattgattcggggggctagaatcgagccgttatcgtcatccagtgcttacgaatcttacattgaagcaaacaagatttaccagcttagaaaaactagatatggtggttatcaagatcgatatgaagaactcgatatatcctccggtagtatcattcaagattatggcaataggcttgatgatgattcgcacgaatctttgaacaaagttgagatttcaaaagggaaagttgctctttcaagcgggaaaacattttctactggcactacatccagaatggaaatattctctcaacttgggactagcgataacggactgtacggcggcaattttatcactatgtatagaaatgacgaaaaagttttcgaacttcgacaggatagttggacagaccctgacactaatgtaatcatgccgcaaatgtcaatcagagcggagaaagtggatttcgtttcattctttgaagacgtttccgtttatagtgaaaagagtatataccattctgcagaaagaagtgtcgccttattttccaaagatggtccggtaactgtctacgcaaaggacggcatgaaacttaataggggaagcaacggcgaatatacaacatcgataactgctgatgatgctttaaagatcgcatctaaaggaacaatcacgctggaagatacagaatttaacggcgcaagtttatatcttggaacagacagcagaggcccgcgtatttggtcgtattcaattaataaaagaacaaccacagcggcggcaaacctccatatggaccagtacggaacctttcataaggtgacatcatcccaaaaatacaaaattaacatagaggaatttccgaacgatagagtggaaaatattttaaaactaaatcctaaaacatggtttgataaaaaagctgtggaagcatatgcagaaattttagagagcggacaagaagatgacgaaaacaagccatatttcgagcgaatcccgggattaattgccgaagaggtattcgaagccggtctaaaagaatttgtttttttcggaaagccggacgaaaacggaaaccgtgaaattgaaggaattatgtatgatcggctgttcgctttactcatccctattgtcagagacctgaaaacccggatcgaaaatatagaaagcacgttaaattaaggaggaaaacactttgaatgacactaaaatgacatacgaagaactggaagaacaactcaacaggcaagctttaaaagcggcggcgtatagagaagaattaagccaagcgcatgatagattggcagaaagtcgaagcctatatatgaatgaattacagaaacggcagaacctagagcaggaaaatgaaaagctcaaaaaagagctgcaagaagagcggatcggcaatttgcaggcggaagatgaagtgatagaaatgaatcaagtcgaagcaaataaagaatatcacgaaaaaggagcagaagcggcgaaataagcggcttttttattttgcctcaaagaggtgaaaatgatgtgagaacgggaggattaaggggcatggcgcaaacaaacgaattggacgtcttcaagcatgagattaccgagctgaaagccgatcataaaacgcttgaacagcgagtcatcacgttggaaagggcgtctgatcggcatgaccaacagattatgtcgatcaatgataagctcaacaagattgaggaaaacacaacttggatcaagcgcagcataacaggcgcgatcatcacagcggtgtgtacactggtgatctccgggattgcggcgcttttcattaattttattcaaaaataaggaggaagacacaatatgacaacattcgacaaaggcacggtcgtccggacggtgcttctttttattgcattggtaaaccagacattgatcatgttcggaaaagcagctttgcctatcagcgaggaccaggtgaatacgttggccgacgctttgtatttggccggttccacggcattcaccatcattacgtctgtggtcgcttggttcaaaaataactatgtcactggcaaaggaaagcagcaaaaagaagttctaaaacaaaaagggttaacgaaatgaggttgccggctggcagccttttaataatttaaaggaggattttaataatgggaatcaaaggaatcgacgtatcacactggcaaggtaatatcaattggaagaaagttgcgggggacggtattaaattcgcttttatcaaagcaacagaagggacaacattacaggacaataaatttgtaacgaatatttcaggtgctaacgctgtggggattaaaacgggagcctaccactttgcaagattcggttccaagtcagaagcattggcagaggccaggttctttttgtcagttgcaaataaggtccatctcacgtatccgcttgtgcttgatcttgaagttaatcagcggaatgtcagtaaatcagttttgacagatgcagcagtggcctttttacgggaagttgaaaaagctggttacttcgccatgatatacagcggtaagtctttccttgagaattgccttgacgaatccaagctgaagccatttgcattatgggttgctcgttataacaacacacttggccgtcatgcagatatctggcagtattctgattgtggaagggtcgccggtatttctgggaatgttgatatgaatatttgttatcgtgacgggttacgggctcaggtagccgtgacaactgaaaaagctgctactgtaaaacctgtttcaaacaaaaagccagttaaaacggagacagtttacacagtcaaaaaaggggacacgctttcggaaatcgcacagaaaaacaacacgaccgttaaagctctccaaaatttgaataacattaaagatgcgaataagatttacgttggccagaaattaaagattagcggcagtccttcaacagcatcgaataaaaagcaatattacaccattaaatccggtgacactttgtctgggatctcgaaaaggtttaatacatccattaagacgctgcaagcttggaatggtatcaagaatgccaacaagatttacgctggtcagaaaattcgtgttagataacgaaatgggattacaacataaaactaaagcaggcattcggcctgcttttttgattaattttatttctgaaaagatctgttttctgtatcaacttattggagttatgccaagcatactatttcaattgccatgaccgtattcttcttctgaagctaatgcatctcctttagtaacatgaacagtaccaaatggatggttaggaggagcatatatggagtatagttttagcgggattctacctgtattggttagattgtgccatgttccagcgggtattatgattgcagaatcatcatagacatttcttttgaaatttaaatggtctttattcttgcccatttgaacgattccctgaccttgttcaacacgtaagaattgatcaacgttagggtgcatttccaaaccaatatcttctccaacattgagactcattaaggtgacttgcaaatgagttcctgtccataaagcggtacggtacgtattattttgcttcgtagcttcattgatattaaccacaaacgcttctggtccataatcctttaacaaaatgctgttactacctttggatgagcgaacagaacttaatttgtttgcatgctctacttcactaggaacagtccggtgaactgactgtcttctacagttgtacattggcacattaacataataaggataagaatattgatatggatacatatgaggaacataatacatttttttctcaatcccttcaaagctttatatgaattaatcctatgcattatgctcagggaatgtacttagataccaatttttgttcaaagtcaatggtgtttgcctatgcacttttaaaattgatatgttctttttgcaagatcaattcataaagtttaatttctctcaagacctcttcggaaagcctctaaatgatttagtgatgcgttgcgtaattgagtaaaaactgttcttgcatctgctggaagatcaaaagttagaaacttgttatacatggcgatattatcaatttctccttgtaccccagaagcatatgcatccttaagggttactggtgtagtgacatataattgagaggtgtctttaggtatctgtacttggtatcgttcaaaaagagaaagtaatgcattgatatgccgtaattcggcttctttaatttggacaaaggttcgaatatccccgaagtttcttagaatttcattgtatcttgcttgagctaagtactcatcctgaatggcaaaggtaagcatttgaggtaaggtgagcctaccggaatttaacgctccttttgccccataattaacttgacgtgtttgttgtgtagacgatgtatttaaaaaaaataagaaccatacagcatgattttgttcatcagctgctgcacgctgaaaaacctttttaattgactgattttgtattcggtctgctaaatctaaataaaaatcgactgtctcctgctcatctttaaaagcagactctagacttgttctatactttttagggcattcttctatgattatggggattggctttttgcctgtcaggttagtgaaaattctgctaaactcttcaaaatgtcgttgctcatcttgtctaatttcaagtatttgttttcttatatcttctgtgggggcattttcggctatttgcttatagcagagaatggcgctatgctctccgttaattgccttgtgaatgtcattaattagttttctgtcgggaggcatacgaaaatcatcactattccttatataaggattataaacaggataagggtacaccaatttcaccgtcctatttgcggtatttagtaatgtagcatatgcctaatacaacaatgagtgcatgtatatgtgtctaaccattatttcagtatatataagatctcttttgtctatgatgtttttagacgatacaataagttggtgaaatctatgagtgaacatattgaagtaatccttcgatcgattcttgcctttggtattttattggtaggatcaagattgttgggaaaacaaacaatttcacaaatgaatatctttgattttattgcatcaattacattaggcgctattactgcaaatctggcttttaatacctctcttaaaattcatcacatggtactggctttttttatatttgtttttgtgatcttagccactgcgtatatatccctttggagtcaaaaaggccgcaaattttttgccggtgatccaactgttgtgattcaaaatggaaaagttcttgaacacaacatgcgaaaaatgcgttatacaattgattatttgaatcaacaacttagagaaaagaatgtattcaaaatcgaagaagtactctatgccattgttgaaacaaatgggaccttaacagtattaaaaaaaccacaattccgaaatgtgacaaaaaaggatttgtgggttgccactacgccagaaggaaaactcccgattgaattaatcatggatgggaaaatgaagaatgaaaacttgaaagataatcaactcactcaggcatggttacaatctgagatgaaaaagcgtggtctatccacagatgaagttttttatgcagtattatcacctgatggaaatatctatatagatacatatgaagatcatatacattcttcttttgataaagaataaatgatttcagcattctgtaaatacattttgaatgtattagtgactacatgttttagtggaaaactgttggcggattgttgtctaaccctaccaacaatcatcattttcattcagaagtcatcagatgtaccattcaatagcgcttttttgaccacatatttaagcgtgatcaccaaaatccaccacaaatttttcaaaacacgttaaaaaagtatgaaaataagaagagatgacgttaataaaaaatcttatgtggtttaaaaattgaaaggaaacgaatgtccacgaaatgctattttaaacgggtgatgtaggcaagaatcattaatcatggtttgtgaatcgtgagacattctttgtctcgggcttttttcttcttatctctaggcttatgctttgctgaaaatcttatggccgcttcatttctattccaacaacatcttcaaatttaatggaattaatgtctccttttgaatccacaacatgcatttataggccgaagacgcgggcgaagttgaatgacctcttaaattgatttttgaccactttttgaccttctttgtagtatcttttctgattgcctgagattttatcaccggataaaccaagaaataaatctggttgagattatgacgaattccgggtgatttaaagggtatgaaacggagggaatgattcgtttttttaacggtttttgtatttaaaatgagcgttaagctggccttcgagcattttctttctgagctgctggtcgttttttagcctttgttcttttttgcgcatatctttgaggatttctgcggtctgaacaccgtcttcccgcttgtttgcgatttccatcagccgttcgacgtcagcaaaggaatatttgcgcgtgcctcttgtagagcgctgcggatagatcagcttgcgttcttcgtaatagcggatctgcctgaccgacagacccgtcagctcgctgacaatgccaattgaaatcacttttttatctttataagaaagatcttcgactgtcattttcccacccctaagatgactttttttgtattatataagaaaacgcgcgaaaaaacctgacatctgtcagaaaatctaacattgttgaaaaaatttttaaaaaatcacggaagaaaagtttacaggaaccatgcaaggggtaaaagtgttttgtatgctgtaggtacagacttttgaggggggaatcgttggatgaaggaacacaaagcagtcttactcgccaaagaaatcgttgccttagacaataagagagacgaattgctcgagacattgatgaaccttgccggcaaggatgcgtttccgctgctgagggcggtgcagaacggcttttatcaaaagtcctcttaaattccggaaggggagtaaaagcgaactttacacggccttaaagcttggttaataaataaggtctattcttatagtatacaatacgcgaaaatgaaaggagaagatcatgagcagattgttaaaaaacgctttggaaaaggaaagaaaccattacttgaaaaaactgatctcactcggtgagcataatcgggaagttttgcagaggatgacgattacggagctcagaaatgaatatttttattttttccggaaaaataaagcccgtgttcaaaatcggccattttgaaaaaacgggcttctttttaatatctaaaaaaaataagcaggagttttctttcggataacgaaaatatatacatatagaatatgggaaaagcatgaccctttctttttctacatttgtaagggttttcatttcccgggttcattttaagaaaatagtataagaggtagatgatatgagactttcgtttaatgaggaagaagttcaccgtgctatgtcgctgtacaaggtttttgccagggcttttaaaagcgtttcagaacatagtattcgggacagcaaggaacacggctttaatcctacagaatttgctgtattggagcttttgtatacgaggggagcccaaaagctgcagcaaatcggctcgaggctgctccttgtaagcgggaacgtaacctatgtgatcgacaaactggaaaaaaacggtttcatcaaacgagagcaggacccgaaagataaacggtctgtctatgcgaatttgacggagaagggaaaggcatatctcgatgagatttatccgatccactccctgagaattgcgagggctttttcaggcttgacaaaggaggaacaggagcagctgatggtccttctgaaaaaagccggaatccacagccagcacctattgtttcgctgaaaaagtcagttttccgaacggttgttttcttttaagtgatcgagaatagctttgatctgtttgtcctggggctgtctgaagaagctttcgaaagggcatccgagttcctttgtgcgtttgacgacagcctccatcgtaaaatttaagggtgacaagtctgaatggacttcatcccaaaacagcggtgcggccactgtgccaagctcattgcctcttgtggaatacgggcagatgatcgtttttcccggggcatgctgcacatagtcaatatagagctttccgcccctgtttttgatcaggcgttcggttgtgaacagatcgggaaaaagcgagacgcaataagaagccgcaaagcttgtgaaaaggcgggtttcttcataagtaaaggcgttttttgaaatcggaatatagatttgtatccctttatttcccgacagctttggaaaagataagaggccgagctgatcaaataaacggtgcagctctttcgcggctctgacggccagcggaaactccgactttgaaggcggatcaagatcgaaaacgatttcggtcggatgggccgtatccaccgtttgaaaagggatatggaactccaacgcaagctgattggcaagccacagcagaaccgaataatcgctgcagatgatatgctcgtgctcgtcatcccgaatggacgtgataaattcgggtgcgtagtcgggcttgtttttttgaaaaaaagactctccgccggaaccgtgcggataacggataacggtaagcgcccgattgtcgagaaacggaagcagaaaatcgccgatttcattaaggtatccgatgtaatccgcttttgttttatcgcttttaggaaagatgactttatcaaggcttgtcagctgcaaatcgggatggacgtttcttgaatgaagcagcaggcggttgtaagtgcaattttcccatgccatgtcaaattcaaatgaaacaaacgacacctcgcgcaatgtcccgtaatgaatcgttaagtaatggaccgtcatgcaaatcgacggatcaatggtatattcaccgggttttgtttcggttccgtattgcttgacgatcgaaagaatggcgtttctttcctgttctccgagtccgtgggaaaccgaaccgacttccttgatttggccgcggtcatagacggcgattgtcaaataacggtttgccatgttgtagcctgtcataaatacagcagcttttttgtagtttttgagtttgagccattcggccgtttttttattttcagcccagcggctgtcttttttcttcgcgacaattccctcgccgtcaaaccttttaacagccttccaaaggtcgtggaaatcagaagtgtcagggatgtattgaattcgagcgtgagccatcggatcgggagccatcggcaggccgagctctttcatcaggtcgaaaagcatgcgttttcgttcggtataggggagcgaggttaaactttctccgttaaaaaccagtaaatcaaaagccaagtactggcacggtttctttgcggctgcttgtgcaatcaactcggcctttttgctcaaaccccttttttggacatattcaaatcgggaacgaaaacggtttgtcaacgacacaatttccccgtcaatcgtgatcggcaagtgttctttgagagtttcgatcatgctttttgcaaattccgaaatttccggaaatgtgttttcgagcggctgtgagtttctgctgatgagcgaaacttcgccggtcgcagcaatctttaaaagaccccgatacccgtcatatttgacttcataccgccaattgccgcctgagggagctgatgtagtcaatacaggctgcatcgtaattcccattttttattttgcctctgaagcttttttgcgcgacgtttttttctttttctcagctgttccttttgctgcaggcgctttcgccgcttcccggtcaggcccttttgtccgttcgatgctggcttggagagcgctcacgagatcgattacatcctcgcgcggagcggcggccccggcatttggcgtgacaccttcattatggtcgattttctctttgattttatccatcagcgcgattctgtacgtatcttcatattgttcaggcgcaaatgtcgttgtcagctcgtctattaatgaaatcgcggtttgcagctctttttcgttgactgcggtttcttccggaacaccgggtacgtgggctgcgtttcggacctcatcagggtagtggatggactccattaaaatgcagttttcgtagacgcgaagaatggcgagctgtttttttgagcggatggtcatatgggcgatcccgatcttttctgtttttctgagcgcttcgcgcaaaagtgagtacgcttttacaccgttatctcccggtccgacgaaatatgaacggttgaaatagatgggatcgatttcctttagctgcacaaaatcaacaatttcgacggccttgtcttcctgctcttctttgagctgcttcagctcatcgtccgataagacgacgtatttgcctttaacatattcgtagcccttgacgatgtcgtcgggcgcgatttcctgatggcagtttgtgcactttttttcatactgaatcggggcgcggcattctttatgaagcgaccttaatttaatatccttatcctctgtcgctgcaaacagtttaatggggatattgacaaggccaaagctgatagagcctttccacatcgtatgcatcggttcggttcaactccttttcttttattgatgcctctctgcagattgtttcatgaatagcaacttatggatgacagaggaaaaaagcatccgggctgaagcccggatgcttgcggcggtacaagtttggagccgttcttcttgaaggaagccttagttcagctcgatttccttctggaaagacggtctgttctttctggcgagggaagacgagaagtaccgatatctgcttacgctcttgtgctttgcggcgtacatagccatgtcggcttttctcatcagctcatcgccgtctgttccatcgtccggagaaacggcgattccgatgctgacggatgttttgaggcgatgctctttaatgcgaaaaggcgtttcaaactgactgatcaattgcctggtcagctgatcgatcccttgtaaaggagcgacaatgataaattcatcgccgcccagccgggcgataaagccttcattgggcacacagtgcgccaaacgctgtgcagcagccaccagcagcaggtccccgacgtcgtggcctagggcgtcattaaacactttgaaacggtttaaatccaaaaacaacacggccgtccctgtctcctgccgctttagaacatttgccagacggtcgactgcataccttctgtttggcaaatccgtcaacgcgtcatagtgggccattctatggattttgcgttctgcttcacgctggtttgtcatatctttgcatatgacataaatgctgtcaagctgctttctgacatacaccggtatcagcgtcacatttaaatcaaagcgcttttcagctatcgcgattgccgtatcgcggttgatggcctgtttttcattttggacttgaaggaaccagccgagcagcctgtcatgatcctcctgccgaaaaacggaagacaggcgctcgggttcaattcccattttttcaagaaggctgtatcccgatgaattggcggaaagcagcttgccttcaagcgaaaaaacatagatcggatcaatgttgtggttgatcaaggactggaaccgctcctcgttatctttgactttttcgatatgaagcagcaggcgtttgtcattgaaggcgccgaaaatcaagaagcattgaagcatcaggctgacaagcacgatcataatgcccagttcaacggtatcgattccttcatagcctgtgtcaacgctgtcagccatgaaaagcgtagctgctgacattcctgtatagtgcatgccggaaatcgctccgcccattaaaagcgcgcttccgattttaatgaacaatatccgaaaagaaccggtttttttggcgaatacaactgacagttttaaggcagcgaaggaggcaaaaatggcgattgcaaaagaggcggcataaagaacgggatgatagacgattgtcatattttccattgcttccatcccgataaaatgcatggaggcaattgcgcatcccattgcaagggacccggccgccagtcttccattcgtcggttttttttcattcaccacataaaatgagatgagcgagcctgcgaaagcggcaacaatcgacaacaagacgaatttcaaatcgtatttcatttcttctgctgtctgaaatgacaccatcccgataaagtgcatagaccagatgccaagccccatcgtgagggaaccggccaaaagccatccgatatttttcctgccttttgtatgtacgacccgttcagataaatcaagggctgtataagctgccaaaactgcagtgaaataggataataggacgagccatccattatattcaccaagaacttctgtcacttttttctccgcctttttgtacttatgatgaaaagtctaaataactatactgtattgtgaaaggctagactgccgtactcttaaccgttgacataaaaaagcggcaatagcgctaattccggtataattcgtgaattatactatatataatgaaattcgccaataaaaaatgatatcctcctgttctttttaaggaggacttcccattttgctcttcaattttctcgaattgtgttaaaatcatttttgtacgttctttagaacttgaaattatcaatcgtcaaaggttgtggtcgatatcgaagagtttattttatcaatggctgaggcatttaaaagcctctcgtatttaggcattttcctggcgctgtgcatcgaattcgtgccggctgagatcgttctgccgcttgccggatactgggtgtatcaaggagatatgtcgatgttcggggtcgttgcagcaggttcactgggaggtgtcgcaggccctctgacgctttactggctcgggaggtacggggggcggccgtttttggaacgctacggcaaatacttctttatcaagcctgaagcgcttgaaaaatcggacaggttttttgaaaagcacggcgggtttgtcgcattcagcggccgttttatacctggaatcagaacgctgatttccattccgtgcggactcgcgaaaatgaatgtgtgggtattttgtatttatacattcctcgcgatcacgccgattacgttcgtctatgtctatttaggcttttacctcggcgaaaactggagcaaggtcggcagcctattggacggataccttcttccggtcggcatcgggttcatcgttttgttcgttctttacctttggttgaagggcaggcggaacaaaatcaaatcgcaaagcgtttcagcctttataaataaaaataaggattgacagccgtgcgcatatgaggttaatattatcttataattcaatattttcttttatcccaaaggggagtagcgtccggatgtttaaccggaaacaaagtcgtcagttcatggatcttcatccatcggctttgttggcatgttttaattaatgataaccatgtctagcaagacctttgcctaatgttggcagaggtcttttttgttttctgaaaataccctgccgcattagcgggaataagagaaagagacaatcacttaggaggaattacaaaatggatgcagcattattacttgaatatggttgggttcttctcatcctagtcgggctggaaggcattttggccgcggacaatgccctcgtcatggcggtcatggttaaacacttgcctgaaaaagacagaaaaaaagcgctcttctacgggttggccggcgcgtttgtgatgaggttcggcgctttgtttgcgatctctttccttgtcaatgtctggcagttgcaggcgatcggcgccgtttatctgctttacatttccgtccatcatattttgaaaacccacgttttcaaaaaggacgaaaaagtgaaggagacgaagcaaagcggtttttggccgacggttatcaaagttgaactggcagacatcgcttttgccgtcgactcgattttagctgcggttgcgctggctgtcacacttccggcgacaaacctgccgcaaatcggcgggcttgacggcggacagttcatggtaattttagccggcgggatcatcggattgattattatgcgctttgctgcaagtcaatttgtgaacttgttaaagaaacgtccgagcctggaaacggctgcttttctgattgtcggctgggttggtgtgaaactgacgctctatacgctcgcacacccgcaaatcaatatcgtctctgaacattttattcattcaggtacttggaagttcatcttctgggcggtgctgatcgccattgcgctcgggggatggtttatgacaaatccgaacaaacacgagaataaagctgctgaggagtaaacagcttttcccagactgccggtctttcaccggcggtctttttttgcccgcacgaggaagagccggggaagatggccctagatcaatcgaaataagatttcattttattaacagccatgttacaaaaacggcgggaaaacccccttaatcgtcaaacagatcacgaattgttctaggagatcaaacaaatgactgtcacaattgaaaaattagaaatgaataccgcgttttctcctttgcgaatccctatcaaattagctatcattaatgagtagtatagggaggaactgaggtgaaaccagtgcttagccttttgtttaagacaggaaaaaggaaacaatcattagaagagtctgtaataagcatacaaaaaggaaatcagcagttgcaaaacgagcttatcgatcaatataagccttttgtggctaaaacggtttcatccgtgtgcaaacgatatatagatgaaaaagatgatgaattcagcatcggcttgattgcattcaatgaagccattgaaaaatattcttcagataaaggaaattctctgcttgcatttgcagagctgatcattaagcgcaaagtcattgattatatcagaaaagaagcgagaaatgcccagaacatcaatatggacatgcaagaaggagaagaacaggaatcctcccaaagcatgattgaagcggagctttccattcatgaattcaaccgcatgctcgaacaggagcaaaggcgggaggagattctccattttaaagaaaggcttaaaagttttggcctgtctttttccgatttgctggagcattccccgaaacatacggatgcaaggcaaaacgccatcaaagtggcatatacgcttgtcgaacatgaagaattaaaaaagatcttgtttgaaaagaagcagcttcccgtcaaacagcttgaaaagcttgtggctgtcagcagaaaaaccgtagagagaaaccgcaaatatatcatcgctatggcgatcattataacgggcgattatgtttaccttaaagattatctaaaaggggtgctcaattcatgagaagaggaattattgtagaaaaaaataaaaaattcgtcacattgctaacccctgacggacaatttttaaaagcaaagagcacagaggaagattatgaaatcggtcaggaaattgcttttcccgcggagacgagaatgtcgagaaggcgtgcgggcttttttgatctgctttcgctccgtccgctgaaagccggcgttttttcaatcgccgcgatcatgctgctcgctttcatgatcatccctgatgttttaaacaataaagcatacgcctacatgacgatcgatatcaacccaagctttgaattgacgctcaacaaaaactgtgaagttatcgatttggtgccgctgaacgaggatgggaaggccttaatggatagtataaaaaattgggaaaagtctgactttaaagaagtgatcagtgaaattgtcgaagacagcgataagagcggttatgtcaccgaatcaaaagaagtgcttatcgccacagtatacgaaaacaatgaagatgacacgtataaggcgacggtaaaaagcgaaatcgatgatgtagcgaaaaaatacgagcagcagaattataagatggaagcggtggaatcagaccttgatacgcgtgcaaaagcccaaaaagaaggcatctcaacaggccgttatatccgttcccacaaagatgaattagaagacaaaaacaaagatgatgacaatgaaaataaaaaagatgatcaaaatcaggaagaaaacacaggagaaaaggagaaagctgtgaaagaagaagatcagccggaacagcatacggatgataaagaagcagatacggaagatcatccggacggcgaaaaaccttcagatgaagatcagtctcaacctgatcaagaaatggaaaaagaaaaggagtcaaattccctaataccaaaaaccctcaggaacataaccataatgacaaagacggtcagcagacggaggaaggaacgccaaaaagcggttccggttcaaatcaagagagctctaaatcacctccttaccaaaaggagaaaaagccttctgaccaaacgaataaacaagaatatccgccgagcgggcccggcgaataatccatagggtatttatttgtcattatgcccattcaattgagcttgtgcctgctgtacaagtcgttttgtcatttccccgcctacagatccgtttgagcgagcgaccgagtccgagccgagctggacgccgaactcttgggcgatttcgtatttgaactggtctaaaacctgctctgccccgggaacgaggagcttattcgttcttgccatgcattctcaactcctttttcaattggtactgcttgtttagtttgatttggactgaggctttttatgctggcaattgttgaagggcaaaaaaacgcctggcaattggcaagccaggcgcgccggtcggcgattatttcatttcatattttaagaagacgctgtcaatcatggaatgtgcggtcgcctgaatgtgcgaagcgatgacggacagcacagtgactgcggtgatgtctctcgctttgttccattcgggatcggccagatctttataaaaatcgcggagctgtccagtctgctcaatgacgattttttcaagcgccgatttattgagcgtatagtctttgatctggtacacatgatcaaggacccgcgcatacccttcataaaagcgcagcggactcactacatcatcggagcggtctgtaatcgtattaaaaatcgttgttaagatcggacggatcgtttcgaagtcataaaccgattttaagtctcgtacaatgagaaggatgacggcttggtcgatggaatattttttgccgagttccggatgccccatcaaatcttttatatcgcgtttgatccagttttggatggctgtcgattttaaggatgtcagttcgcacaaatttccaagttcaacaatttcatttgtggaaagtccgtgttccgttttttgttttttccgttcgtaccgggcaatgaattcggggatgtccaaattgtcttccggctcatcgggcgccaaatcggccgatctcaaaagaatcgctagcggactgacatccagctgcccttttaaagcgtacatcagtttggccatttccaggcgagtcagtttaaaaggtttcatcattccacctcattatgtattaaaatgaaatagcaaacaatataaacattatcttacgtcttatcacttgcattttcaattctatgccgtataattttattatacgagttcatttgatcttattataacatggagggtaatcatgggaaaaagaatctttctctttcttttatcgaacatcttagtcattacgacgatcggtatcgtgctttcgattatcggttcgctgacaggggtaggcacgtatttcacggctaacggcggcatcgatattgttgcgcttctcgtatttagtgcagttgtcggttttgtcggctcctttatgtcgctcttgatgtcaagatggatggcgaaaatggcgatgggcgttcaggtgctgaatcctgataagcaaacgctcagctatgaagaacagcagctcgttgaccgggtatataagctgtcccgcgctgccggactgacaaagatgcctgaagtcggcatctacaattcacgcgaagtgaatgcctttgcgaccgggccgtctaaaaaccgctcgcttgtcgctgtatcgacgggccttcttcaggaaatggatgacgacgcagtggaaggcgtacttgcccacgaagtggcgcatattgcaaacggcgatatggtgacgatgacgctccttcaaggaatcgtcaatacgttcgttgttttcttcgcaaggattgcggcatgggctgtttcacgcgttgtccgtgaagagctggcgccgatcgttcactttatcgcggtcatcgtattccaaattgtgttctctattctcggaagccttgtcgtgtttgcgtactcccgccaccgcgaatatcatgcggatagaggaggagcagaccttgcaggcaaggataagatgattcacgcgctccgctcgcttgagcagtacacttcaagagtcaaagaagaacaggcatctgttgcaactttaaaaatcaacgggaaaaagcatacatcgcttttctcaacacaccctgatttaagcgacagaatccgccgtctggaagcaaaataataaagatgcaaaccccctttttcaagggggtttgctttttaaatttaaaaatcgaaaagcggctgtacataatagcatgtttcctttaaaatggaacacgttatacacaagaagcaacttttgaatattgaaaagaaggaacgattatgaaggttttattgagaaaactactgcgcgtgctgtctcctgtacagctgatcgcgctctattattttttagcggtgacagtttcggttgttttattgagtctgcccgttgcacacaaaaataatgttgaatggtcttttatcgacgccctttttaccgcggtgagcgcagtgagtgtaaccggtttgacggttgttgatacagccgatacattcagcacggccggaatttggattttggcgtttgttctgcaatttggcgggatcggcgtgatggctttgggtacattcgtctggctgattttcggcaagcggatcggtttgaaagagcgccgtctgattatgaccgatcaaaatcaatccaacttatcgggcctcgtcaagctgatgaagcacgtgctcggcttaatcctgctgatcgagctgtttggcgggctgattctcggcacttatttcttaaagtactttgagacacctggagaagcctttatgcacggattttttacaagcatcagtgcaacgaccaacggaggtttcgacattacaggcaactcgctgattccgtttcagcatgattatttcgttcagtttatcgtgatgatgctgatcattcttggagcgatcggttttccggtcctcatcgaggtaaaggattttctgctcagcaaagagcgtaaattctctttcagcctgtttactaaattgacatcagtaacttttttccttttagtaattggaggtgcgatcggcatatttgccatggaagcgcgctttgctttttcagggaaatcgtggcacgaggtatttttcttttctctgtttcagtcgacgacgaccaggagcggcggactcgcgacgatcgatatcagccaattcacgcatacgaccattttgtttatgtgtatgcttatgtttatcggcgcttcgccaagctctgtcggagggggcatccggacaacgacctttgccttaaacctgttggccctgttccacttcgcgaggggaaataaatcggtgaaggttttcaaaagggaactgcaccaagcggacttgatgaaatcattgattgtaacgctgatggcggttattcttgttttcgtctcgacactcattttgacagtgacagaaaagcattctttgcttgaactgctgtttgaagtgtgttcggccttcggtacgacgggcttgtcgatgggcatcaccccagatttgagcacgattggcaaaagcgtcatcatccttctgatgttcattggccgaatcggcattgtcacgctgctttatttattcggcagaaaagaaatcgaagcgaattaccattacccgaaggaaaggatcattatcggataagaaagacagtttagtcaaactgtctttttttatgatcataaagtcggtcgctgtatttatttgtatgatataatgcttaaatggcggacttgaaaaaaagggggaaacaacgatgaaaaagagagtcatccatttgtttatagccgccggatttctattgctcgccggagcctgttctaacgagccgacagcaaaagaaagcatggaccaatatgtagacaaatggaacgagcaaaaatttgaagaaatgtatgaacagctgtcggctgaagcgcaaaaatcgatttcaaaagacgatttcatcaagcgtaatcaatctatttatgaacagattggagtttccgatttgaaggtttcaaccgtcgacaacgatgaagatgaaaaaaataaagagaaaaatgattcggtgacgataccgtataaagtcagcatgaagacattggccggtccggtttcttttcaaggcaaggcaaagcttgtcaaagaaaaaaaagacggagacacttcatggaaggtcaactggaaccaatcctttattttttcacagctgaagaaaggggagaccatccggattaccgccaaggagccaactagaggcatcatttatgacagaaacggaaaggcgctcgctacgaatgcgacagtgcctgaaatcggcgtcgttccggggcagctcggagatgataaagacggtgtcatcaaaaagctcgcgaacatgcttgatatggaaaaagaagacatagaaaaacagctgtccgcaagctgggtgacggacgattcattcgttcccctgaaaaaagtgaagcctggcagcaccgagcttctcaaaaaagcgacctctctccccggggttttgaagcaggatacgcagtcaagatactatccttacggtgaaaaagccgcacatcttaccggttacatacggccgattaccgaagaggaattaaaacagaataaagaaggctacagcgagcattcactgctcggaatcgtcggtctcgaacatatttatgaaaaagagctcagaggagaaatcggctggacgatttcgatccctgaatcaggcgcgacggttgcgtcaaaggatgcaaaagacggaaaagacatccacaccacgatcgacattaagaaacaggaagaactgtacagccagttaaaagatgactccggcgctgccgttgctttagaaccgcagactggagaaacgctggcgcttgtcagcgcgccttcatatgatccgaacgggtttttgttcggctggaaaaaaggagaatgggaaaagctcaacaaagatgcgtctgcgccattcacctctaaatttaataaaacttatgctccgggttcaacgatcaaaccgatcaccgcttcaatcggtctgaaaaatgatgcgatcaaagcggatgaacctaagaagatcgaagggaaggaatggcagaaagattcgtcatggggcggatataaagtcacacgggtttccgatcgactaagcgacgtcaacttggaaaacgcgctgatcacatccgacaacatttatttcgcccagactgcccttgatacaggcaaggatcaatttgtcgaaggcctgaaatcattcggctttgaggaaaagcttgattatgaattcccgacgaagtcttcctccatatcaaacgaaggaatcgactcggatattctccttgccgattcaggatacggacaggggcaaatgctgatgtcgccgatacaccttgcggcaagctatacgcctttcttgaatgacggtaatctgatcaagccgcacctgatcaaaaaggacggcgaagagaaagaaatatggcataaaaacgtactgcccacaggcggagcagaagcgattacaaaagggttaaaaggcgttgtagaagacccgcgcggctcggcttacaagccggttgtcaaagggcttacgatcgcagggaaaacgggaacggccgaactgaaaacgaaaaaagacgaaaaaggcaaagaaaacggctggttcaccgcctatgattacaaaaacaaaaaccttttaatcacgatgatgatcgaggatgtttcagaccgcggcggcagctcatacgtcgttaataaagtgaaaaaagtgtttaaataagcacccttcagggtgcttatttttttgccgaaaactggatgtgtggaatgtgccgaaacggaaaggatatggatgaaacgactaaagaaaggaatgtcattatgaaaagaaaagttgccaggaatgaagcggctcttaacaataaaacgcctgctgaaagcatgcatgatcatcaatacatgacccaatatgacgccgaaaacggagacaggggagccaaccgcaactcgaaacacgggaagcagggagaatcgcaccaatgaaaaaacaccaaaaaagcaaggatatgcaaaaccataaaaaaccgatgaatcccgatgtgcttcaggaggaattttcgaacgaactgggcgatgtcaacgcctttaaatttatcgatgtgatcgagaacaataaaaagaagaacaaaaaggcggacggacagaagcgggataaagataaagaatgaaactgcagagcaaacgagaaaggtccaaatcggaaacgatttggaccttcatttattttaaataagggttatatccgttgtcttttttcaacagccttattaaattcgtcatttttaattcgatgaacggctgggcgaccgttttcacaaatccgcttgataagcagaaggttaaaattgccgtggcgatgaacaatagcgtcagactctgataatcggcaagccattcttccgcgcccgtctttctgaacgacttgatgataaagccgtgcagcaggtagacatagaatgtgcgcgttccccagagggtaaagaaataccgcctttcaggcaccagcgccatgaacgcgaaggttgaggcaaatgttataacgagaagcgccacccggtttaacccgctttttatcccgacatcgccgaattccgaataaggcttggaaccgaacagccaggagtaatcgaagtctgcaaaaaagtagaaaacgaacgttgctgctaaaacggctagagccgcttgctttcctttccagcctttcagcattttaaaatggtctttttgcaaataatagcccgccaaaaagaccggaaagaaaacaaacgtgcgggacaggctgagcgtgttgctgatcatgtcgatatacccgacaagaacggcaatcgcaaagcttgcggcaaacgcccatttcgccggcagttttgtgaacggaaacaacaggagattccaaaaaaacaagctcagcaaaaaccaaagcgaccattgcggttcaaacggatttgcggcagttaagctttgatcatcgataaaggaataaaacagcgtatagattccctggaaaatcaaatagggaacgatcagcttccaggcgatttttttgacatatccgggccgattgaacccttttgcaaaatagcctgatatgagaataaaagcaggcatatgaaacgtgtaaataaatttataaatatgaagcagtgcatcattgtcatgaatataggacctgattatatgtccgaagacgacgagaaaaatcaataggaattttgcgttgtcgaaatagctgtcgcgtgaattcgccataacatcaccctttcgcaaacaatttcaggaggcgccggtgcgggaagcgtctgaacccggctacattctttccggaatgacgtcttcaaccagtcttgcctcattttaaaattttaaaatagaaagcatgtgttttcctatgcattaagtcttattgttaggccgatgtaattgaacagtaaggaacttttatatcgtcatcttcatgtaaaataggcggaaaggttgtaaaagtttgaaacaaatgaaggaagattttccggtttgtagaataattggaggacaggttttcaagaaggagtgtaataaatggaggaaactcttgatttgaatgaatccttaaatctgcaaaaccagctgaacagactgaggaaagaaaacgccaagctgaaagcggatttgtatcagtatgagctgctgtttaacgggacgctggacgctatttttatattggataaacagatgaacatcattaaggcgaatgatgccgcctgcaagatcctgcaaagccaaaaaaagaatttgctgaaccggtcggcgctcgacttcctgcacgccgttccgccggatgaactaaaccagaacattcaccgcttcttggagcggggatatgcgaaaaaagaagtggccatcaggcttgacaacggatctgtcaaatatatcgaatttaccgcaagcaaaggaatcggtgaggactgcttttttgtcgtcatgagagacatttcgtctaaaaaaatattggagcgggagcgcaccatcaatgaaaagctgtttaaagatttgtttcaccgcgcggttgaaggaatcgtcatctttgataaacaaggctgtttcatcgatgcaaaccattcgttttgccagagcttcgaaattgaaaaatcagagctctcaaaactgaagctgtctcaattcgtatcgcctgaaaacaaggggcggctcgataaaatctggaacgctcttttcagaagagggaaggcaaaaggggagcttcctgtccgcctcagatcaggagaagacaggctgtttgagctgacgataacctcgaatattttaaatggcttttacatgtcgattatgagggatattaccgaaaagcgctcaatggaaaaacagctgtttaagagcgaagaacgctttagggaagtctttgaaaatgcgatggatgccatcattctgatgaataacgacggccgcatcgtcaaagcgaaccagtcggcctgcaaaatcttcgaactgccgatggaccagctgctcaacaagaagatgactgattttatagatcgaaccgatcagcggtatcatgccattcaaaagcagtacgatcaaaaaggggaaatccgggcggaactgctgtttcgtatggcaaacggacaatataaggagcttgagttcacatcaaaacggattatgttcgacagccaggacttaaccattttgagaaatgtcagcgacagaaaacgaatggaacaagaattgcgggaaagcgaattgaagttcagaaaagtattcaacggatcaatggacggaatcgttcttttcaacaaccagtacgatattatcgatgcgaacccccttgccggaaaaattctcagcatccctcttgaacagctgaaaacgtccaatcttcttgatgtcatctccggctatcacatcgaaaacgcggcttctcccgctaaaacgatttcctttgaagaaatggacaatgatatcccattcctgctgagcgaccaaaaacggatacttgaattttcatttaagcgaaacatcattcaaaatatgaatctggcgatgctcagagacgtgacggaacgaaaagagcttgaagagcggctccgcaagtctgataccctccatgtcgtcggagaactcgcagccggaattgctcatgaaatccgcaacccgatgacggcattaaaaggatttatccagctgctgaaaggcagcatccaaaatgaggatcacgcgctttactttaatgtcatcacatcagagctcaaaaggattgaatccattattacggagtttctcatccttgcaaaaccgcaggcgattatgtatgaagaaaaaaacatcgtcaaaatcatgcaggacacaatggatctgctgcatgcgcaggcaaaccttgacaacgtccagatgcatctgaagtgcgaagacggcattccgctgatctactgcgagccgaatcagctgaagcaggtatttatcaacattttgaaaaatgcgatcgaagtaatgcccgacggaggcaatgtatatgtgtcgatcaaaccgaaaggagacgaccatatcattgtctcgcttgctgacgaaggaatcggcatgacagaagacaaattgaagaggctcggcgaacctttttacacgacaaaagaacggggcactggactcgggctgatggtcagttataaaattattgaagaacataaaggaaaaatcgaagttgaaagtgaagaagggagaggcacgacattccacctgactctcccgatcagacagcagcatgaggaggaggcttaatcgcatcgtgggcttttatattgaaatgacctcgccttttggacaagcctacatcgtcgaggaaaataaccatattacacatttgctatttgaaaaagaagaactaaaacagcttcaacaagacggcctggagcttcgcccggccgaaacggaattgttgaaggaggcaaagcgccagctcgaagaatatttccagggggagcggaaaacgttcacccttcctctccgccaggatggaaccccgtttcagaaaaaggtgtgggaggcgctgcagtcgatcccgtacggtgaatcacggagctatttagacatcgcatgcgccgtcgggaatccgaaagcggtgcgcgcaatcggccaagccaataaaagaaatgcgctgccgattttgatcccgtgccaccgtgtcatcggcaaaaatcgttcattgacggggtattccggaaatgaaacggataaaaaagcggtgctgctcgacatcgaaaatattgcgtataaaggaaaataatatacgagcacgccgtttctttttttcgtccgcgacatataattttattaagttaaaaatgttggccttggtaaaaaaggaggacgaataagtgaaaacaaaccgcccgaaaaaaatagcaggatacgcggaattgttcgtcaagctgcacgttttgaccgaagagcaaaagaaagacatcatcaaatcgattaaaatccgctaaagcggcctaagtaagggcttcagcggaaaacagcgcttcgatttcttcttcaaatctatctgtgataatccctttttccgtgatgattccagagattaaatcgtgcggcgtgatatcaaaagcaggattgaacacaggcacctcttgcggcgctatttgcgttccgtttatccgtctgacttcatccggatcgcgttcttcaatcggaatgtcgtcgccgcatgaaatcgagacatcaaaagttgacaggggagcagcgataaaaaacgggatttgaaaggctttggcgaggattgccaagccgaacgttccgattttattggctgtatctccgtttcttgcgatcctgtccgctccgacaatgacggctgaaatgttcttttccttcatcgtatgggcagccatgctgtctgtaatcagcgtcacgtcaatccccccctgcataagctcccacgccgtcaggcgcgccccctgaagaacaggccttgtttcacaggcgtaaatatgaaggtcgagatcctttgttttggcaaggtaaaacggggaaagggccgttccgtacctgcttgtcgcgatcgagccggcgttgcagatggtcatgatgctgtcgcccgatttgaacaaatgcagagcattctgtccgatctgccggcatgtttcttcgtcttcaacctggatctgaatcgcttcgtggacgaggtttgtttttgcctcattgaccgattttgcgccctctgcgctttttaacagccgattgagggcccaggataaattgacggctgtcggccttgcctgattgagttcatctttgattttgcggagctcccgcagaaaagcggaaacatcagatgtatcgatgctttgtgcgcaaagggcgagtccgaaggcggctgttatgccgatggcaggcgctcccctcacttttagcgtttggatcgcatcatagatgtcttctttagttgtgagatgcaggtactccgtcttttcgggaagcttttgctggttcaggatttttaccgatgtttcttcccattcgacagaacggggcaccgcaaattgttccggcatgtcattcactccttaagcgcgtttcgaaacgcttcaatcatgtcttttggcgtccggaaaccgctgcgtttttctatgaatgctgcgcctattttaagggcgagctttttttggctgattctccgggaaaatggaacgattgtatcaaggtccgcaacatgggcgaggccgatcgtccggcggatcatttcgcagccggcgaagcctgctgcgtcttcaaacgcctgtctcaggactgactcaaggcgcccattctcatgtttgcaagtctcaacagcatcgttttcccatgcttcgctgaatgtccggctgaacgtattccagacggtctcaacatggcggtataaaggagcccgcctgttttcttcgcgagaaagcgcgtttaacagcaggttggcgataaactgtccgatgtcaaacccgatcgggccgaaaaacgcaaactcagggtcgatgattttcgtttcgccatcttcaccggcgaaaatgctgcctgtatgcaggtctccgtggatcagcgtttcctccgctgataaaaagcgctgcttcagttttgccgcttcaatttttagcgcttcattgccccaaagaacttctgcttcatcgcgaagctcttcttcgaaatcgttcgtctcatggtcaaagaaagggtctgtgaacacaaggctttctgtaatatcgcacagatccggattcgtaaactgcttcacaagccgctctttaaccgttgggtcaagcgcatattctgatgagtaaaaatgcgtttttccaaggaattctccgatatcttccgacagatgcgggtaatccttcccgtcaatcagtccgtttctggcgatttccaagtgagaaaggtcttccaatacggtgacggcaagctcggtgtcagaatagtacactttcggaacaaggtgcggaacgtgctcagcctggcggatcagcgcactgctttcgattcttgccctgtcaagcgtcagcggccagctttcgccgacgacttttgcataaggcaccgcctgcttgatgaccaatcctctttgctgctctttgtcataaacgcggaagaccagattcaggtttccgtccccgatctctcggcatgtcagggtgcttttgcttggaaaaagcccgagacggacggcaagcgcggccgcggagctttcagtcaaagtttcgtatgctgcggtttttgttacggtcatgtgtgattccccctaaaatgtcgttaacaaataaaaaaacctctttctcgtcgagagaaagaggctgatttgtcgcgtacgcctctcttatctctcagaattcaaagtctgatggaattagcaccgtgccctagcggcgcagagattcgcgccccatttcacaatggtattacggtcggttgctgttgggatcattaggccagtccttcacccaactctcgataagagaaatcaatataaaattttgaaatttcagttcggtcagttgctgaacatgttaccagcatctccgttttcttgtcaacatttttttaatataaatctttgcgaatgtcctcaaaaaccggaatttgcccccgcgctttttcaatgtcccttaggtcgatttcggccctgatgaccgcttctccgcgtcctgcttcagcaagggtgcggccgagcggatcaatgactgtgctgtggcccgcaaattcgtttgccgggtcttttcccgaacgattgcaggctgcgacaaagcactgattttcaatcgctctggcttttaaaaggctttgccagtgatcgaggcgggcgagcggccactccgccgatacaaagatgatgcccgcaccttcgctcgtatgttttctgatccattccgggaaacggatgtcgtagcagatgaaccccgcagccggcatcccttcaagctcgaagcgcccgtcgcctgagcccgctgacaaatagaggtgttcgtccatcagctgaaaaaggtgagctttgctgtattctttgatcaaatgtccgtttttgtctgcgatgtacatgatattgtacacaccgctttttttcttgactgcgactgagccgcatacgatatggatgcggtttgcttttgccgtttcctgcagccatctcttcgtttgcctgccttcttcatccgcgatggagccgagattttttaaatcataacccgtcgtccacagctcaggaaggagaaggatatccgccttccggctttcctgctcgatcagctgctccgcttttttgaaattttcagaaggattgccgtacgcgatatcgaattgcaggcatgaaattgtcagcttcactctggatcacctcatttttttctttacattttacatttaacaatatatgatgatggactatcatttcaagaatttttcaaaagcgggtgaatcgtatgaaatttgagcattcagatgtactgaagcagctgccggagcagtttttcgcttccttggtcaaaaaggtgaatgaaaaaattgccgccggccatgatgtcatcaatctcggtcaggggaatccggatcagccgacaccggaacatatcgttgatacaatggcgcaagccgtccgcaaccctgaaaaccaccggtattcttcctttcgcggcagccgttcactcaaggaggcggcggccgcgttctatcaaagggaatacggcgtagagctcgatcctgaacgcgaagtcgctgtattgttcggcggaaaagccggtcttgtcgaacttccgcaatgtttgttaaatccgggggatacagtgctcgttcccgatcccggctatcccgactactggtcgggcgttgaactggcaagagcgaacatggaaacgatgccgcttacagcggacaatcagtttctgcctgactacagccggattcccaaggaagtgaaagaaaaagcgaagctcatgtatttaaattatccgaacaacccgaccggtgcccaagccacatctgcttttttcgaagagaccgtccggtttgccaagtcgaacggaatttgcgtcgtccatgattttgcctacggcgcgatcggctacgacggcaagaggcctgtcagctttctcgaaacggcgggagcaaaagacgcaggaatcgaaatttacacgctttccaaaacgtataatatggctggatggcgggtcgggtttgcagtcggcaacgcctctgtgatcgaagcgctgaacctttaccaggaccatatgtatgtcagcctctttaaagcagtccaagacgccgcggcggccgcgctcctatcagatcaagcgtgtgtccaggagcaaaatgagcgctacgaaaaaaggcggaatgcatggatccgcgcggtccgcgatatcggctggcatgcggatgctccgcaaggatcttttttcgcctggatgcctgttcccgacggctatacatctgaggctttttccgatctgcttctcgaaaaagcgaatgtcgtcaccgcgcccggcatcggcttcggcaaacacggggaaggctatgtgagagtcggcctcttgacaagcgaagagcggctccgggaagcggcttcgcgtattgccgagctgaatatattcaaaaagaccggccacagtcattgacaaccgggagaaacgatgggataattcaaaataatttataaaatcaatattcttatcaagagcaggcagagggacaagcccgatgaagcccggcaaccgactttttaagcacggtgctaattcttgcagctgacgctgagagataaggattcgaacctgaaaagcgaaacctcttttagctaaagcagcaaaagaggtttttttatatgcatgaagcaggaaggagctacagaatgagtgaacttttggcaacatatatcttggccgatccaggctgtgacgcagaaaagcgggccgagcaaatcgcgatcgggctgacggtcggatcgtggacagatctgccgctcttaaagcaggagcagctgaaaaagcataaaggacgcgtcgtcaacgtcgaagaaacagaaagcgagctgggggaaaaacaggcaacggtcaccatcgcctatccggaagccaattttacaaacgacattcccgctgtgctgacgaccgtttttggaaagctgtctctcgacggaaaaatcaaattggcggatttggagttttcgcggtcttttaagcaatctttgccgggtccaaaattcggcgtatacgggatccggaaaaaaatcggcgaatttgaaaggccgctgttgatgagcatttttaaaggcgtcatcggccgcgatatggaagacttgaaggaacagctgaggcagcaggctcttggcggagtggatttgatcaaggacgatgaaatcctattcgaaacaggcagtgccccctttgaaaaacgaatcacggaaggaaaaaaagtgcttgaggaagcctttgaagaaacagggcgcaaaacgctgtatgccgtcaacctgacgggcaggacaatggagctgaaagcgaaagcgagaaaagcagccgagctcggagctgatgttttgctgcttaatgtgtttgcctacgggctcgatgttttgcaaagctttgcagaagacgatgacatcccgctgccgattatggcgcacccggcagtaagcggcgcacttacttcatcgccgcattacggtttttcccattcgctcttgctcggcaaactgaaccggtatgcgggtgccgatttcagcctgttcccttctccgtacggaagcgtcgctctgccgaagcgagatgcgcttgccatatacgatgaatgcacgaaggaagacgtctttaaaccgacattcgcggtgccgtcggccggcattcaccccggcatggtcccgctcttgatgaaagactttggcattgaccacatcatcaatgcaggcggggggattcacggccatccaaacggggcggcaggcggaggaagagcgtttcgggcggtcattgatgccgtcttagaagcggagcctgtcgaagagaaagcaaagcgctctcccgatttgaagctcgcccttgaaaaatggggaagggttgaggtctctgtatgagaaagccgcttatcatttgcgattttgacggaacgatcacaacaaacgacaacatcatcagcattatgaaacaatttgctccagaagaatggaccgctctaaaagacggggttctgtccaaggacatatcgattcgggacggagtcggcagaatgtttaatttgcttccggccagcctgaaagaagacattacggcatatgtactgaaacaagccgagacccgccccggatttaaagaatttgtttctttcctggatgagaagggtcttccgttttacgttgtgagcggagggatggattttttcgtctatcctctgcttgaaggaattgtcggaaaggaccgcatttattgcaacgaggccgctttcaccagccgcaatatcgagatccgctggccgtatccgtgtgacggcggctgcggaaatgactgcggctgctgcaagccttccatcatccgccggctgaaaggccgggacgatttcgttgtcatgatcggggactctgttacagatgttgaagctgccaaatgttccgatttatgcatcgcgcgcgactatttgctgcgggaatgtgaagagctcggcttgaagcatgcggcattcggcgatttccgcgatgtaaggcgaatactcgaagagaccgcggaggtgaaagaatggatgtctgagcaaaaacggcaggaactagccgaggtaaaaaaagagcttgcggaaagggattggttcccggcgacaagcggtaatctgtcaatcaaagtatcagaagacccgctgcggtttctcatcacagcaagcggaaaagataaaagaaaagagaccgaggaggattttctcctggcggacgaagaggggaggccggcggagaccggacacgcgctgaagccgtcggcggagacgctgctgcacacctatgtctatcaacacacaaacgccggctgctgtcttcacgtccacacggttgacaacaatgtcatctcagagctttatgcaaaagaaaagcaagtgacattcaggggccaggaaatcataaaggcgctcggactttgggaggagcacgcggaggtcacggtcccgattatcgaaaacagcgctcatattcctgatttggcggcggattttgccgggcacctttcaggcgattcaggcgcagtgctgattcgcagccacggcattactgtctggggaaaaacggcatttgaggcaaagcggatgcttgaagcatatgaattcttgttcagctggcatttaaagctgaaagctttgcaggcttatcacgtttaactaaaaaagggggagaaagcatggcgacaattcggatccatgatgaacaaaacacgagcattgaaaaccaggaagaagtagaacaatttctaaagcggcaggaggtcatttatgaaaagtgggatatcacaaaactgccggccggtttaaaggaaaaatacgatttgaccgatgaagagaaacaggagattttagacgtctttgccgctgaaatcaaagacatttcagaacgccgcggctataaagcgagcgatgtcatctcgctttccgaccaaaatccgaaactcgatgagcttttgaaaaacttcaaacaggagcatcatcatacagacgatgaagtcaggtttatcgtcagcggccacggcatctttgcgatagaaggaaaagacggcacattttttgatgtccttttaaatccgggggatttgatctctgttcctgaaaacacccgccattatttcacgcttcaggaagaccggaaagtcgtggctgtcagaatctttgtgacgacagagggctgggtgccgatttatgaaaaagagaatgtgaaccagtcataaaaaaagcgtccccggggacgctttttatttgtttctgtcataaagagccttgatgtggccttcatgaaatgaaagatgcggtttttcattttgatagtattgaagacggtcaaatacagagcctgtgtgaagctcgaacttatggccgtctggatctgagaaataaattgaatctctgtctccttcatgccgttttctgcccttcagcacattaacgcctaaatcgtgtaatttcttttcccagaacggcaaatcttcctgttggatcgaaaacgcgatatgggtgtaagagtcgtggatttcctgtcttttaatgtctttctcttcgttgaatgcgagccagatgccgttcaggtcaaaataagcggttttctcggcttttacgagccacttggcatcaaacaccttttcatagaatgaaatagagacggacaggtcagagaccgaaaacaagagatgattgatgccgaggattttattgttttccattgtaatttactctccctgttagatgtgtttcaaacccgtccagctctttggtgatttgcctgaagagaaaagcgagcacagccgcatcatcaagccagccgacgcctgcgagaacatcggggatcaaatcgatcggtgacagcacatagataaatgccagcgcggccagcaaaattgtttttttcgggaataaggggtagtctccctttctccaggctctaaatgccctgaaaaacaataagaggcctgaatatgcttctttcacggcaaagacggttcggagctttgaaactggttttttcatcatttggcgcatcattggacctccttctatccgtatgaactcttttaaaggtggtttaccatatttcatcgatgggtataacaccattaattccacaaatctattatactcgatttcaaaatatttttttcggaaataggtttacaaaataagtataatctgtaataatgctcaagtacgcaaaatctggatggttttaagaaacgatatgttggtaaggggtgaagcgtatgcaaaggtatattgaaaaagaagcattgctcgtttccatcagcaagaagcggcaaatgatggttgaagccgctgaaatctatggatatacaggggatgaaacgatcaggcggagccaggagctggatcaattaatttatgaatatcaaaaattgtctatgaatgaaaacgcgccagacaatctgctgcaagattttttaggctgcatcgactgtctgcccgttgaaaaatatacggcatagcggatgaacgaaaaagagctgccgtaaggaaggcaggctcttttacaggaacggggaaacctcagtcgtcctgttcctttgaagtcggcagcgtaatcgttacagtcgttcctttatgccgttcgctttcgatatgaatggttcccccgtacatggaaatgatgcgcttgcacacgacaaggccgagtccggttcctttttcttttgatgtaacaaaaggctggaaaatactttccatcatttcttgtggaatgccttctccgatatccttcacaataatttgcgccttctcttgatcatgttcgatttgaatgaccagctttccgccgtttttcatcgattcaagagcatttttggcgacgttcaagacaacctgcttaatatgatcctttttacaatacacataagccggatcttctccgcagtcttgaaattccacttccacattatataaatttgcctcagaatgaataatcggcatgatctcgtcaatcatttcattcatggagttgagctgccactgctctgccgtcggctttccgagcacgagaaactcgctgacaatctggttgatcctccggatttcctggtcgatgattgagaaatacatttgatcttcttttgattgatattttttttgaaggagctggataaagccgctgatgcctgtcagcgggtttctgatttcatgagcggtgctcgccgccaaggtgccgattaattcgagcttctgcgcttcattttgggcgcgctcctgcttggtccgccgcttcagcaggacatactggagcaggaggaacataatattcagcagaatgaaaatactcaaaaatgacagcagaagactgtgaacgatttcatcaagctggaccggttccggatagacttcaagcttccagtcgatctggtccaaaaaagcgtcgacggtaccgccgtccggcttctcaggaggagaatggcctgccgtaaagacgatctgattcttctgattgagaattttgatataaagctcagggctcaagacgttcatgatatttttcagataatcgacgcggatcgaagcgagcagaaaatttgttgttctcccttcgctgtcaaagaccggagtaaaaatattcagctccagcccgtccgacactgtatgtatatcgtctgtgatcacggatttctttgatttttccgctttttgcagaatgctcttgtaagaaagcgcctttttttctttggcgggagacgtgctcaccatgacatcgccgtcttcatttaaaaggtataaagccgaaaaacgcggttcttttttatacgtttccgtcaggattcgtttgatatgctgctcattaacagggtggttgagggccgtggcaagggagctgagccttgcttctgtttcgccgatcaggtaattgatttggttgcggtgaatattgagcatgagagtcgcagtctgacggtgcttttcagtgatattttctcgttcttgttcgtatacaaaaaagcttataatgaaggcggggatcatcaccaagatcaaataaagcctgattttcttccatatacttttcaaattgcgcatgtttttactctctcccaatcgatacaggaatagaggtattatatcactagtgagagccgatttatagaaaagataaccaataccgtgaaaataggacacaatgccggggaatttccggatatatctatttgctgttcaattcctactcatcataacatggtttgaatgttaacagttgacattttcctcatagtttattaatgttttcctgtagttgtttctttggagatgagtgatatgagtaatagagaacaggaacagtccttgaagttatttattgtattatctcgagcgtacagatccattaatgatcatatgaataaacatattcatcatcatggtctgaatccaaccgagtttgccgttttagaactcctctatcataaaggggatcagccccttcagcaaataggggataagattcttctggcgagcgggagtattacatatgtggttgacaagcttgagcaaaagcagctgatcacgagaagagcctgtacgacagaccgcagggtgacctatgcgcaaattacagataaaggcaccgagctcctcgagaagatttttccgggtcatgcagaagagctgcacaacatgatcagcgtattaagcgatgaggagaaagaagcctgcatcgaaatgctgaaaaaagtcggactgaatgcaagaaatatttataagggcaaagagtaaggaagctgccaaaagacagcttccttattcttttttattcagattttcctggccgatcggcaggataaggatttcaacgcgtctgttttttcttcttccttcttcggtgtcatttgaagcgatcggtttaaattccccgtagcctttcgcgctgaagatcttggcgtcaagctttggattttcgattaaaagccccatgaaattgacagcccgcatcacgcttaaatgccaatttgatttaaattgagaatttcgaatcggcacattgtccgtatgcccgctgattacgatattgcggggcgggttcaatacgagaaggtcggatacttccttggccagcggaatgtcctgctggcggatctccgcttttccggaatcgaaaaagatattatcctcgatggaaaggaggaggccctcgtctgtcagcttcgtattgacctgtttttgaagattcttctctttaataaaccggttgacctgctcctgaatttttttcagcgactgcttgtctttttctttttgagcttcggagagatcttttgcctggtcagggctttttccatcttcggttgtgctcgttttcggctcggtgaagctggaataatccatcattcctgttccgccggtaaatacggcattaaatgattttgacagcatatcgaacttcttggcgtcgatcgagctcatggcaaacagtacgatgaacagggccaaaagcagtgtcagcaagtctgcatatgggatgagccaagactcatccacgtgttcttcatggtcttttttgtgcttcttttttctagccattgctgctgtcccctttgtctccatctgggatgacgatgctggagcgttcgcttggagaaacgtacatcaaaagcttttgttcaatgacttttggagcctggccttccaagatcgaaaggatgccttcaatcataacttcgcggactttgacttcctgtttggatttccgctttaatttattggcaaaaggatgccatagtacatatccggtgaagatcccgagaagggtggcgacaaaggcggcgctgatcgcatgtccaagcgcttctgtgtcgctcatatccgcaagtgcggcgatcagtccgacaacagcgcccaaaacgccgagtgtcggcgcatatgtgcctgcctgggtaaaaatacccgctccgacttgatgcctttcttccattgcttcaacttcttcagttaaaacgtccctgataaaatcggcactttgaccgtcaaccgccatgctcatgccgtttttcaaaaattcatcatcgatctcattcaaatttgcttccaaagcgagaagtccttcgcgtcttgcgatttgcgcccactcggaaaacatcgggatcagttcgttgatttcgatcatcttcttctctttgaacaagatgccgaagagtttgggaacctttttgagctcgcggattggaaaagcgatcacaactgctgcgattgtcccgacaaggatgatcagccatgccgcgggattgacgagaacggaagggctgacacctttcatgaccatgccgacacctactccgatgatagctaagatgattccaattaacgatgttttgtccattttttcaccaattcctttaactaacttttctatcgttaatatcggtgttgcgtgataggaactttaggctgtttcttaaattgttgcaaaatcatggtgaaaagggactttagggttatttaatgttaaaaaatagaacttttgtgattcttatgttgtatgtaaaacgacctccgcgatcggaggccgttgtgtgtgttatctggttgttttcacccggatttcatcgttttcaacgataaccgcaaaacctttgatgtgttcttcttcaagcagcagatcggtcatttgatcttcgaccgctgtttgaatggttcttcttaatgggcgggcgccaaaggccggatggtatccgatttcagcgattttttcttttgcctcatctgaaacttcgagcgtcatgttttgctcttttaacgtttcttcaagctctttcagcaagagggcggcgatcttgaccagatcttctttttcgagcggctggaattcgatgatgctgtcaaatctgttcaggaattccggcttaaagtagccgcttaatgaatcgatcattgattgttcgcccattacttgctcttcccggttaaaaccgacggttgtccgcttttcagatacaccggcattgcttgtcataataatgacggtatctttaaagctgaccgtccgcccttggctgtctgtcagacgtccgtcttccatgatttgcaggaacatgtgctggacatcgggatgggctttttcgatttcatcgagcaaaacgatgctgtacgggttcctccggactttttcggtaagctgtccggcttcttcgtggccgacatatccaggaggcgaaccgatcagctttgatacggcgtgtttttccatgtattcgctcatatcgaggcggatgatggcatccttcgtgccgaacagttcttccgcaagccttttagaaagttctgttttaccgacacctgtcgggccgacgaacaggaatgaaccgacaggcctgttttttgatttcaggccggcgcggcttcttctgacggcttttgccacttttttcaccgcttctttttgaccgatcacgcggcttgaaaggtgtgcttcaagctctttcattttcttctgatcgtcgtgctgaagcttgccgaccggaatgccggttttttgttcgatgatcgcttgaatgtcttccgcttcaactgttgcccgtttttcttcctcatggctttccatttttttatgcagcgcttcttcttcgtcgcggagttttgctgcaagctcgtagttttcttcttgaagcgctttggctttttccgcttcgatttcttgcaggcgttgggaagcttgttcaccgctgaccgtgtcgattttcaagttcgcttttgaaccggcttcatccaaaaggtcgatcgccttatcgggaagatggcggtcctgaatatagcggcttgacagaatgacgcaggctttgatcgcttcatccgtgtaagtcacatcgtgatatgcttcgtatttttccttgagcccgtttaaaatcgctgcggcctgctcaattgtcggttcgtgcaccatgatcggctgaaagcgccgctctaacgccgcatctttttcaatttggcgatattccttcaacgtcgtagcgccgataacttgcagctcgcctctggcaagtgcaggttttaaaatgttgcccgcatccatggagccttctgcagagccggccccgacaagaaggtgaatttcgtcaataaacaagattgcgtttttgcgttctttcagctctttcatcagctgtttcattctttcttcaaattgccctctgatgccggtgtttgccacgagggaagcgacatcaagcaggtagagctctttgtttttcaatttatttggaacatcgccttcggcgattttgagagcaagtccttcagcgacggctgttttaccgacgcccggttcaccgattaagaccggattgtttttatttctgcggtttaagatctcgatcacacgggctacttcatcatcgcggccgatcaccggatcgatcaagccggtctttgctgcatttgttaaattgacggcaagttcatcgagcaagccttttttggcagcggtttgcgtctgcgcttgtgatggctggctgaagaaagaacctccgccgccaaaaaagtgatttcctgaaaacatagaaggctgagtcagctctttatagcagtcttcacataaatccatttgtttttttgtaaagttgatttgcatgtttaggcgaatcgtcgcctcatttttttgacaatgttgacaacgcatttgccaaaaccccctttattgaatttgaccttttttgaccaattgacttagaaaaaatggtctgcagtttgaccatttctgactattagtatacattgaccttctttgactttcaagttctatgctttttcctttttgttcctggatgagaagttgtccttctttttgaaggacatggatcatatggtgtagaaagggaattcgcttacggaggagtcgtatgagtcaatcacaaggatcagcctttcagctggcatttgtttatgtaggaacggttgtcggagccggatttgcaactggaagagaaatcgtcgagttttttttaagattcggctggccgggattggccggaattttgatcagcggactgatgtttacgtttctcggtgcaaaaatgatgctgattgcggtcagaatcaatgccaagtcttatcaggagctgaataaatatttattcggccatacgcttgggaaatttgtcaatgtcttcatgctcgtggttttgctcggcgtgacgtccgtcatgctgtccggagcgggggcgatatttgaagaacagctcggcttttcaaaccaagcggggatgattgcgacgattgccttgagtctgtttgtcatgatgaagggcgttaaagggatattcggcgtcaatgtcattgtcgttccgctgctgcttctgttcacagttgtcgtcctgtttgactcgtttattttcagagggccggagatacacaatttggcggcattttcggcaaaccccgattggattttatccgctgtctcgtacggcgcttttaatttgtcgctcgcacaggctgttctcgtgccgatcgcttctgaactgaaatccgaacgcctgattataaaaggagcattaatcggaggggttctgcttacccttgtgttggtcgcaagctttctgtctctttcaacattgcctgatgcccttttatatgaagtcccgatggcacaggtcgtattcatagtccagcattctgtccatatcatctatctgtttatcattttcggggaagtcttcacatcagtcatcggcaatttatacggtcttgaaaagcagattaatgaatatattcatataaaaagcctgtatgtgtttatcttcatcctgctgacaatctacttgacgggacaaatcggctacggaaagctgatatcgaccatttatcctttgttcggccagctgagcctcgtctttattttctttctgatcgtcaaaagggtgcctgagcgatgactggcaggcattgcacttggcgaaacgtgcgatttgtgataagatggcgaaggaaaattgaaataaaatccgcttgaaactgcgggagaggttctagcaaaaccctctataaaaaactaaggaaagctgtatccttggggtatggccttttttattgtttttttgctagagcacctttctcacagagaaaggtgttttttcgtttagatatcattgaatctcttcttttatgaaatggtgacgaaaagcggagaaggaggaactatgaaacaggaaaaagcgatcgtcgtattcagcggcggtcaggacagtacgacttgcctattgtgggcgcttcggcaatttcaggaggtggaggcggtcacgtttcaatataatcagcggcacaagcaggaaatcgaagtcgcgaaaaagatcgctgcaaagcttggcgtcaagcatcaccttcttgatatggaactgttaaatcagctcgcgccgaatgctttgacaagggatgatatcgagattgaggcgaaagaaggcgagcttccgtccacttttgttccgggacgcaacctcgtgtttttatcgttcgcttcgatcctggcctaccaggtcggcgcgcggcacatcattacaggcgtatgcgagacagacttcagcgggtatccggattgccgtgatgagttcgtcaaatcctgcaatgtcactgtcaacttggcgatggagcgcccgtttgtcatccatacgccgcttatgtggctgaacaaggcggaaacgtgggagctcgccgatgagcttgatgcgcttgatttcgtgaaaaacgagacgctgacgtgctacaacggaatcattgccgacggctgcggcgaatgcccggcctgcaagcttcgcgcaaacggctacaatgaatatatgaaaatgaaaaaggagcgagcttaacagtgcttacacaaatttatccgcaaccaagccatccttactcttttgaattaaataaagatatgcaaatgtcagctgcacattttattccgagagaggatgcaggcgcatgcagcagagtccatgggcatacgtatacaatcaatattacgattgccggggatgagttgaatgcatcaggtttccttgtcaacttcagcaccattaaaaaattgatccacggagaatacgatcatacgcttttaaatgatcatcaggaattttcaggtgaaagcgcggatcggatcccttcgacagaagtcgtggccaaaacgatttacgataaagtagaggcttatttgaaagatctcaacaaccgtccgcattgcgtccaggtgtttgtcagggaaacgccgacaagctatgtcgtgtaccgtccgaaaccgggtgttcagcatggctaagccgattcccgtacttgaaattttcggtccgacggttcagggagaggggatggtcatcggccaaaagacgatgtttgtcagaacagccggctgtgactattcgtgcagctggtgcgattcagcttttacctgggacggttcggcgaaaaaagacatcaaatggatgaccgcggaagaagtgtacgaatctcttaaagacatcggcggaaacgcattctcgcacgttacgatttcaggaggcaacccggcgcttttaaaacagctggacggactgatttcccttttaaaagaaaacggtatacggacagcgcttgagacgcaaggaacgttttatcaagactggtttaccggaatcgatgatttaacaatttcgccaaagccgccgagctccaatatgaaaaccgattttaacaggcttgatcatattgttgacaggctgaaggaacacggccgggcggctgcggcaagtttgaaggtcgtcattttcacggcggacgaccttcaatttgcaaaacaagttcaccagcgttatcccgatatcccgttttttcttcaggtcggaaatgatgacgttcatacagaagaccaagagcggctcgtcgaacggctgctccaaaaatatgaacagctggtagaagcggtcacgcgcgaccctgaattgaaccgcgtccgcgttctcccgcagctccacaccctgatctggggaaacaaacggggtgtttgatttaagaaaggaagatgaatgatgacgacaagaaaagattcagaactggaaggcgtaacccttcttggaaatcaaggcaccaattatttgtttgactattctccggaagtgcttgagtctttcccgaataaacacgaaaacagggactatttcgtgaaattcaactgccctgaattcacatcgctgtgcccgaaaaccggacagcccgattttgccacgatctacatcagctacatccctgataaaaaaatggtagaaagcaagtctttgaaactgtatctcttcagtttccgaaaccacggcgattttcacgaagactgcatgaacatcatcatgaacgatttaattgagctgatggacccgcgctatatcgaagtctggggcaaattcacgccgaggggcggaatctcgatcgatccgtacaccaactacggcaagcccggcacaaagtatgaaaaaatggccgagtatcggatgatgaaccatgatctgtatccggagacgattgataatcggtgatgatgaagcgaaggtttgtggtcgatgtgtgaccggtcacagtaaaagtgtgactcgggtgtgacccgaaaatagcgaagtgtgacccgtgaaaatacggtattttgtatagaaataatggtcgaggggatagaaatgtttgtgacctagacgtgcaattacgcacgtctatttttttttcatgtagaacgttcctacggtatttatctcgcgcatacgcggtatttaaaaggcgtatatgattccggaacactcgaagaaatcggcctatagttgcggtacgtcaaacgttcattgcaacgaaacgaaagcatattcggaatctggccggctattataacggcgtgcttgatcggatattagatcgcctatatgaaacgcgttttaattcgttaatcgaagggtgaaagggataacttcgccattcgcctcgttaacgtcttcgttcgctagttcgtcgccaacttcgcgatctctttcgttcgggtttcgttaattttcgccagttattcgtcttgtttcgttcgtttattcgtgaaaaatactgctttattctcgttttaaaagagttatttttcggttttcacttgaagtgactaaataattcagttattctgacaatgaggaggggatgagatgtatatgcgggggagacgaagaccggcgattaaacatagtgagaaaaatacatacgaaagtaagactctgtctgatgtgtgtaaacaaatttgtaacgtaaaaatgtctgaaggacttacgaaagaaacaattgatcgctatcgccgggtttgtgagagtgtggaagaattcgcggaaattaaaggactgtccaccagtgttgaatctatagatgtcgagtttgcgaggcagtacatgacctatatactgcacgagaagaaaacgtttaagggacaccgttataaaccagaaagtgtgaaaactccagggtgttctccgaaatatgcaaatgaccacctgaaaactatgagagcagtttttactttctgtataaaggaaaatatgatttcggaaaatccatttcaaaaaataaataaagtcaagcagccggaacctgtaattcaaatattatctgtagaggagatgaagcagcttttaaaaacaccgaataagcgaaagttctctgagtttagagattacgtggttatgatgtgtttaattaactctatgtgtagaatcggagaaatcgtcactttagagatcgaaaatataaattttgagttgagctacattattcttgaagctcaaaaaacaaaaacgagaaaaggccgtatgattccattagataaaaatacaatgcagctgcttaaaaagttattgttaagaaatacgcgatttaagcctagcaagtatgtcttcattacggaggaagggacaagattaacgaccgacaattttagaaaacggcttgcggattacgctcatcaggcaggaataaataaaagagtccatccgcatttatttagacacaccgcggcgagcatgtttttgcaggcaggaggggatcttaggcacctccagacgatcatcggccataaagatttacgtatggtattacgatatactcatctgtcgttagaatccctcgcaaggcaacagagtgaatattcgctaataaaccaagtggtagatgggttaaataagccaaggaagacaaaaagaaaatacggaaggtaggaaatatcgtgactcaaaagaaaaaaattttctcggtagaagaaagtcttcctgatctctctggaatgtttaataatatctcggcatcgccaaacccaaagcaaattacaattgaaaaagcacttacaattattctccgacagatggaagtaagcgggaatagggagcggacaattagcgattaccatcttcatgtatcacattttaaggaatcagaagaattaacatatctacatgaaattacatataagtcgattcattcatggcttggaaacatggatgtcagtgcacaaacaaggctcacgcgtttgaaatgtctcaaagcatttttatcgcgttgtttcgataatggatggttcgaatcgaagttttggaagaacgtaaaggtgaaggtcgacaataaagttaaagagggggcgacggatcaggaaatcaaaatcttactttcgttattagatttaaccgactttgtacagctacgtgatgcgacagcattgcttcttatgtataaaacaggtatgcgtgtagggacgctcgcaaacttaaaagaagaacatgtcgattttaatggagaattacttcggttaagtggtgaaatcgttaaaaatcgagaacctttactactgccctttgatgagactctcgctcaacttctctctgtactggtgaataaaaacgccgaaatccgccgagcatataagaaggacaataaatttgttttttaacaaagtacggcaatcaaatagcaacagggccgtcgaataacaatattcaaaaacggttgaacaggtatgcgcgcgagtacggattaaagaatataaatccgcacgcattaagaaggggctttgcgaaatccttgcttgaaaaaggcgcaaatttaactgacatttcaagagcgctgggacatagtgatctttcggtaacgactaaatatttatatttagataagaatgaagtggccgagaatttgcgggggtttttgtgaagaaaggtcggcagcgaaccggaacgatatacgtttaatcctaacgtgttttatcgtcagtcaaaggcgccggataagacgctacttgcgatgtttaacgttaataagccgtagatgaacgaaaaaaaagcgccttagactggcgcctctatctcgtcttaaatccgttcacaaagctctctccgtctttctccgtgttaataagctgctgggcgctttggctgattcgttgagcaagcgcctcttgcgcttttccttcgaagctgtagagaagcgatgaataaacgctgttcatttctttttgtatatcgcctattttaaacttcggtcttagtgtcgttttaatgccttcaagcttagttgcggccgttactctcatgcccgttttcagcatttgaagctggttgcgccgtatgaagagggtatcttcttgatctccgtttaagttgttgagtgaagccagtttgttgaaattttccattgtttcatctcctaaagtttaagccaatttgccagcattttatctttcgatttaaaatcttttgcaatctgcgccaggtacccgctgatgtcttctaaatctgaaatcgtattttttaatgaggcgatgtacgctttttcggcatgaacatcgtaaaatagcggattgccttttttgtcaaacgactgcgccaggtttttcagcgtattgtttacatcctcgagtgtcagcttgtcgtataaaccgtggccgacctgacggtaggtatcgtgcttcaggtcgttgatctcggcgtcgtgttcctgataagcgttttcggcttcccgtttcatcgtccgcaagtcatcgatgatcgcatttactttttgcgcgagctgcttggcaacttcgggtgttactttaattgcgccacttccggaggcaacttccggtgggagcatcgcttttaaatttttgtcataaacgagttcatcgccctctatattttgaacgttgccgttttcgtcgaaagagaaattcgacttatttatcccatgtgtatccggattttgaaagattagtgtattagcgaaatacagaaggtttcttccaacctgttggagtttattgccgtcaagtctttcttcgcgattagccgttgcaatagaagggtcttttgtgtagatggtagtcccattgtggcgatcgaattcgtcccaccaaccggcaccgaccatatcatccggattaatgatagattttacataagagttataatctccgttattaatttctttctgtttttcatcagaatgcaggtgaacgattgaggggctattaaacgcgacggcatagatatcattgttgaccgcgctgtattcagcctctgcgccgccgagcgagtgtccggtggttgaaataactgtcgaggtgcctttatacttttgtttaacttcccgcacaagttgatcggcttgatcgatttgcgatgtttttgtaattaatttataatctccggactcaagcatggcagtttgttccatcgaaccaatatatctaccgaacgtcttagacatatctttcgcatctttcttgacgacatattgtgttttatctttcggatcgtttcctaagacgatatgattaatgtctgcttgctctacgtcacttaacgggtccttccccggatcagttcccgcaaaagctacaacgacgtttttggggtggtcggatttcacccacttgccgtttttattttcggcctgggatagaacggccgcatctaacccggtgtcttcgtctgttttaattttatcaacataccagtaggtggctccggaaacagatgaatttatccgtatgtactctttgttttttaatttttttctgagataatcgtagttgtaagaacgttggcttatacgataataagtctcatccgtaagattggacttcttaatcttcttactcaagatatacaacaccttccgtgtaatgtaaaataataataggaaaggaatgaatttcatttgaaaaaatacattattatcctactattgttaattatagcaggtggagggttgtttatgaagcatcagtatgatgtgaaaaaagaagaaactgttctttttgagaaggcgaaaactaagatgactgaatatctacataatgagtacaaaggtattgatactattacttattatgatgattactttattgatccaaccggtgctatcaccgttgaaggatatttgaacggtgataaatctaaagagttcgacggtttatatgatccggcgagtgataagataggaagctcgtctgtagatgcagaagaaaaatagcccactcaatcgagtcgggcctttttcgtatttatatactctttttcataccgcaacgtcgacactcacgtaggaaaacgccatccttcaccgaacttttaaacagcgtatagtcgcagttatcgcagcgcccgtaatggacgtctgggtactctttataatcgtatacaattgacgtatcatagccttttgtttcgtaatccattcgtcctcaacctccgaatattagaatacgataaatgaccggcacattcaacgccattcatggaacgaaggaatccgcaacaaaccgtttttcgtcttgaaccggtgcttgacgcggcacccaattggctcgatgtaggcgtatttctccgtttcttctacgattagccgctccgcatgaaacttccgccgcgcatcatacggcataaactccataatgccggcatactggccgtccaggtacgaaagaagcagcgcattgtcttccttgcggagtcctgatatcagaacgtcagtatattcgtagttaacgatcttcagccagcgatctgaccgcttattttccgcatacggagcgtttgcctgcttcataacgatgccctcgatcttattttcgcggactaattcgaaataatccgtagcatggccgcgcacgccctcgactattttaacgttaggatgatcgagttttagaccggccagcaattcttttcgttcacttagcggcttagacgtaactgaaacgccttctatccgcaggacatcaaaaacgcaaaatactatcggataaaaacttttccgcgactggaatcgttccatgacggcctcaaaatcgccggcgcctgtcgatccaggtacgataagctcgccgtctaaaatagtttcatccggtatgtcgagcgttaatagttccggaaatttagcggtgacttcgttgttgtggcgtgtgtagaggcggattaaaccgttattcctggacgcgatcagacggatgccgtcgaatttggtttccgtgatatagtcgtccgagttaaacggctcctttgcggactcaagcagcatgggccaaataaacaaaaagaatcacctcgtttcagcgtagttactataatgatatagtaagagtccgccgagacaaagcgattcggttgcggtaaattattccggcatttaaacagtttgcgtaggcttttccggtctacttgccgttcgcccttcgaacgattttcccacgaaattaaagcgtaggagccgccggaaagtattgctggtatattaggtatcggcggccgcttaacgcctgatttcgtgtgttattcgataaccttaatcgccttaaatccgctgccattttcgtactgatccttcgtaaaagtcacgatgatccgatcgcctggctttgcgtctgtggcttgtggatcgaaagagaagccgccgtcgtccgctgataccgcgtagtctttatcttcgacaatatattcgcgctcgatcgtttcctgggcgtcctcagcttcggcggccatgtcgtcagccacgcgataagcaatatcgacatcttcgtttagtttggcggcgtagattccgagagccgcgttgcctgcgagtgataggccgaggatggccgttaagagcttcgttttattcatcgtcattacctccgtatttgtttgcgattaaatagccgagacacgtaagcgccgtattgaagccgatctgatacgctttgccggcgtctttaaacgtcgcaacagggcgttggtatagatcgagaagctggtcggtctgctgcggcttcagcggcggtgtgtccgaccacaagcgttttatataaagcgtcattaccgattcctcctcgatctaaagaatagaagcgcgataaaaacgacggctgagccgagtccgacgcagtccaggacggaaagccggccgaaattcatatccgcaatccaggcgagcaagacgacgattaacaaaatttccgtggtatcaattcgtttcattcgtgttataattgattgacaaggggcgcaatgcctctcgtagcttatgttcggcgacggtgcttcttggtcggaggccgtcgctctttactttcggattcctttcgcatcttccggatttctaagacgatttttagaattccgagccaagttgcgatgattgccgaaagcttcattacggtgtcaatcaattacgttcacctcctttcgttaccttaattatacgatatcgcataacgaatgtcaatcgtatttgcgaaaatttattcgttatcgtataatcgaattatcaaaacgaggtgagtacggatgaaaataacggtaagaccgcgactgtcggaagtaatgaacgcgaaagggtggaggcaaattccgttgtctgaagcgtcaggagttccgcaaggcagcataagccggttcgataagaacgaaaggcatctcgattggcacgtttttgcccttgcgcgaacactcggcgtaggtgtcgaggagttattcgaggtgaagatcgaagacgctgacgaataggttggcgtctatttcttcgtgttggtatcgtatatttatacgtttatatgaatgataatgcggacaatctagcggtgagatgtcggatgattatcgttaaattctcaattagaataacgtaattgataatgaacacgatcttattcgcacaaatcggctaaaaacacgactttattcgcacaaccgaaaacagggttcgtgcttaaagccgcaagggatacagcgtttttcagtccgcaatcacttcttagtcttctgaatccgaagactagcgggaactacgtttcactccgtcccgcagaaacgcaatcatgtatattgtataaataattatatcgcgataaaggccttaataatatccgcggacacggaggagcgtaagcgacggagtggacgctagggtttaaaacttacgaaaatattccgttactatatcaacttttacatgcgtagctgtctatacgttatgagaaggacgctacaactacggaataacaacaggcactagccgcacacttggcgtccttttagtacatattgcggcgatataaacggaggtgttctcgtatgaaatacgcagtcttcagcgactattgcgacgcaggccaagcgatctacgacaattacgaagatgctctcgctgatttcgaagaacggaccactaacaaatcctataacggtgttgatgcgtacatttgcggagttattgactactacaaagcggaagagcgtaacgattttcacgcacaaatcacacgaaattagacgttttagtattctccgagggtattcggtagggtgacggttagaagcgctaatttcgtgtgaattcgaagggagggacgtaagggtggcgaaatacaagaaaaagccggttgtagttgaggcgtttaaatatggcgcaccatggccggattggttccacgacaaagtaacgagtaatgacgttattacacatgcggcgtatgaaagcggaagcccgtttgaacgaaataccggtctttggtgcgaaattaaaacgctagaaggcgttatgatcgctaaagaaggcgactatattattcgcggagtagaaggcgagctgtacccgtgtaaaccggatattttcgaaaagacttacgaaagagttgacgaataaaacgcaatcagaacgagggcgatccgaataggggtcgctctttttgtgcttgcgataaataagccggagcgcctctcaacgatgcggacccagcccggtggataataaacgaaaaaggagacgatgtgaatggcggaatcaaagcgcgaatcaatcggcaaaattaaaatcgacttggatgtgtccgacgcgataaccggactcaaggcggtccaacgcgaggcaaaggcggcgactaaggcgttggctgaattgcgggaagaacaggcgaagggtcatctagcagggcggttatatatcggcgaggagtatattgcgcctccggtctatgtcgacggtaagaagatcgaagaggctagtacgaaaatcttccggaagggggagcgctgatgtgcggtaaaataaccgttaaacttaccgcaggcgatgaatacgacgaacagctcgatcaattgcgccaagcctttttcgctctgtccgacggccctgaacaagaagagtggcgactcgctctcgttgtaggaaggaccgttagcgaagccaaaacgatatggaaacgggtgaaaacgaactatccgagctataagtacacgcaatttgtatcgcgtaatccttacgtactggacggtataaacccggaatacgttgcgctatttatgctgccaggttgcgcagataatccgattgtaaacgatccaatgtttcggtgggttatcgataatgcatacgaagttacttgcgttgaggagggcgatggtgtatgagggtacgcgtttataagattgagcatttaatggccgataatattttcgctgatggctctttattaacgtcgttttctatcggaatgcgggccgaagctaccgtcgaatttgagtctggaaatcgtttagaagccgtgttcgagtttccggaggctgatactctttcattcgttgaggccgagcgattgattcggaaggagttgagcgcggagtgagtcgtctgtcgttaaacaaaactcaatacgatacgtttcgaatatggctacgtgacagtggctatgctccggaacatttacgacaggcggacaacgcagagatgcggcgagtcatacggcagatggattattggtacgatggctttcggatagggagcgaacggcgccgtattattgccggtttgtatgcgatgcgtaatcgcgacttttaattaaacgggaggtatgttaagtgaacggattattttactgctactcaacaacgctgatgcacttcttaaaggcgaatggccgccgctataaatttacgaagctgcatccgcgaactaataaccggatgtgggtattcgaaagagacgccgactttggcgctttgcttgacgaatacgacgcccgaaaggcgaatgcgaaggcgcagtgagtagcgcgattagttaacgaaaggaagtcgatagtcaatgcgaggccaattcgagcatttggcgcgggaggcgctacaacggaaagcttacgcgatgcagaaagaaagtgaactaaccggcaacgcaccgataccacacgacttatggcggcggttggttcctatcgcgagagaatacgagaaaggtaacggagccatggcgcaattgtatacgtaccttctggcgcacgtgaacgggcaggccgagaacgaacggtatatgagcgcgttcccttcggtggataagatcgccgaggatacgggaatagggcgcaacaggatagcgcggttggctaacgtgttggaggcggtaggactactgaagacagcgtatgactatgcgtcgaataagcgcgagaagttgtattatccgcaatattatagcgggctaagtgatgcagagataaggcggaggctggacgttatatacggtcaatcaccgtagagtgacttacgttaatcactgtagagtgatttacctaaatcaccgtagagtgacggtaataataacaaacgcaataataacgaactaataataacaaacaaataatagcgcctctattcgctaacgctcatacgatacgcagatattagtaatctattaaataccttatcgcgataaagaacttatataaaagataaagacaaagtgcaacgatattggtggggagcgccagattggttagtcactctacagtgattgacgctttagtatatgaaaggggtgggagtgtatggagtatagattaaacctggctaagtttagtatcttagaaacactcgagaaggcggcagttgaccgtgagttggtttacgttagagccggacaaaggtgtttaggaaagaccaccgcgcttattgagtttgctcgtaagcatgactgcgaaatcatggttcaccgcaacatgttgggctactacaaaacagagcatccagatgttaaggttagatctcatctaagcgagaagtgggttactccgagtgataggtttgtgtgcgatgaaggtgtacctcaggatgcaatcgacgaattgaaacgaggcggcaaccttatcaccggattcgtaagagtgaaggattcttttagggacggattgtatgaccaattaatacgtgagaatacaccgaacttactaacgatagaactcacggatgaacaatcgataccacgcgtcatatacaaaggcgaagaaattaccggtcgtattgcggtagacttcgagtggcgtactaaagacgcagaccaatgcggctctacttattaccgtatcaaacacactaaggatagcacaggcgctccggttgtagagacgaaggaacttgcggtaggcgaacgagcttatgaatagagaacgtaagcagcgttatagatacctacgagagcaacgaaaggaacgcgactatgagcttggatttatacaactggcaggccgtccgttctgtaagcctagattaatacgactgggtccagcgttaaccttaacgcgattcatggcgggtgcaaggcgatgagtaactactatgacaaacataagcgcgatcccgaagcacgtgctttctataagtctacagcctgggctaagtgccgagccttagtgctcaagcgcgaccatcacctgtgtcaagactgtctcgcaaataaaacgatcactaaagcagagactgtacaccacataaaggagctgcgagaataccctgaattagctttagatgcatcaaatttggtcagcctttgcaattcctgccacaacaaacgccatccggagaaggggcagaaaagtgccaaaacagagaagaaacagagaaaaatcagggttgtaaagacagaggctaaccccgaattatagccccctcccctctggactaaaaaacaaaaatacaagggaccggcgggcccccttcgcttgttgcgcgaccagaaattttacattaaaggggggtctccccgaatgaaaggagtgttttaatggcggtaccgacagcgaaaaaaatccgggaatacctcggagacaggtataaagaatcggatgaagaactgatcgaactctacgttgacactcataagttttaccgccgactaaaaaaggaagtagccgagaaccctttaatgatgcggcatacgaacaaagcaggcgcggagaaccttgtcaaaaatccgttagcgattgagcttacgaagacggtgacgacgttaaacaatcttctgaaatcgctcgatcttacgccggctcaaagaaaagaattaaacgcgggcggtgaagaaaatgacgacggtttcgatcagctctaacccgacagacatcgaaaaatggtataaaaactggctaaaaacgcaaaaaatagccggatttatacgcgaaaaaccggcggaaaagttgcttacaacatggtatgcggaaaaagtagtctccggggagataatcgcaagtaagaaaaatattctcgcttgtaaacgacatcttcgcgatttaaaacgcgcaggaacagacgaatttccatacgtttttaacgaagaaaaagggcatcgccccatacagtttatcgagaagttttgtaaaccgtctcaaggacaatacaacagtttgacgcttcaaccgtggcaacattttgtgatcggatcactgtacggttgggttcatcgcgataccggccttcggagattccgtgaaggccttgtttttgttgcgcggaagaacggaaaaacaacgaaaatcagcggtttagccaattttgcgataacaaaggacgacgaaccgggcgctcgggcctacgtcttagcaaactcgaagcaacaagcgggtgttttattcgaggaaagtcgtgcaatggttcagaagtcgccggtacttcggaagcgtctgcgcgagaatcaaaaaggcatctaccatgacgcgtccatgagtcagatcgaggcacgggcgtctgatagcgaaaagttagacggtttgaatacgcacctcggcatattcgatgagatacacgaattcaaagattcaaaattgatcagcgtaatcaagaactcaagggcagctcgacggcagccgttgatcatctacatcacgacggccggctatcaactcgacgggcctctcgtcgaatattacgaaattgcttccgatgttttggacggatctaacgttcaggagcggaatttttactttatggccgaattagacgacatttctgaggtggaaaacccggaaatgtggatcaaagcgaaccctaacattggggtaacgatggatattccgtcaatgattcaggacttcaatgcggaccgtcacgtccctcgtgaatacaacgactggctggtcaaacggtttaatatcttcgtggataacggagaggaaagcttcatagacttcgaagtcatcaagagcaataacggacatgtcgatccggaatcgttgcgtggtatgagatgcattggcggcttcgacttatcacaaacggaagactttacaagcgcgtgtctggagtttttgctgccggataatcgcgtttttgttatgtctcattcgtgggtaccggcggcaaaagtacaaaaagataacgaaaaaatcgactaccgtgggtttgaagccgacggttttttgacgattatacccggaaattacgttcagtacgagtacgtttacgactggttcgttgaaatgtcgcgtaaatatcagatcgataagatcacgtttgacccagcgaatgcgatgcgattggttcacgatcttcaaaactacggatttcaaaccgaagttgtgcgacaagggtacattactctgagtgacccgttaaagcatatcaaagaattattgcttgacggaaacgtcgtttacaacgaaaacaagcttttcacatggtatctaaacaacgtcaagctcgtcgaagatcggaacggtaactggttgccgactaaacaaacgaggtaccggaaaatcgatggctttgcggcttttctgaacgcacatacacaggtttatctcgatatgacgaagccggttgagggcggaagcgtcggatttatctcaattagcgatctattaaacggttaggaggtgagaaattgggcttttggagcaatgttcggaacttttttcgcaagccatccgatgtcaaggcagaaacgagaagggatctaacacactggtatattcctcgagctactattctaggaaattacggagaacatgcgctggctgacaacgaaacagttttctcggctgtgtcgcgattatcaaacacgatgtcaagcctaccgatcaaggcgtataaaaattatcaaccgattgagtctcaggcttccgagcttctgacatacgcgccgaatcataacatgacatccgggcaatttatcggccttttggagacgcatcgggccgtatatggcaatgcttacgcaataaaacggtacggaatgcgttatgaagtcgttggattagaggttttggatccttcgagagtgcagccggtgattgaagagactactcgggatctttggtacgagattttaggagacaacggaaattatttcgttcacaacatggacatgattcacgttaaaaatacgtcggtagacggtctaaaaggaatctcaccgctaaaggttctgcggaacgccctcgactttgatcgagatgtccggcttttcagtctagaacaaatggatggagcaaagatatcattcattttggaattagcgaaccaactcgacgatacgcgcaaagaaaagatgttagagaactttaaaagtttctataaagacaacggcggcctcttaattcaggaaccaggggtaaaaatccgcgaattaaagaaggaattcatcgatacaaaggcgtttgaggtcgaaaaagtgacacgttcaagagtcgcgcaggcctttaatattccgttgtacatgcttggcgagacacagggcagcgtctccaatatggagcaactttatatcgattatgtacaaggaacgctaatgcctatcgcaactcagtacgaaaaagaattcaaccggaagctgctgactgaaaaggagcgcaagtccggttattattttaagtttagtatgaacgcgttattgcgcggagacatgcagacccgcggtaatttctatcaacaaggcatccggagcggctggtttaagccgaatgaggtgcgtgcatgggaggatttgccgccagaagagggcggagacacgctttatttaagcaaagatttatttccaatcgaccaggttgcgcaacagaaaatcacatcggctgatgccccgacgcctccatcgttagaaattaacgaagatgataacgaggactcgaaaggaggtgaggacgataaagaagttctgggaaatcaaagcggcgaagaatgacgctaaaacaggcgagatttacatttacagtgaaatcagttcggcccagttctggggggacgaagtgactacgcaaactttcaaggaggatttagacggacttggcgaagtatctgcgctaaatatctatattaattcgccaggcggctctgttttcgaagggaattcgatctacaacatcataaagcggcacaaagcccacgttaacgtctacgtcgacgggctggcggcctctatcgcaagtgtcatcgcaatgtccggtgacgctatttttatgcctgcaaacgcgatgatgatgattcataatccgtggactgttgcgcaaggcaatgcggaagaactccgcaaacaagccgacgacatggatcgtattcgcgaaagtcttatcgaggcatatctcggaaaagcaggcgaaaaactcaatcgtgatcgtttgatcgaacttatggacgcagaaacgtggctgacggcgcaagaatgtctcgaattagggctgtgtgattctatcgaagctcctagcgctgcggttgcgaaagtggatacgcagttatttgcgaagtaccggaacactccggaatcgcttcttaatcagacgaaagaggacgaaaagcaggcggaaaaagagcgcctgttccgtgagcagcttatcgcggaagcacaaacgaatttactaaaacttcaaaacgggggaatcatttaatggaactatttgatctgaaggcaaacttaaacactgtaggaacacaattagcatcggttgaaaaggaaatcatgaacaaagcggctgaccctaacgcttctatcgatgaagtacggtctctaaaacaaaaaagagacgatcttaaagagcgtatggacatcctgcaaaatcaacacgatactttagagcgggaacaaaaagctaaaattcaagcaagtcttgaaaaagcaaaagcaggcgcgtctgctggacttaacagcgaagatccaaaggttaagaaaatttctgctaaagcaggcttaatccgtgcaacaatgagaaaagaggtaccggctcctgaagtacgtgctgcgctaggagataataacggaacaggtggggagaaactccttcctaaaacagtttccgaagaacttattcacgaaccttttgtaaagaatccgttgcgtgaactttcaacgtatacaagtgtaacaaatctcgaaatccctaaagttgatttttcccttgacgatgatgatttcatccaagatttacagactgctaaagaacttgaagtagacggagatgtggttactttcggacgccgcaaattcaaagttatggcgaaaatctccgaaactattttggcggctactgatactgatctggtcgctacagttgagcgcgctttacaatccggcctagctgcaaaagagaaaaaagtttctttcgcagtaacaccgaaacagggagaagaggaaatgtccttctacgctgccggaattaagcaagtcactgcggaagataaatataaagcgatcaaaaaagctattgcggatcttccagaagacttccgtgaaaacgcaaaagtaatgatgacatacgcagactatctcgaaatcattgaaactttggctaatggaagtgcaactctttacggtgcacaaccggaacaaatcatcggtaaaccagttgaattctgtgatgctgcggttgatcctatcgtcggtgacttccgttactctcacttcaactacgatccggcaatcacttacgaaagcgacaaagacgttaaaactggcgaaaatgtatttgttcttactgcgtattttgatcacaaaatcaaactgaaatctgcattccgtatcgctaaagtagacactactccctaaagcaccccaagggctaaaggcatcttcgactgactcatcggtgtccctcagttgggatgccgtagcctttgttgggggaatcaaagaatacgaaatctttagggacggggtttccgtcgggacccgcgttggcacgtcgtttaatgagagtggtttaaagccggaaactacgtataaataccaagttcgggcgatctcaatggcgggaaatccatcggagctgagtgacgagctttccgttacaacagagccgacgcctgttcctgatccggaaagcatcagcgtcagtccatcgtctaagacattaaacgtaggtgagacgcagcaaattaccgcaacagtatcgcctagtggggctgatcagggcgtaacatatacgtcaagcaacacgtcaatcgcaacggtgactagttccggtaaggtaactgcggttgcagctggttctgctacgattactgtaaaatcgaaagtgaagacaacagttaagaataccgtatcgatcactgtcgtcgacccggcgccgtctggcggtgagtaaacatggatatatctctggatgaggtaaaagaatatctgcgtattgatggagatgaggaggattcccttatctccttttttatttccgcagcgaagacgcatcttgaaaacgccggtgtaaccgacaaggaatctgaattatataaattggccgtcctcatatacgtcacagacgcgtatgaaaatagatcaacggcattgagtggaaataaagtagctggaatcgtattgcaactgaggtgatctcgtgaaaacaggcgattttaacaagcgaatcacatttcttcggtttaccgaaacgacaaacggtgagggattcgaaataaaggaatggttaccggttgcgaccgtctggtcagcggttaagacggtccaggggcgtgaattttaccaggctggcgcagtacaggcggacagaacagcacgatttgttattcggtattcaaaacggatgaagtcgcttcttagaaatgacttgcgcatttcatacgcgggaaggacgttcgaaatagaaagctttataaatgacgatgaacgtaacgtcacctttacgttagtgacgaaggaggtcggaatcaaatgagcattcagatttccgggtttgacgaagtaatgcgaaacatccaacgtatgggcaatcgggctaattcgttaaaatccggcgcattagatgccggagcaaagcctatctataaaactatggaagataacaacccaagtaaaagatacaagatcgctgtcgaaaaaagtaagtcagacgaagtagtaatcggtcctgaaaaagactttttcacagcgcattttcttgaattcggcacaagcccacaccttataaaactgcgaaaagccaagatacaaacagacggccaagttgtttacggtaaggaagttaaccacccagggcacgctcctcgaccattcgttgagccgtcttttattgcgtctaaggaagatgcgcaacaagagattgttaactacctgagaaggaatttattgccatgagtctacggagtctagtaatggcgactttaaaggatattggcgtacctgttcgatttattacgtattcgggcgacgaggacacgtacattctcttttatgtttataccgtatctgacgcactttcaatggaggatgaagaaactttcgctaatcactatgttcagattagtatcttcacaaaagacccgacaaaatattcagaattagaaaaagaggtaaagagccggctcaaacgagctggcttttttcgttcaaacgagcaggacctttatgaaaacgaaactgagctttttcacaaagtcttgcgttatgggacgacactaaatacggaagaggagtgaagcaacctatggcaaaaggcgtacgcgtaggtttaaaaaatatacactttgcgaaaattctaacggaagatgagaacggagttacttacgatactccggttaaaatcggaaatgcgatcgaagcaagtatcacaccgaacacaaacagcgaaactctatatgctgatgacggcccttcagaagttgaatcttcgttgggagaaacggaagttgaaatcggtatcgatcaattatcaactactgcacaggcgttgttgctcggtcacactattcttagcgatggtgtactagagaagaaagaaacggatatcgcaccgtacggagcgttgctttttgagtcagctactactggagggaaatctaaactttacgcgctatataaagggagattccagccgcaagaggagtcttttgcaactaaaggagatagcccagaattccaaacagactcaatttctggcgtatttgtacgtcgcgatcacgacaaggtttggcaacgtagcgtatttacgggagatgagggcgtgaaagcagaggttattgaaaactggtttaagaaagtttacgaaccaacaacttctactccctgatgcgccccagaatctacggtacgacagtacgacagattctattacagttgaatgggatcccgtagatggggcgacttcatacaacgtttacagaggcgcagacaagaaattcgctgaaaacgtgacgcaacctaagtatgtaacaaccggcatgagtccggatactaaactcacaattaacgtaacggctgctaatgagtccggcgagtctcctatgagcgaaattgtgacacaaacgaagatgaaaatagaaacggagagctaagtttttagctctctttttattaaaaaaaataaagaaattaggagtgtgggttatgcaaatcacattaatgattgatggtgaagagaaggtatttcaagcacctttcgtaaaggggcgtatgttgcgggaagctattaaactttcgaagtcgagcaactttgatgatttggatgttgaagatttggacgcattggtaggttacgtagtccgagtttatgacgaacaattcgatatcgatcaattttatgatgggatttcttctgaaaaactaattcctacaattacggaaacaatccaacaagtcgttggaactgtagctgttccaaatgaacaagttggcgagaacaaagaaactgaagcgcaggcaatcggtgaggtaaaaaactaacaccggggtatattttaccccttgatgttttagatcaacttgatagggatctcaaaaagctctatctcgacaactccgaaaaaccctcggatatctattacctagacgaaatggacatcgggtggttttgcgaactaatgaattttagtgatggtggtagctctcacggaagcggaaaaacacaacaaaaactcggctatatcgatcagataccgggtttttagaagggaggtatcggagatttggcgactgaatcagtcggatctatacgcgttagtttaggtctagacaacattgacttctctcgcggcctccaggacgttaacagaaaattaaaggtactaaactcggaattcaaagcagcaatggctggcgctggccgattcgataacagcctggattcattgcgtaataagaccgacatattaaatcggactttacaaacgcaaaaggcaaaacttaacgagttgaagcggcaatatgaagagagcgtaaggacgacgggaaggtattcggcacaatccgaaaagctcctcgcccagtataatcgaactgttgcagcggttcggaaaactgaggatcagttagaccttcttaaccgtaaaatgagagagcagagcaacggcttcagtcaattaggcgctaaaattagcgcaagcattaagacgatcgatacgaagttgcgcgtattggattcgtcatttgaggccgcatcagccggcgtaagggatttcggttctactaccgagcaactacgacaaaaatcggaacatcttacgcaatcgatctcgttacaagagcagcgacttaaaaacatccgccgactgtatctcgaagctaaacgcgcaaaaggcgaagatgctcaggcgactcaagaattacgcgttcaaatgaatcaagcgacggcacaacttcgaacaactcaagccgaactggccgcaacgaaccgacagatccaatcgaacacgggccgttggaacgagctcggcaaccggatgggtgaagtcggggaccggatgcgggacgttgggggtcgaatgcaatctgcgggatctgaaatcgcgatgtcattcggcgtagcgacagcggctttaggcggaggtcttgcggtttcaacgaaaaaagcgatggacttcgagcagcagatgtcgagcgtgaaggcggtcatgaatccggcagaagccaaccaatacagcgctgcccttacggaattagccattaaactcggtgctgatacgaaatacagtgcgcttgaggctgcgcaaggtatggaagaactcgtaaaggccggtgtatctacgaaggacatactgaatggcgcacttaagggcgcgctatcgcttgcgacagcgggagaattagagcttgcggatgcggcggaaattgcgtcgactgcactgaatgcgtttaaagacgataacattagcgttgcacaggcagcagatattctcgcaggggccgcaaactcttctgcaacaacggttggagagatgcggtatggtcttcaaatgacatccgcagtagcagccggtatgggactgtcttttaaagacacggctactacactagccctcttcgcacagaatggacttaaaggatcagatgcaggtacttcgatgaaaacgatgttaagtcgtttagtacctatgacaaaagctcagtacgagacaatgcacgatcttggtctagtcacccttgatacttccgaagcttttaaacgtatggctgataaaggcttcaaaccagcgagtaaaaatatcggcgatatatacgaggcacttaacaagtatgttgaaaagacgacaggagcgaagcaagggaccgaaaagttcgagaaggcctttgacaaagccactcggagtcttggaatcatggacaataaatttttcgatgctaacggaaatattcggagtatgacagaaatatctggagagctttctaaggcgcttgacggtttgtccgcaaaagataaacaagaagccctttacaatattttcggtagtgacgctattcgaggcgcgttgattcttggtaaggaaggaagtaaaggcttcgataaaatggcggctgcaatggataaaattaaggccgataatgttgctgctgaaaaaatgaataaccttaagggtaaaatcgaagagctttccggtgccgtagaaactgcacaaatttcatttggtaatgcgctaaccccagctatctctgcactcgtttctgtgcttcagagcgcgacggactggtttaatggtctatctaaaggaatgcaatcgttcgtagctatttctttagcggttacaactgtaattatgggcattgttgcagcgttaggttttttaatgctaggtgtcggccaaatgatatctggactcgggactgtaagcggtcttttaaaaggtttgataaaaagtgaaaagttcataaaggttataggtgttgcattcggagcacttacgagtccgatcggccttacggttcttggcataaccgcggtaggagcagctcttgtaatcgcgtacaaaaagtctgagaaattccgtaattttgtaaacggcgcttttgaatcagtcagaaacgtgacggttacggcattcagcagtatttcggcagtggtaggcgacacatttaattttatacaaaaagcttcggtagccgggtgggagagattttctgacggcgtctccgttattgttccggcagtacgaaagcgatttgctaacgtggttaattcaataggtgaattcgtttcaaacatcggatcgtcgatcgcagatagattcggttccggactagcggatagaaccggctccgcagtagatttattcattcagaatttaagggctgcgttttcgagcgtgggcggaatcatatcgattttagcgccaaccgtgactgcgttagggctggcgatggccggagtttccggatctattggttttgtcatcacctctcttgttagtctagccggttttttattccgactatatcaaacaaacgaagagtttagagcgtctgtacagaacgcctggtcacagattatgtcggtgatcggtaacgttgtagttgcgattcagccaatcataaatcaatttatcgggtatttttcggatattgcagcagagcttgcacctgaattcgcgaaaacgggcgaagtcataatgtccagcattagttcgttaggaccaacgtttactgagctcggaaatgcttttggggaattgtggacaacgttaggtcaatcattctctgaaattgcggttcagatagcgccggtaatccaggaattaggcgtgactttcgcggcgtttctaccgcaagttgtaactttggttggacagttgattcagacatgggcatctttccaagtccaattcgcacaacttattatgcaagtcgcatcggtactattgccaatgttagctcaagcatttacatctttgcttccgctgattttacaaatcgtatcgtctgtacttccaatagtgctacagttgattcagtcccttgttccagtagtaaccactattgcgactaccttgttaccaattttgctacaggcgtttcagtcaattttcccgccagtactggcgataattcagtctgtagtgcctatcgtcgctaatctgttaacatcagttgctcaaatcttgagtcagttggctgtaaccttgctaccactcattctgcaagttgttcaggctgttttccctgttgtaacaagcatcattcagattgccatgcaggtagccgtaacggttttacagttagtggcaactataattcgtactgttcttatcccagcgatccaattcgtgctgaaaattgtgcaagtcgtgttccctgtagttgttagtgtaatccaaaacgcactcaatatcgtgatcaacgtagttaagtttttcactgcgctactaaaaggcaattggagtgcggtctggaatgcgatacttgggattctgaaaagtatttggaacataatcaccgcagtaatccgaggagctgtaaatgtagtcctcacactcttttctggattggtcaatggggcagttagcgcctggaatttcttgaaggacagaacagtaggtttgttcaaatcaatcgggaaatttgcggccgacacgttccacaacatgatcgagggagcaaaggcgctaccaggtgaaattggtgacggaataaaaaatatggccggcagagctctatccggagttaaatctctaggaaatacgatgatcggcggacttgaaggaattatcaatggcttgacgcaaaaagggattaacaagctactcgatacattcggggtggataaaaaactccggatccctaaactcgaaattccgaggttcgctaaaggtacgccagcaggtgggcacaaaggcggtcttgctatcttaggagatggaggcggtccggagttattccgtacaccttccggtttcacaggtttaagccctggaaccgacacgctctttaatctgccaaaggggacgcaagtcttgccgcataaagaaacacgcgaggtactatcttctggaatccccgcattcaggaaaggtacgaagaacaaaagtttcttcgattctgctatcgatgttggaaaatccgctgttgatgcgggtaaagctgccgtaaacagtgttaaggatttcgcttttgatgcgtgggaatacgtaagcaatccgtcaaaacttatcgctaaaacgatagaaagtctcggactgaagttgccggatatttccggagctttcgggacaattgcgaaaggtgccttcggtaaagtcaaagattccgccgtcagctttatgaaaaagaaactcgctgactttggtggagctttcggaagtggcgataaagcgtccggaaacgttaagcaatggattcgggcggcgatggctaaaacgaattcgccagcttcttggttcgctccactcgttacaattgcgatgaaagagtccggaggccgtacgggtccgtctacaattaatcgttgggactcgaactggagacgtggtacaccgtcaatgggacttatgcaaacgatcaaaccaacgtttgatgcgtataagcttccgggcatgggcgatatcatgaatccggtgcacaacgcggttgcggctatacgttatatcaaatctcgctatggaagcccgtttaatactccaggcatcagatcgatggagaaaggcggtccgtacaaaggatataaaatcggcgatattgtgacgcaaaagcagctcgcctggattgcggaagaaggtccagaagcgattattccgttgcaaaaccataggcagcgggcgcagcaattatggacggcggcaggaagagaaatcggtatggatccgtctggtggaagtaacgaagaagaactcgcgttgttgcgtggacagaacgcgctactcagacagacgaacacattgctaacggggattctacgcaaagatccgagtgtagttgtcgatacggcagcactaacggacagtgtagaaaaaggtcaggcacaaaacatcggattcaataagctgctgtggggtgatcggtaaatggcgtatcttacgattataaaaaacggtgaaaccattgatcaccgtaaatacggcttaaagcttttgagttttcgcaaggaatcgctaacacaccgaactaactttgaagaaataggaggcaggcatggcgcaatagatacgggaacgactttcggtgagcgaaaacttaaagcgacgtttttaatgcaaggcgtagaccatcttgattatcagttgatgatcgatgaggtctacgctttatttgcgtgcgaagattcaatcgaattaatagattcgagacagcccggtaaagtatggacagtaaaaccaagtagcacatttgagcctgacgatttaaacccgaggagcggtaaatttgagatcgaatttacgtctccgttaccgttcgcgagttcgtatggttctactcttgatccgttcacattcggcgaagaagtttggcaaatcgggcaagggctgattccttcagatagcctagtttacagacatcgaactactcgattcagtattttcaatgctggaaatgtagaggttgatccttgccttgaaatgccgttgaatatcgtttataaaggcgcatcctcaaatttttcgatcaaaaacaaaacgaccgggcagacgatttcatataacgggacctctaagtcgaccgattctataaaactcgaagggctgcgccatctgaagaacggtattagcatttacggaaataccaatcgcggatacgtttcattaaagccaggatggaatgacttcgaacttaccggcacatctggaagtttcgaaattacatttgattttttctttttctataagtaggtggtcgagtgaaaacgatagcaattagagacgtaacaggtattatggagccgttaccgggattttcggtagtacgaacagatggtagcgacgggcagagatcaataaaattaaacggctataaaacaactaataaccagtacggctaccagtttgtaaaaaacgaaaatacagttgtctacgatgacgaagagtacatcatcaaaacacatcgcgaaagaacgtaccggaaaggcgtcggagttgaggcaacggccattcatcgcatctttgacgacttgaggaacaattacatttacgatgagaagacgggcacgctccgattggatgcgatgctctcttttgcattggagggaagcggctacacattcgaaattgatacgacggatttaccagcgtcagtcagagttgaaaattttggatggaataactctctcgctcttttccgagacattctcgaaaagttcggtgcagagttcgactacaaaggtaagaaaatctatgtcgctaaaaaattcggcatccaaagagacgaaccttttctgcgttataggttcaacgtaaaggatccggaaaaagaaattgatacaagcagtttcgcaacgtatattcgaggttacggaaagaaagacgataaaggaaactatttgtttgccgagtacacaagtcctttagccaaaatatacggtattaagcacgctgacccggttaaagatgagcggtacacagacaaagatagtcttctcgcagcaatgaaaaagcaactcaacgataacatcgatatttctcttacctttacagccattgaacttgaaagtatggggctcagggatattaaaaagggtgattatgtttggtgtgtgattgaaccatttgacttaaatgttcaattacgagctgtaagcagagaagattactcggatgaaaccaagtcacctacgtttacttttgggactattacgaaaaaagcttcggatattatcgcgagctttaatacgacaaaaaaagcggttgacaaggttatcgacacgtctaccggaaaaataaaagactctgcaattgacacgacgggcctcacaacgaaatccgagtttcagtcgcacgtagataacaagatagtgcacataacagcggaggaaagagctgcttggaatgcggcttcaaattcaatcggtgatttaacttttatcacctggagcacgccaactcttaaaaatggttggattcagtatacggcgaataccgaaagctatccgattcaatacggaaaggatgcgatagggacggtcaatatcagaggagctgtttcgtcaggggtagtcggatcttcaactccagtctttactttgcccgctggttttagaccgccgtttcctcacctttttatcggtgtttcatctgtcgcaacagacggtacgcctcaatattttcgtgggattataaagacgaacggagatgtttgcattgagaatatctcaaacaaagatactcccaatcagtttatcggtatctatacgcaatttaaagcgatttaaaaatagcggaggtgataacgcttgggaaagttctattataaaaaagccacaacaagcgggtttgatcgccaatatataaaagaccaaaatcaaaacctagatgacataggtaaggacatccgagaagttgacacaaaaataaatgatcataaaaaagccaaaaacgcccatacatccgaacaaatatcgcacgaaagcggactaaatgtcggacaggaaatcgaagtaacgaaggcgcgctttagaaatctcgtcctaaatgtcgacggaaccaacgttaaagaagtcgtcgatgcccgtgtcggccgggacgggacgatttatccgacgctcagggatcgtttagacgccgacggacagacggttgatgacataaaggacgatcttatcacgagaatcagctttaaaaatgcacttagttatggcgcagatcctacggggaaaacaccgtcagcggatgcgattcaaagcgcgctggacgaaatccacagcgaaggtggtggttggctcgtcattcctggcggtacttatctgatcgataaacgcatgatcatttacgaaaacacacgcgttacaatggcggctgattgcgtgctgcttcgaggatggtctggcggattctttgcaaacggtaagcccaccgataatttctccggatattccggaagaggtaacatcgtcattgagggcggtatgttagatgggaattacctgaagatcgaaacatataaaacgaatgcgatggacagcgttattatcggtcacgcgaaaaatatcgttatcgataacgtaacgtttaaagacgtaattaccgaccacgcaatcgatgcgaacggatgtaacggccttcgaatcacaaattgcagatttaccggatttatcgatactagcggaacacgtcctttttctgaagcgattcagctcggagagtttacgaaaggcggcgtcaacattttcggtgccttcgacagcacgccgaacactaacgtctatattgcgcataactacttcggaaagtccgatcttttaggcggttggggatgcgctgtcggaaaccactacgctgtatacgacgtgttccagacgaacataacgatattcgacaatacgattgaggattgcgggtttgctggcattcgtacatttaaatggggcgaagttaaaattattaacaacgtcttcagacggaatcgggagtgcgtccggatttcgcaagtttccggcggaatcgagagctctaaaaatgcctctggcgtacagatgaatcgcccacaaaacgctcaaaacattctaatccaagggaatgacttctacgagtatacggtctgcggagtagttacctacgggcagatttacaataaggaagctgcttggagcgatggtatccggatcttcggaaactactttaaactgcgggagaaagatatcggcagctacggcaatgagcaggcgattcagataatctacggaaggaacgtcttcatctccgataacaggattttcggagggcgtaggggcatctggctcgagggttgttttaatacgttcatctcgaacaattatatatcatgtgtagatacggaagcagtttacgttgcgaaaagccgcgatacatcttcgactatcacaaaatctacacatttatcgatagacgggaacgaaattaacacgatcgggcgaaacgggatctacgtccagaactgcgataattttgatgtgcggaacaacaacatattcaatacgaatatcgaacaaggatcaaaagatcgcggaggtgttttcgtagaaaaggcttacgatggacgtatcgaaggtaaccgaatccgaggtgtagagaaaatattcgccatcttagtccagtctaccgcaactgaagtgaacgtgtttaacacgaagggaactggtcgcgtcatcgttcaaggtgattcgaatcttaacgggtattacggcacaacacagaatgattatataagaaaaatcagcacgaagagcagcagctaaattaaagggagggatgtctccgtatgatatataaagattccgaagtccatttcaatataagctcgcaaattaaacgaagtgtttccgcgaacattcaatttagtacgcaggacatcaatacggcaaagctaacgatcagcttaacgaaggacggcgtgccgttgccgataagccaagcgactcacggtaagttgtttatgcggtttgcggacggaagcaagttctacgttaatacggaagttcaagacgcgctcgggggcgttattttttatgtcttgacgccggatcaagttacgcattacggaacggtgcaggccgagctttacgttaattatgacaacggccagaaattgagcgtccataaattttcgtttgaaatcgatcgagcactcgtcgaccaggatatcgccccggtggccgaatattatgttgacgatttcgaatcgctaaaggccgtcattcaagaaatggcggacgatgccgaacaggttctcgctgagttacagaagaaattcgaaaatctcgataacattgagacgaaagaaggcgctcaggaaaaagcagacgtcgcagaggctggtgctaaagcttataccgataagcatgcggctaaaattgataatccgcacaaggtaacgaaagctcaggtcggcctctcaaacgttgataacgtcaagcaagcgtctaaatccgattttgacaatcatgtcggcaatacagcgaaccctcacgcagtcacgaaagcacaagtcgggctgtcggatgtagacaacgttaagcaggcgagcaaggccgaatttgatacgcacaacagcgacaacactcgccatattactgcggatgaacggacgaaatgggatggcggccaattgcgcaagctgacagacgacagcggcaaacggacacaggtcgcagacggtgcggatctgctgacgttgtccaccggattttattttgcgacaggaaatgccgttcagaataacccgacgacaaatgacagcgcgcagtttacttacgacgttatcgaatccgatcagggccggaagacgatctatgcgtggaggaccacggacaatacgctgtggcacgcgacagttattccggataccgcgtttaaaggatggaagcgagttatcactgacgacgattttcggaagaaaacattcgtagatacgtacgattttgataactctgcatttacggcaactgagggcgtggttacaaagataaagttcggagctgcccgggctgacgaccaatcagaatatgaccaaacaaagtctgagattaccttgaaaaacagcggtttgtatctggtcagattgtatatttcagcaacagccatcccatctaattcggacatcggatttatttgctatgtcaatgatgcgcaatatcaaacgatgggctactggtacccttcaaaaagtacacaaacgaatgtagtattcttacagcagaagtttaatagcggtgataaagttacctttcatattttccctaaagtgaccggtagcactccttcatcagtcagtgttaagtctgcgtttttaacgatgtctcaaataagatagggaagggagtgataaatttatgaacctagcacttgctgttaaatatttattcccggatgcgattatcggtgaggactttatcataagagacgatggggatgggcgcggtcagtatattgagacttggcggataagcgctccgcaaccaagcgaaaaagaacttcaagaagcatgggaaaattacttggaaaacccagttacagatgatccacaactttcatatacatcccagcagcttttaaagttaggccgtgagatgtcttcactgaaacttgaaattctcgcgcttaaaggagagatgactaatggatcttaatttttgggtgtacgctctttattataattgggctgatactcctatggttaagcaagcactacaatacaatgacgtaacaattgaggagttaagagacggtgtagatcaaggatatgttacgcctgagcaattccaagaaataactggcgagaagtacattgcctagatgaggaaaagcatggtaatataatcctatgagaaaattattttttatatcgctagttattatgctttttcttagtgtgaatgttgggtgtagcaacgtcgatgctacaacaagcaaatcgatagagtattcacctcttataatcgcacatagaggagcttcggagctggagcctgaacatacaatcagatcttattcgagagcaattaaggacgggaccgatttcattgagatcgatctaagggtgacgaaagacggaaaactagtcgcttttcacgatgaagacgtgtcccgtacaacagatggaaagggagacattgaagatttatcgttaaaccatgtcaaggaattgcgaactgaaaaagatcaacaggtcttaactcttgaagagattatcaagaaatacggggattcaacgaagtattatatagagactcgcgaagattctaaaggccgtttggttatggagaagaaactgatcgatatactcaatcgctataatttacttgaaaataatcaagtaatcattcagtcgtttagcgcgaaaagtttgaaacaagttagaaaactcaacaaagaagttcccatcgtacaacttgtgcagacttgggatgcggagaaactgtccgaaagaattaaagactataaaaaatacgcgtatgcgattggaattagttctcagacgctgtctgacaaggaagtgaaaatgattcatgacgagaatatggaggtccatacgttcttccgtgtcgagttagagaaagaggaaacaaagcgaatgattgaactaaaagtcgacggtatgttcgctaataacccggcctatttaaataaattactcgatggatcaaagtaatagccgtcttagcacctcattcgcagaggtgttttttattttgcctaaatttagaggaggcgtagtcattgggcgagctggacgtaatcaaatactttttaacgcaagggccgttcgcggtcctttttacgtggctgctaatttacgtaatgaaatcgaatcgtgaacgtgaatcgcggctacaggatctactcgataaattcagcgataaatacgacgtcattatcgacaagctcgatagactcgaagagaaatttcgcggaagagaataacgcgcccgttcggtgagagtccggagggctttttatatacgcaaaattaacgaaaagggagacgattaaatggcgatttcagtcaagaaaaacctcgtcgcgtcaagtaagtattccgttaagtgtccgtattcaatggatgcgaagtacatcacgtttcacaatacggcgaacgacgcttcagcagcgaatgaaattgcgtacatgatccgcaataacaaccaagtatcgtatcactttgcggtagacgataaagaggtcgttcaggggattccgacaaaccgtaacgcatggcattgcggagacgaaaacggacccggcaaccgttcatctatcggcgtcgaggtttgctattcgaaatcaggcggcgctaagtataaagcggccgaaaaacttgcgattaaattcatcgctcagctattaacagagcgcggctggggcgttgatcgcgttaagaagcatcaggattggagcggaaaatactgcccgcaccgtgtactcgatgaggggcgttggggtgcggtaaaagcggccatcgctgcggaattgaaagcgctcggaggaaagtcgtctagccctgcgaaatcagcaccgaaagcatccggtaagacgtataccgtaaagaaaggcgacacgctttcggaaatcgcggttaaaacaggcgttagtgtggcgaaactccagtcctataacggtattaaaaatccgaataaaatcatggtcggtcaggtgctgaagcttacgggcagcgttagttccaaaccgtcctctagcggtaagaaatacgtatatcttccggcatctgccgactcatggcgcatctatccgactaacaaagcgccggtcaaggggaacgagtgcggatttctgcgtccgaagaaatttggcggccttaaatacgaaatccttgcgaatccccaaacggacgtctatacgatcaaaacggatcagttcggaaaagtgaatatctacgcggcgaaatcaaccggcgcaactattaagtaaacgaaaagggagacgatataaatggaagaagtattattatttgcgactgtgttggcgcccatcctaacggcgcttgttcaacttgttaagaaaacgattaacatgccgaccaatgttgtgcctgcggttagcttcgttttaggaatcgcactcggagccgtggcctatccgtttacggacctcgaactagtattgcggttgtgggccggcggttttgcgggactggctgcgacgggtcttttcgagatcggcgcaaaacgtgaaggaacgaccaagtaagcggaacttttggcgggcgcctgcgtataaaagcgtaggtgctcgtatacataaactggtttgcggttaggtttggcgatagagtataattttagtaaattattttggaggtaaagtaaatgaagaagatactgttatcgctcctgttaatcccgttgttagctttaacagcttgtaattcagtcgattcttctaaaaacacagaagacgagaaaatagctgatactaaaaaagaagaaactttcgaagcgacagagaagaatataaagcttcttgttgcagacgagctgaaagaaaaaggcattgaagacaccgataagttggactcattcgaaatttttgatgatgtcaataaagataataagccgattaaaaccgtacttatcacattaaacggaaatgataaccttacaaaaaacatgataaagaaaagcatgcttaaagagggagaaaaaactgttccctcggatatttgaagatcaatcggtcggaagggttctaataacgtggaagtttccattagaagacgataaaggaaatagtactttccaaaaagtattgtctattcaacttgagcgagaaactgccgacgaaattaactggaagaaattcaagtacaaaaactttcctaccgtagctgacagctactttgagcatcaagcttttaaaaaataacaaaatcacctcatccttaatgggtggggctttttatttcctcctacactcttaatcctcgtgaacctcaaacaattcattcatatctgtgatattaaacttatcaattattttttcaagcgtttcttttgggtaccttttggttttccccgaacataattcactcacagcgcgagttgataactccaattcctctgcgatttctttttgttcatatccgtgctcctcgagcagttctttcagacgaagacgcatcggcatcaccctttcgcattctatatccgtagtatacgataaagttaaaaattacgcaaaccgtaattgacaattccgtttagtgtaattataattacgttaaacgtaaattacggaaggcggaatcgttatgcattatttagcggaacaccaaacgttcgcttcgacggccgaactcaacgcggcagtctacgaacacatcaagcgcaatacatacgaattaaatgacacggaccggctgacgctgaagacgattgctcgttacgcagtcaaattcgccggcgcagcgcatctcaaagcggagacactcgcggacctgatcggaaagtccgtcaagacagcgcgtcgtgccgtcaacaaactcgcatcactttcgatcatccagaaggtcgcgacaacacggaaaataaacggcggccacggcgccaatatcatcgtcattcttccggtcggaagcagagtcgaggacatgcaattgtccgaagatgaccagtcgacaatgaccacgcgtggggatgccgaaaagccatcagagccaacggatgaatcgcctaaaactacgaatgaaccatcggattctataaatctttcaaaaaatcacgtaatagatacggtgccggcctgcggtcttaaaaatgcgttaccaagcgaaatctactccgcaatggcgcgctacttcgaagcagacgaaatttataaatactacggaatcttattgcgggctaaggcaagcgtagatccaacgctgatactcgaagaacatccgcagccattcgttgaagcgtggcatgcagcgattctgaaacgaaaacagcagaaaattagacgctttgacgactacctatacgctagcttccgacaagccgcatggacagtaaaagcccgtgaaaatcgcgttaaaaacgttgggctattggcggagttcgaaacgttcctccaagcggaatagattgcgtaagaacatttgttcgtgttatactttcgtcatagataacgaataggaccgaaggaggaaccacgaatgacattacgcgatagagggacgatgaaatggacgtctatattcttgccggagcacatcgctagtctccggaaacttaaatccgaaattgatcacgcatatgagcggaagccatcgattgatccggagcagtggtcggactttgaatcgaagatacaatacgcgtacaggaccggacaggattgcgagatccgttactggcgtaattgggtcgcggagagggtgagcggcgtgattgaatccgttgatccggtcggagggacattgcggattgaaggcgttgacataccgttcagggagatcgtgtgggttgcgttggaggacgtgtgactccctaaaaaggggtcatagtgatataatagaggacatcacaactagcattaatctttcgctcaattggagtgaggataatgacagtgattaagaaagacgataaaaccggaaaatattattttgtatattctggcggggttcacccgataactggtgctagaattcaaaaaagaaggcaaggaatgtcgagtctacgagaggcgaaagaggttttaaagcaggtcataatagaggtggataaggaaaaaaattctcataaccctaataaaagcgtgtttagtaccttcgctgaaaaatggtttgaatcgaaaaaggttagacttcgatcaagtacaatcgtcaattaccgcgagcagcttgattacaacatacttccatatctaggaacgtttaaaattaaagacatcactgaggaagtcttgcagcattatattaatcgacttcacaatgaacggaaacttgctccggcaaccatccggacagctttcggtgttgtcgccgaagtcttaaagaaagcttcccgaaaaggagcgttcgacctcgccatccttgacgatgtaaaccttcctcccgaaaatcgcatttctaaagtatggaacgagtcgaatgtacaagcgtttttggatgctcgcaaccgtatcgtgtcactaactcgttactttatcggaatggtattatccgttattacaggcatgcgaatgggggaggttctcggattgcggtggtccgatatagacttcgaaaagggttatttaacaattcgacaaactctcgctaagatagacgacgaaggtaattacggattagttcccgaggtcaaaactgcggcgggcttcaggaccgtccatttaccgaaattctttatcgaatacttaatcgaacataagaaaatggtccagcgcgaaaaagaaattctcggcgaggactacatcgactatgatctcgtagtgtgtacgaagcacggtaagtgggtacatccgaataactatcgacgggcatttactcggttaattgcgcagcttgagctcccgaaaatccctccgaagaatttgcgacatactcacgcgacgtatttaatcagtatcggaatcagtccgaagattgttcaggagcgtttaggccacgcacatatcaaaacgacgctcggaacgtacagtcatgttttgccttcgatgcaggcggaattagtcggaaaattggacgatttagtcgcgaaagtgtgaccgcagtgtgaccgttttgtgtgaccggatgtgagagcgttgatatgacgggattttaacaacggattccatcacgaagactgcatgaacatcatcatgaacgatttaattgagctgatggacccgcgctacatcgaagtctggggcaaattcacgccgaggggcggaatctcgatcgacccgtacaccaactacggcaagcccggcacaaagtatgaaaaaatggccgagtatcggatgatgaaccatgatctgtatccggagacgattgataatcggtgatgatgcgggcagatgaagcgaaggtttgtgatcgatgtgtgaccgagacgcgtactgttacgcgtcttttttgttcgaaatttccacgaacaattaccaagcgtattggtcgaatgctagtccgggtatatgaaatacgattcgaattgttaattgaaaggtaaagaggaggaaacttcgtcgtcactcgcctcgttaacgtctccgcttgacagttcgtcgttaactgcgaatgctctagcgttcggtatttagatggtttccgtctgtttttagtcttgtttgttcatttattcgtgaaaaaatgtagctttgtcctcatgttacaaaggatgttttctgttttttctttaaacataaaaatctagttattctgactttgaggaggggatgggaggtatatagcagagacgaagacatagtgccaagagcatgtcttattcgtatacacacaaatatgtaacgcgaagatgttggagggcttacgaaagaaacaatcgatcgttatagacgggaggagcgttgaagaatttgtggaggcttttaaaggaaggttggcactgagtcggaatggtatacgttaatcttaccgacagctgataagaagttaatcacgatgtttaacgttaagaaaccgtagaaataaaaagcgccccacatttggggcgtttcttacgtttgcttacgggtagcgatttgatatacgccgtcagactggtcggttgctgaaacaacgctaatacccatcgttaataacgcggcggctaaaatgggaataacgagctttttaatactcatagagacactccccttttttaatttttgtttgcccatacatcattttttgaaggaactcgattgagtttctatggtcttttctttcaaggtattggttagagacttcaagcgaaagctcttctatgtatgcaaatattttattctcctccaagtatttaaatacctctaaaatctcttctttattcacagaatagatatataacgcctcaagatattcaaatagagaagtgaatagggtatcgttgaattttcgagctgtttgtctaaccaataagaaatatctcgattgcgcgctcgtagtttttctgcttaaaaagaagttgagtagagtaatataatgattgtggtaggttgttatattcttcttttagattaatctctacggctttttcagcatattcaactgctgcatcaatgtctcccatacattcatgacagtcggctatattaaaataggcagaactaatgagccttttattgtcgatctctatcgctaattcaagtgcattttccaggtggggtaaggctttgtcatggcgcattaaatcgtcatagttacccgcgataacaaataaacattggattttacggactgtgtagagttcatgattattgtatattttaaaggcccttaatatatgatacatgtgtctgtttcatgatgtagtatgcttcagccattttaaagtgaaactcggcttgttctataacatcgtaatgagagccaactgtttttctgcgtttcgataaaactctattgctttgatgtactgttttttctcaaattcatacatgcccctaaagaaaaatgagtagtaactaaggaggccatttaaatctcttcgaggctcctcgatttgggccaacaatttgtttattgattgtccttgttttcttttgttagtaggttctaaatattctaacattaattgatgtctaaaacacatcaactgatagtaaaggagtaagtcctgatcttcttccatttgattaatttccttctctacttcttcttttaaagcctctgcatccggtacgctaaactctcttatcattttataccattcgtggattttcactccgacttttgacgagggtattaactgtttcacttccgcctatacctttttatttcatttttgtaaatatattactataattcgggtgataataggttgaaaagtgaaaaaattttcggtatgccgcaataaaatcagcaacaaaaagacgcctgctaagacgcctgaatctctatatgctctttttcaagccgcacctgcagtattctcgaagggaaatttcgtccaccgcgatcttgaagggtttactatttgaaggaatttgcggataaaccctgtgcatccatgaaaatgaaacttggcctaataaagaagtaattcgatttgtgaatgatcaacttaaagaaaatattgatcttttattgatgcctgcaacagcttccacagctcctcgaaacccttttaaaataaagagttataaaaattgaccagcatccactctagtggaatctttccccttcacctgttttaacgtggctacgattagaaagctgacaatcactaataagagccatgaactcactttccctacatgaacgagactccacgtactggtttggtttggatatgtccaggccccaaaaaacgttgcgatattttcggctatccatataaaaaatccgatgagcacaaaagaaagtgcgagcggcatacggtaacgaatcccattaacctcgtatatgacccatgatttccaaaagacaattatcacaagtccagataaccaaaagcggacgtcaatccaaaaatgatggaggaaaaaatttaaataaatcgcagcggccagcggtacaacgacgtaaaacggcggccacttaaccagttcaaccttgagcctcctccaagcctggcaaagataactggctacacttgcgtacataaagccgctatacaaaggcaccccaaagattttggagtaaccttcctccggataagaccaggagcccatttgcaccttgaaaagctcaagagcaagtccaataatgtggaacaatgtgattacttttaattcatcccgtgtttcaagaccggaacgcaccatccaccattgcatgagaacacagatgatgagcagcaagtcataccgcggcaggaagggaagaggtatgatttgtgtaacagccaaagaggcaaaaataacgacaggaaatacacatgacaaggactgctcccaaccaaaacgaacgagttgttttagtgctctcatgatgtgtgcctccgaagtttttttctgaatatatgcgaggccagcttagtatagcagctaaaccggcttacaggtatgcgcataggatcaccgccaaaaaaatggtttctttccatattaaatacttttttaatcctgggtgtcttcatcacttcggtattccaaaatatctccgggctgacattctaacgccttacaaattgcctctaaagttgataatcgaatggcctttgcctttccatttttcaatatagaaagattcgccattgtgattccaaccttctcagaaagttctgttacactcattttccttttagccagcatcacatcgatattgattataattgccattgttatcacctcagactgttaaatcattttctgattttatatcaatcgcttcttgcaatagcctttggagaacagcggcaaagactgcgataaccattgaagcaaaaataaggaccaacccgatcagtatgatccctggagcgtcgtccatctctgcgataagatagaagagcggcatgcctgccgcaaataaaatactgatggtgattgcacagtattttatattctttaaagcccgtacagataattctgagaaagctttattctggtcaatatagcttaaaagtttaaaggcttgatacagagcaaaataaaaaggtatcgccgctgcatacaaatcggcatatacgagatatttcaaataagaaatacccggatacaattcggctgcaaaattcgctatttccggcacaaaaaatatgcacaaagcaagaactgggattccaataagaataacagctatctttaaaaagagagttgatccccgtttcattaaaagcacctcacttatttttgtcgatttgaatttaacacattatttatcgttttacaataaaaatatattgaaattgatgattttattattgttatggactgatcttttgatttttagacaagatggcgttacttgcggaaacaaagccgacacgtctgcagagtacacacacatcttgcagacctctacggattccgcttatatgcaaataaaagccctaaatatgttaagcgcgtactgaatcctacagatcgtcgaggagtgaaaaagaatcgatttttcccaaacatattttgaatttataatagaatagctttaaaggaatatgtatcaacaagtcgtctagcatatgttgtgttataaaataaaacagctggcgattggcgtgtctttccttttaacgtgaatagtcgaggagttatttgaggtgaagcagaagacgctgacgcatgatcgacgtctttttattgtggtaaacacagagcagagagtcttgttagattaaattaaaataagacgccaattaaggcgccttcatcttgtcttaaatccattcacaaaactttctccatccttctctgtcgcaataagctgctgggcgctttgactgattcgctgagcaagcgcctgctgcgcttttccttcgaagctgtagagaagcgatgaataaacgctgttcatttctttttgtatatcgtctattttaaacttcggtcttagcgtcgttttaatgccttcaagcttagttgcggctgttactctcatgcccgttttcagcatttgaagctgattgcgccgtatgaagagggtatcttcttgatctcagtttaagttgttgagtgaagccagtttgttgaaattttccattgtttcatctcctaaagtttaagccaatttgccagcattttatctttcgatttaaaatcttttgcaatctgcgccaggtatccgctgatgtcttctaaatctgaaatcgtgtcctttaatgaggcgatgtaagctttttcggcatgaacatcgtaaaatagcggattgccttttttgtcaaacgactgcgccaggtttttcagcgtattgtttacatcctcgagtgtcagcttgtcgtataaaccgtggccgacttgacggtaggtatcgtgcttcaggtcattgatctcggcgtcgtgttcctgataagcgttttcggcttcccgtttcatcgtccgcaagcatttactttttgcgcgagctgcttggcaacttcgggcgttactttaattgcgccacttccggatgcaacttccggtggaagcatcgcttttaaatttttgtcataaacgagttcatcgccctctatattttgaacgttgccgttttcgtcgaaggtaaagttgcctttgttgaggccgtgtgtatccggcattcccattgctgtggtagcaatgtagtctacagcgacattaaacactgtgccaaatataccgccgctatacttcggatctagtcgtatttgtcgttccacacgcgaagtagaggggtctttggtatatattgttctgcctgcgtgtcgttcgtactcattccaccagccggaaccagtcatatcatccggattgacaatcgcttttacagacgagtcatatttgccgcttcggatctccttttgcttttcttcagaatgcaatttaacgacggaaggattgttgaatgcgactgcgtatatatcattgttcacagcgctgtattcagcctctgcgccgccaagagagtgtccggtggttgaaataaccgtcgaggtgcctttatacttttgtttaacttcccgtaccagatcatcagcttgcccgatttgggacgttttcgtaattaatttgtatttaccggtgctaagcatcgcgtcttgtgagggggttgcgttgtattttcctattgtttttgatgtatccttcgcatctttttcgattatgtattgcgatttctttttcggatcaagacccataacaacgttaccgccgtctgcatcaataacatcttgaaaaaactgttctttaggatttgttccagcgaaggccacgacgacgttttctggtgcgttaggtttaacccatttaccgtcctttttctttgcttgaacaaaaacatacgcatcaagtccagtgtcagagtcccttttaattttatcaacaaaaaaagccttatttgatttactctctataggtgttctttccttgaatgcttctttcattttatcggtactatatgtgttttggctaagaaaataatactctttatctgttaatttaggaatatcgctctttttattcaggtacataaccccgcaaactatgtaaaatgtaacgtggaaaggatggttttatgaaaaaatacataattatccttcttgctctggtcattataacatctggaggaatatttatgaagcaacaaaataataacagagaaaaagaagagctttataatttagctaaggaaagaatgacagactttattaaaacgaattataaggacattaagtcaattgattattatgatgactacgaagtgaatccaatgggcggaattgatattaaagggtatctaaatgatgataagaaaaagaaaatatggggtatttacgataaggcaaatgacgaagttgggtccttcacagtcgatgctgaaagaaagcccgaatataaagataaaatttgcgattattaataaaaggcccgactcgattgagcgggcttttttctattttcatctctcgtttgtttaactaatcggtttttattaccccttttaggcctcctcaacataaaatagttcttcagtaggcacgtttaatcctctaaaatggataaattgcagttttgggcatttttaagatgggaagataacttgcatgcggaaataggataagctgtaaaacaacgaaatttttgatttatagttacatacttatagtgtgatgtgtaataaacgaaaggtgaatccattttcaggctatatggcttaagctttaatatgcatagttggttatcgggaaattgccttcaaaaccgtccaagttcataataataaaaagatattcgtattgagcaggcgtgcatcgttgcacgcctattccttttaagggcatttttttcacctagaacgaaagaacttaatgatgcgaattttattagttctattgtcctgttttatatattgagtaccaaaaatgcactccatatgttttataatgaagcgggcctaacaatcagcaaacatggagcggaatgcaataaaatcgtataagggcatgcagtatgaactggaggatacatttttgaaatataaaaaagcagcagcacttggaattggtttacttttatttataggcggatgtcagaagagcggggaagctgaaatcagcgtccaagattacacaggacaggattttcatattcatagtaaaggttatcagaaggaaaccgctgagatcgcagaagcgcatcgagatgaagttgaaaaaacggtaaaagattattttttggatcaatatagaacgaaggtaaaagtccataacattgtcggagggcatgggtttgttactgtgtatgccgaatcagtcggaaacttgcatttctacacaagcgcaaaaattgaaattgatttggacaagaaagaggtgcaggctgacgcgatcagctcatcggagtgggacgtaaaagactcgattacaagcgcgatatatgcgttggcttttgaagaagaatttgccgctctagattactatttagagaagctggcagaagaagagccggttgtaggtaaaacgcaggcagccgttgataacacaagcggtatgggatatcagacgccttattatgctgtttctttaaatgctgattggaaggatgacctttattcagcctatttagaaaacccaaaaagaagcaaaaaagactggcaagagaaattggaagatgaagaaatcaccccaaaatcatgtgatatcaatatacggttatatatgaataaaccaaatacaagaccggacgagcgcatttataatcaagttgtccaggatatcgaggacatggaagagctggccccggggacttacaccatttacttgagtgacaatagaatcaacaaaaacctaggatataattcaagaaaaagcacgcttggccgataaggtcttcctaaccgataaagagattggaaaccgatcaattttctgtatggatatgagcgggaaagaaaaagtggagatttcatcatctattttgaaaaataatgtcctggggaaccgttcgggtgtttcatttcgcacagtcgccgttttttcagctgtccaatcaaaaatcgattaaggcgctgtgcgatgcttcaaaagacatcctgaacatatcaaacttcttcgggatgatgcaggggacagaggaaaaaaccgccggaccaaggtggcaggcggttttccttttgtagaaaaacttgtggaaataaagcttcgtggaaatcgtgaattttttgctgtgaagggcggctgattaatgcagggagtctttaataattttatagtttttatgattgacgacggttaaggagtccagttccaagtctctgtagttttccataatcgtgacatcgacgatcacagagttttcgtttactttttctacgattccggtgagtccgtttttaaattcgatgacgttcccgacttttgcaattttcaagtgacttcctctcctttaaagtaaattaacctattgaaagtattttgcaatattttcttggagaagtaaagcgatttgggaagcggcatcactattgttgtacccggtgtgacttaatgatatagttaattagttaaagatgatgagagaaaaggggagagaaaagttgacagagcaaaatgccatcgatcagatcgagcaattaaggtcagggagcattcatgagctccgtgtgaaaaaagaggattttctttctttcagagccatcttaacaaagcaggaagattttaagcattttcgcggcattgcccagcatggcggagatattatatttcaatatatgaaagaggcaagaagctgaaaaaagctttctcagacaggctgagaaagctttttttatttgtgtgaagccatatgtttctggagattttggtgttttttgcatgaaatccgccggctgtctgcaataatgtgacagccgaacggtttgatggaagtcatgccaacattttggcaatgaaatcggcgaatcgtcttgttactgtaaaacatatgtttttttcgatgaagatttgacaaggaggaaggaaatgaaatcgaaatttgctgctctagctgcgtttttaatctgcatgctgccggcggcaagaatcgagcatgctcaagctgtcatgttgttctcgaaaaaagataaacaggaaatggaacggctgatggaaagccttaaacaagaagaaaatcctgctttttcccaattgacagatgagaaaagcttcattgaagccgcgcatctgtcagctgaagaggaggaggaaatagaagaagctgaagaagagacgactgatcttacacataaagaaaaagatcttttatcaaggcttgtacacgccgaagcgaaaggcgagtcatttgaaggaaaagtggctgtcgccaatgtcgtcctgaatcgggtgaaagacagccgatttcctgacagcgtaaaaagcgtgatctatcaaagaaacgcttttgagcccgttctaaacggcagcatcgagaaaaaagcagaccgcgaatcagtggaagctgtggaagaagcggtagatcaaaataaaaaagaaacagaagctttatttttctataatcccgacatcgcttctgatgactggattaaaacgagaaaagtcgtgaagcgcatcggcaatcatgtctttgcgatctagaaagcagtcagggccattcgccttggctgctttttttgtgcgattctttcttacgcattatcatctttcacagcccaagaaaaaatttatttttgatactttatgaaaatcaattttcaattaaaaagaaaataatttttagacttgtctcatatgatgggataaacccgtgagacaaggagagacctcatgaaccgttttgtaaaaggaatcgttcttctttcgctagctgctttttttgcagaatgtcttgaattcgtcatcaacatgattcttgcacgggagcttggcgagcatggcatggggctctacatgagtgttttgccttccatttttttggtcgtggtgattgcgagccttgagctgcccgtatcaatatcgaagtttatcgccgagtccaacccgaagctgcacgaaagcatgctgaaacatgcattgcggatgactgcggtctgcacggttttctccacggcagccgcagtgatcattcttccatttattccggtttttgattcttaccaccctctaatcagaggacttgtgatcgggatgattcctacggttgcattcacatcgatcgcgagaggctacttcatgggcgttcagcaaatgggtaaaatcgcaacggcgaatgccttgaaaaaaatctttcagctcatcggcttgtttttattttttcaatggtattcctttgaattggatacttctcttctcatttcattgtttgtcctcgttgcaagtgaagtggtcgtgtttgtttatttgttttcgcagtttgttttggtcaggcgtgccgctcaaaaagggcagcagatccacttgcggagaaacgatgttttaaaacgcctgctcactgtttcgatcccgacgacggggctgcgcgtgtttcatgctgtgacaaatgccgtcgaaccttttttggtgaaggggacgctgcttgccgctggcgtatcaagaacatcggccatcgaccagttcggcatgctttcgggagttgcgatgacaatcggcttttttccggcttttatcgcccattcactgatggtcgtcatgatcccgagcatttctgaaagctacgcttacgggcaatacgaaagagtgatcaaacggattaaacaggcgatctttattacgctgttttacggcataccgtccgtcatggtgatgtatcactttgcagagccgctgacccatttatttttcgattcggtcaaggcgtcgttttaccttaaaatgttgtggccgtattttttattccacttttttgcgatgccttttcaggcctgtttaatcggaatggggttggccaaagatgctttttatcataacgtttgggccagtgtcttatcgtttttgatgatgtatgttctcgggtccatgcagactttgcagatgacggggatcattcttgcgatgaataccggtatgattttgctgacggcgctgcattatgtgacgatttgcaaggagctgggcgtcacgctttttttgacaaacaaatcccgatctccgagaattgaaagccgctgatggatcctcttcatagttttagcttttgcggggaagctaatattaaaaaagaaggggagttcccatgcgaagaatcagtctcatttacccgctcatcctgctgttttttaccgggttattcgtatttcagccgcaggcatctgcaaaacaagcttcgccggcagtcatgcagatgaacacggtcgaaggtcagcgcgtcgtcattcccgccgaaggccagaagacgatcgttcatttttggacgacctggtgcccgccatgccgtgaagagcttccgcgattccaatcctactatgaaagcaagcaatccggcgtcaagctcgtgaccgttaatttactgaatgccgaaaagaacgaacagaaggtaaaacagtttattaaagcaaacaagctgacatttccgatcgtttttgacaaaaagggtgagatgatgaaagcatataaagtcatgacaattcctacgacttttttctttaatgaaaaaggagagctggagaaaacgtttgtcggccccattactgtagaacagatgaaggaatgggcagggaaaagctgagccgggagttcagctttttttaaaatgtaaatgataattaatatcataaagaaattataataattattatttgaaaacgtaggatgtcgtgctataatgagaaatagaaaagggtgtgtccaatggacaagtagcagtcataccctttatataaataaaatacttaatgtttatgctgccgatgaggcggcaatttgttttttaagaaggaaattgacgatgaattacattctcaattagggaggatattggagatgcaattagagatcgggaagcaatcgcagcaaaaccgtcacacgttgcaatttgaaaattggaggcagcacggggaattgatagctgcgcttttgtcgggtttgttgattcttgcaggctggctgttgtccggcaatgaaacattgtccgttgttctgtttattttagctttttgtatcggcggctttgctaaagcgaaagaaggtatacaagaaacgctgtcggaaaaaacgctgaatgttgaactcttgatgatttttgcggcggtcgggtctgcgctgatcggctactgggctgaaggggccgtgttaatttttatcttttctctcagcggagcgcttgaaacgtatacattaaataaaagcaaacgcgatttgacttcactgatgaaattggagccggaggaagccgttttgcttgaaaaagaaggaacaagaaccgtggcggcagccgatcttcaggcgggcgacctcattcttgtgaagcctggagaacgcattgcggcagacggagaaatcgaaaccggaaaaacgagtatcgacgaatcggctctaacgggcgaatccatcccagccgaaaaaacactcggagacgcggtttttgcgggtacggtcaatttgagcggatcgctcacggtccgtgtcacaaaggcaaatgaagattcgttgttcaaaaagatcattcggctcgttgagtctgcgcaaaacagcgtttcaccgtcgcaggcgttcattgagcgatttgaaaatatttacgttaaaggggttttgcttgctgtcggactgctgctctttctgccgcattttttgcttggctggagctggagcgagacattttacagagcgatggtgttcatggtcgtcgcttcgccgtgcgcccttgtcgcttcaatcatgcctgccgcgctgtcgctgatatcaaatggcgcaagaaacggcctgcttgtcaaaggcagcgtctttcttgaaaagcttggcaacagcaaaatcgttgcattggataaaacgggaacgattacgaacggaaagcccggcgtggaggatatgcttttagctgcagatatcgaggagcgcgaatgcttggaggctgctgctgcgattgagaagcagtcaggccatccgcttgccaaagcgattgtcgagtatgcagaagcaaaaggcatcaagccggccgcgaatgtgtcgattgaggagacgtcagggtttggcgttcaggctcgatacaatggagagacatggctgatcggcaaagccggttttgtcggggaagaggcagccgggcaatttctcacggcggctgttcaggagcttgccaagcagggaaaaacaattgtgttcatgaaaaaaggcgaagaaatcgcggggtgttttgcattaaaagaccaaatcagaccggaatcaaaagcggtggtcgaagagctgaacgcgctttgcgttcagacggcgatgctgacaggggaccagcctgaaaccgcagcggtcatcgcacgagaagcgggcttgaaaatcgtacattcagaatgccttcctgacagaaaagtagaggaagcgaaaaagctgcacaaaacatacagaacactcgttatggcgggagacagaatcaatgatgcaccggtcctagccgccgttgatgtggggcatccagtgcggggaggaacagatgtcgcactggaaacggctgacgtcgttttaatgaaaaacgaattgacaggactgaccaaaatgattcggctctcccggaaaatgaatacgatcattaaacaaaacgtcattttctcgcttgctgtgatctgtcttttaatctgcagcaactttcttcaaattcttgatctgccgctcggtgtcatcgggcatgaaggcagcacgctgcttgtgattttaaacggtctcagactgctgaaatcctaagcaaagaaacggctgcatgctaacggcagccgtttttcacatcagagggcagtttgaggaagaggcggcaataatagaagcgggcggcacccccacaatacataagcggtgagcaagagacgggaaaaactgatacaatggatatgatgcttttacattttacatgtatggtacggaaactgtctcaaggagtgaacagagcatggaaagaattgaacaaatctcttcctggctgaaagaaaaaaacatatcttcggcttttattcattcaaaagaaaacgtattttatcttaccggcttttatacagaaccgcatgaacggctgatgggcgtttttatttttcaagatgaagagccgttttttgtttgtccgcaaatggaggccggtcaggcgagagcagccggctgggcgtatgagatcatcggatacggggatcatcaaaacccttgggaactcatatcctcagcgcttcaaaagcgaaacggccaatgtttaaaagtggcggttgaaaaagaaacgcttgctctttcgcgcgccgaaatgctgcaggcggtcacaaacggtgcggagcttgtctctgcagaagaaaggctgaaccaaatccgcgtcatcaaagacgaaaaagaaatcagcatcctccgcgaagcggccaagcttgccgattacggggtcgaagcaggagccgccgcattaaaagaggggatagcggaaatcgatgtcgtcgctaaaatcgagtatgagctgaagaaaaaaggagtccaggggatgtcgttttccacaatggtcctttttggagaaaaatcgggacagccgcacggaaaccccggcagccggacgctcaagccgggcgatttcgtcctctttgatttaggtgtaatcattgacggatactgctctgatattacaaggacgctcgtgtatcaaaatgtgagcgaaaaacaaaaagaaatatataatacggtgcttcaagccgaaacggaggcgcttaagatgagcaaacccggtgtgagaatcggcgatcttgatttaaaagcgcgcggcatcatcgaaaaagcgggctacggcgattactttccgcaccgcctagggcacgggctcgggatttcgcctcatgaatacccgtccatgagccataacaatgacgaacttttgaaacaaggcatggtatacacgattgaacccggcatctatgtgccggaaatcggaggcgttcgcatcgaggatgatgtacttgttacagccgatggagcagaagcgctgacaaagtatccaaaagagctgactgtcatttcataaaaaatggaacccgccgtgcgcgggttctattttattacggaagtgaatcttttcatctcaccgtcaatcctttgaaatgaagaaatcgtcaaaggaacggaatggtttgatttcgtgtttttctttgaggggtttcatcgctgcttttgaagacagcacgataacgatacataataggatcagaatgaagatgcccattttccttctcctttctggaatgtaaacgtgttcagcaccggtgctgtcttcattctaaattatgaaacgctttccatatcaagccctaaatcaataaaagaaacttctgatgccaaagggttctggaatattttgaccatcgcttgagtttattggggctgcatgctgccaaaaaagtcctgtgatgatcgtttgatgaatgaatctatgacgcctttttgcttttgttttggtgatttagtttgatcaaaagataatcggattgcatcattattctcatgtgaaaaatttgtatacttagctcagaagaaaggggggattacacgggaaaaacactgataaattactgttttagacaaaatcttttcatctcgcatccagatatttcagtctccgcaacgattgcggaatcacccataaaacaaataagcattaaggatttttctaatgatttgaagccatccattacctctgaaaggaagctagaaagagtgaaaaaattagggtttgtactgtttatgtcgatgtttgcttttgtcagtgtagtaccggcagctgaggcgaaagtcattgatcatgacaaagtgcaaggcttcagcgaagtgacccctgtgacggtttcccaaaaagcggccaaacgttttcagccttatttgaaggttgcgagcggctgcgtgccttttccggcagttgacgcacaaggcaacacaagcggaggtctggagcctaccggagcgcccgaaggccactgcagcaaaagcgtgggacaagtgtactcacgatccgcatggtataatggagtttgggcgattatgtatgcatggtattttcctaaagattcacctctgcctttaaaagcattcggccatcgacatgattgggaaggtatcgtcgtatggatcgacaatccggcaaatcaaaatccaaaagtgctttccatcgcttattctcaacacggtaaatttcaaaaaacagcgccaaacaacaatattatggaaggcgatcatccgaagatccgctatgatgctcctcaaccgccgatcaaccacagcctatatgtggacagtgcaaagggcggcacccagcctctcatcgggtgggaagatttgacgcctgccgcaagaaacgcattgaacacaacggatttcggaagcgcaaacgttcctttcaatgatcacaatttcacgaataacctaggaaaagcatggtttagataaaaaatatttcgagtatccggctgattgtgaaatattttcatatcagccgatttttttcgccgccttgtacctcctccgaaatcttcttcgctgttttcttcatatcaatagaatcccgaaaaaatggccaaaaggatcaaaatctatggctcaaagcgatataatttctttatgatgaaatgatccggatgtgcgaaaagatttgaatgaaagaagggaaacgaatggcaaatatcagggaaatagctgaagcggcaggggtttccatcacgactgtttcgagggttctcaacggccacccgtatgtcaaagaagaaaagcgtcaaaaagttcttgagacgattgaacgcctcgaatatgcaaggaatatgcatgccgttcatttatccaaaggcttttccaacatgataggcgttgtgctgccgaccatcagccttccttatttcggcgagctgctggaaggaatcgctgaagaagctgcgaaggaaggcgttcacttttcgctttaccaaacaaattatcaattggaaaaagaaatttttgcattggagcagctgaaacaaagacaggtggacggcctgattttctgttcaaaagcgatgtccgatgaagcgcttttggactggcgtgaaaccggcccgttcatcctgtgccaggactcaggcgagcagcactttgcaacggtcagcattccgcataaagaagcattcagacttggattggattttttaattgaaaaagggcacacaaaaatcgcgattggtttggcaaggaaaaacggcatgaacagccattttcgcctcaaggcatacaaggaagctttggccgcgatcggggagccttaccgggaagagtgggtatttgagcggtcgctgacaattaccgacgggcaaaaactgttctccgaatggaaagggatggaggagaagccgacggctgtttttgtcgcaaacgaccaagtatcagccggtatttttcttgaagcgcagcggcatcaagtggatattcccggaagcctcgctattttaagctgtgacaaccagccgatcagcgaagtgctcggcatttcaacaattgaaatcaatataaaggaaatggggaagcgcgcgtttcgccttctgcaaaaaagaatcggcggcgccgggccggaaaaactgactgttccttacaagctgatcaaaagggcgactgtgtaatcaaaacatcaatctttttccagacagtgatcaaaattcgacatttttcatcaaaaacgtcaaaataaattgacgcgctttcatgagttttgtacgatatgagagattgatgacaaaaaggagctgaggatcgtgaacagatcctttaccgttgaaaaggtactcaacaacaacgttttaatcgctctccatgatgattacagagaagttgtcttgattggcaaaggaatcggttttggtaaaaagcgcggagatcttatcgaacatgagaactacgaaaaaatgtttatcctggaaaatgataaggaacaatcgcagtataagaagctcctcacttatgtcgatgaaaaaatggttgatatcgccaatgatgtcatctaccatatcgcgcaaaaaatcggccagccgctgaacgaacacattcatgtcgccctgacggaccatatcgcatttgcagttaagcgtctagaaaagggatttgatatgaaaaatccgtttttgcttgagacggaatcgctttatccgaaggaatacgaagtcgccaaggaagccgtcgatatgattaatgaaaaatccgacattcagctgcctgaaggtgaaatcgggttcatcgcgcttcatatccacagtgcgatgacaaaccgcccgctttctgaagtcaatcagcattcacaactgatctccaggcttgtccaggtcatcgaagattcattccagatgcaagtcaacagggaaagcgtgaactatttgcggctgatcaggcacttgcgctttacgattgacaggataaaacgggacgagccgattcaggaaccggaaaaattaatgttgttgttgaaaacggaatatccgctgtgttacaatactgcttggaagatgatcaagatcttgcagcaagcgctcaagaaaccggttcatgaggcagaagccgtttatttgacattgcatttgtaccgtttgactaataaaatttcataacgcctttataacgtgttactgattcgatcaggcatgagtgaaaaaaggggagaaatgaagacgctgtcttttgtttcttagtgtacccgctttcaccatgccttttttgtcgttctaaaggcgaaatgtaaacggtttatttagatgaaaaagcagtcttttgaacgaagttgtcatgaatttttgctgtaaggtcaaactattcttagagggggttaaaaaatgtttaaatcgctatttggcgttctgcaaaaaattggacgagcgctgatgcttcctgttgccatcctgccggctgcagggattctgctcgcgcttggtaatgccatgcaaaatccgcagatgacaaaagtcgcaccattcttaacgaacagcaccgttcagcttgttgcgaaagtgatggaaagttcaggtgacgttgtgttcaccaacttggcgctccttttcgctgtcggggttgccatcggtttggctaacggcgacggcgttgccggaatcgctgctattatcggatatcttgttatgaatgtcacgatgagtgcagtgctccttcaaaacggttcaattccaagcgatgcagttgaaagagcacagttctttactcaaaaccatccggaatacacgacaatgctcgggataccgacattggcaacgggagtattcgggggtattattgtcggtgtcctggccgcagccatgtacaatcgattctacacaatcgagcttccgcaatatttaggattctttgccggaaagcgctttgttccgattattacatctatttgtgcattgctgctgggacttgttatgctgtttatctggccgccaattcaaggcgcactgaacagcttttcaacgaacctgcttgcagccaatgaagcggtcgcagctctcatcttcggaatgattgagcgggctctgattccgttcggtctgcaccatattttctactcgccgttctggtatgagttcttcagctatacgaaccaggcgggagaaattgtccgcggtgaccaaagaattttcatggcgcaaatcaaagacggcgtcgaattgacagcgggtacatttatgaccggtaagtatccgttcatgatgttcggtcttcctgcggcagcgcttgccatttatcatgaagcaaaaccgcagaacaaaaagcttgttgccggtattatggggtcagcagccttaacatcattcttaacagggatcactgagccgatcgaattctcattcctgttcgtcgcaccgattctgtttgcgattcactgtgtgtttgccggcctgtcattcatgatgatggacatcttgaatgttaagatcgggatgacgttctccggcggtttgatcgactacttcctgttcggaattctgccgaaccgtacagcttggtggcttgtcattcctgtcggtttagtcctggctgtcatctactacttcggattcagatttgccatccgcaagttcaacttgaaaacgcctggacgcgaagatgcagctgcagaacccgctgatgaaggcaaagaagcagcaggagatcttccttatcaaattcttgaagcgatgggtgaccaggaaaatatcaagcaccttgacgcttgtatcacaagacttcgcgtaacagtcaacgatcagaagaaagttgacaaagagcgcttgaaaaaactcggcgcttccggcgtgctggaagtcggcaataacatccaagcgatattcggaccaagatccgacaatttaaaatcacaaatgcaagacattatgtcaggccggacgcctcgtcctgaaaaagcgacctgcgagggacgctgtcgaggaattggtgagctctcaaatcaggaagaatcgtcactggtcatgagcctctcgtcaaaacgaatcaggtgaagaagtattcgtttcaccgcttgcgggtgaacttcatccgattgcagatgttccggaccaagtattctccggaaaaatgatgggtgacggatttgcgattcttcctgcagaaggcacagttgtgtcacctgtaagagggaaagtgctgaacgtgttcccgacaaagcatgcgatcggtctgcagtctgacggcggcagagaaattctgatccactttggaatcgacacagtcagtctgaaaggagaaggcttcacttcatttgtttctgaaggtgacagggttgagcctggccagaaactgcttgaagtcgacattgaaaaagtgaaggacaatgtaccttccctgatgacgccgatcgtgttcacgaaccttcaagaaggagaaagcgtgagcttgcaggcagaaggcaatgtcagcctgacacaggacgacatcgtccgcatcgaaaaataaattcacaaaatggccgtacttgtcagatgacatgtacggctgtatgatataatattgtgaatgtactcaaagctttaaattaaaaggagattgataaaaaatggcacaaaaaacgtttaaagtaactgcagattctggaatccacgctcgtccagcgactgttcttgtacaaacagcaagcaaatatgatgcagatattaatttggaatataacggaaaaacagtaaaccttaaatctattatgggcgttatgtcactaggtattgccaaaggtgctgaaatcacgatttctgcttccggcgctgatgaaaatgatgctctttccgcacttgaagaaacaatgaaaagcgaaggtttaggcgaataatgcttgaattaaaaggaataggcgcttcagccggtattgcgattgcaaaagcatatcggcttgaggagcctgatctaacggttgaaaagaaaaacatctctgattctgatgcggaagtaaatcgttttgaagacgccatcgagcgttctaagaaagagcttgaaaccattaaaaaccatgctttgaaagagcttggcgaagataaagcggaaatcttttctgcacatttgttagtattaagcgatcctgaactgttaaacccgattaaagacaaaatcaaatctgattctgtcaatgcggaattcgctttaaaagaaacggccgacatgttcgtcaccatgttcgagtcgatggacaatgaatatatgaaagaacgcgccgcggacatccgcgatgtcaccaagcgtgtcacagggcatcttctcggcgttgagattccgaatccgagcctgatttccgaagaagtcatcatcgtggccgaagacttgacaccgtctgatacagcgcaattaaaccgcaactttgtaaaagggtttacaacagatatcggcggacggacgtcccactctgccatcatggcgcgctcgcttgaaattccggccgttgtcggcacaaaagcggcaacgaaaggcatccaaaacggcgtaacagttatcgttgacggcatcaatggcgatgtcatcgttgatccttcccaggaaacaatcagcgaatacgaagaaaagcatcaagccttcctggcgcaaaaagccgaatgggcaaagcttgtcaacgaaccgactgtaacgagcgacggccatcacgtggaacttgccgctaatatcggtacacctgatgatgtaaaaggcgttttggaaaatggaggagaagcagtcggcctttaccgaactgagttcctttacatgggcagagaccagcttccgacagaagaggagcaatttgatgcctataaaaccgttcttgagcgtatggaaggcaaatccgttgtcgttcgtactcttgatatcggcggagacaaagagcttccatatttagaactgccaaaagaaatgaatcctttcttaggatacagagcgatccgtctttgccttgatgagcaagagattttcagaacgcagcttcgtgcgctgcttcgggcaagtacatatggaaacttaaaaattatgttccctatgatcgcgactgtaaacgaatttaaagcagcgaaagcgattcttttagaagaaaaagaaaagctgaaagctgaaggccaacaagtttccgacgacattgaagtcggtatgatggttgaaatcccttcaacagcggtcatcgctgatcaatttgctaaagaagtcgatttcttcagcatcggaacgaatgacctgattcaatacacgatggctgctgaccggatgaatgagcgggtatcttatctttaccagccatacaatcctgcgattctccgcctgatcacgcttgtcattgaagcggctcataaagaaggaaaatgggtcggcatgtgcggcgaaatggcgggagatgaaattgcgatcccgatcctgctgggtcttggattggacgagttctcaatgagtgcgacgtcaatcctgccggcaagaacgcaaatcagcaagctttctaaaaaagagacagaatcgttcaaagagcaaattctgtctatgagcacaacagaagaggttgtacaattcgtaaaagaaaccttcaacctggcataagcaattgaaaatccggaccggcatcaccaatgcccgtccgggttttttgtttatctgaatgatcccggctgcggcggagataatacatgtgaccaattgttagaaagggggattctgatatgcctaggcagccattcaaactgggagatgaggtgtatgtcatttaccggaatccgcatgcagcgaatgtggcgcatataaaggaagctgaagtcgttgatcatccgcttcacgaaggcgaactggcattgtttatgtatgatacatatcacgcctttgccgaagatgatgccgttttttcttcatatgaagaggcggaacggctttaccgtgaattatttgacgggatatgaagacattaccggtatatcacatcctctaaatgcaaaaagtaatggaaatatgcaaaggatgtgtctgtttccaatggtaaaaccgtttgttccccaactcgtctatattgaaccgagagccctggaatatccgcttggaaaagagctgagggataaattttcaaacatgggacttgagatcagggaaacaacttcacacaaccaggtgaggaatatcccgggggaaggccacctgcaaaaatacagaaatgcgaaatccactttggtgatcggcgtcagaaaaacattgaagttcgattcgtcaaaaccgtccgcagaatacgcgatcccgtttgcaacagggtgtatgggtcactgtcattactgctacctgcaaacgacaatgggcagcaagccgtatatcagaacgtacgtcaatgtggaggaaatacttgagcaggcggatcaatatataaaagaaagggctcccgaagatacgcggtttgaagcttcctgcacatccgatatcgtcggaattgaccatttgacacatacgttaaaacgcgccattgagcatttcggtcaaaccgaccatggtaagctgcgtttcgtgacaaaatttcatcatgtcgaccatttgctcgatgccaagcacaacggaaaaacgcgcttccgcttcagcgtgaatgccgaatatgtcattaaaagctttgaacccggcacatccccgttggataaacggatcgaagccgccgtgaaagtagcggaagcgggctatccgctcggttttatcatcgctccgatttatattcatgacggctggcaggaaggctacagagttctgctggaaaagctcgatcgtgcgctgccgcagcatgcgaggcgcgacatcacctttgaaatgatccagcatagattcacgaagccggcaaagagagtcattgaaaaaaactatccaaagacaaagctcgaactggatgaagaaaaacggcgctataaatggggcagatacgggattggcaaatacatttatcagaaggatgaagaagcagagcttcgcagcgcccttgaatcgtatatcgacaactattttcccgaagcaaaaatcgaatatttcacataacagagctttagttgataaagctctgttttttgttttgaaaacattatgttaaaaaaggatttttccactccattaacaccgcataatcaagcgattcctcatcttcaatgtagccgggaatcacacaaactggagagcgtccgcaatgaagcaggaacgagagcactggatcgcgcttttccccgtccaatacagcttgaacatactgttcgggcgtcatttcttcagccgacttgtgataatggggaatccgtccgccgccaatgagacgcttgagccctttaaagaccgtcagttcatacatggattgcatcagccgcattccgatgccgagttttcgatagtcgggggacacggaaatatcgacgacataaagggagtttccatcgttttgatgtgtgccgatatacccgttgtccgtcacttcatcccagctgtggtgcggatgatgcggatcaaaatcagccatgagcgctgtcatcgaaccgatgatgcggccttcggaaactgcgcaaagcgctccatcgggaaatcgttcaatatgggaatggagctgctcttcattccacagaaggtcttccggaaacggaggcggaaagcattctctttggagagcaatcaaaccgggaatatcttttttgctgtaattgcggatgtccacctgctgataagaagtgccgttatcgacgtaaaactgtttatagatcgccaatcactccttttgctatttcctccattataccgttattttaacaggctatcttaattttgcgaaatttttgccgataaaaagaatatgaaggtgcatgtaaaggagggtttcatttgtttaaaaaactgcatgtcaaaattgccggatttgttgccgtcctgctggttttgacggttatcgtcctacagttctcgacaacacatttgttgaaatcgatgcttgaagatgaggcaaaagaatcaacgtccagcctcctcggttcaattaaaagaaatattgagcttcaattagaacactacgagatttctttgaatcgtataagtgatggagaaatggctcactcattcttaaaagacggggataataaaattataaaaatcgtcaatgatgaattaaaacaattaaaagaaaaaaatgagtatgtcaatttagcttatatcggcacaaaaaagaaggaaatgtttacatttccgaaaacgacctttgatgatgattataatccggctgaaaggccatggtatacgtcagctgcaaaaacacccgacaaagtcgtttggacggaaccttacaaagatgcggtttccggagatatgacagttactgcggcaaaagccatcgtcgtcaataataaagttgaaggcgttgtcagtatagacttgtcattgaattcattgaacaaaattatcgaaaatcaaaagatgccttatgacggctacgcatttattttggaccaaaacgggacaatgctcgcccacccgtcaaaacagggcgacgatatatcgaatgataaaacatatcgggacatcccgtcatcaaaagacggaatcaaagtaggcaaagatactgtgatcgcttatcagactgtcggcggtacgggctggaaagtcggtacgcagttcgacacggcgaagctgatgtgggtcgcgcaggaaatgaacaaaatggtcattatcgtttcaatcattgctctggcagcggcgatcattttaagctatttcgttgccaaaacgatcacaggcccgattaagcagctgattgccaaaacaaaagcagtcgctggcggcgatttgacggtccaaacagcagctgcctcaaaagatgaaatcggtatattgacaaaagactttaacaagatggtcgaacatatgaaagaaatgattgtgcaagtcagatcatcgtccggaaaagtatcggatacgaccgatcaattaagcgctgtttcagaagagacggtttctgcgagcgatgaaatcgccaaagcaatcgaagaagtggcgacaggcgcgactgaacaggcggctgaggtcgaaaatgtcaatgaacaatccgaacggctgtctgtcaaaattaaagaaatcgaacatcatgccgacagcatcaagaaactttcgagaacatcagaagaagcaagctatacaggaatcgatgccctcgggcagctgcttgcaaagtcaaatgaagcaaactcggagacaaagaaagtggaacatatgctattccagcttgaagaaaaaacgaaaaacattgaagacgttgttacagccatctcggcgatctctgatcagacaaacctgcttgctctgaacgccagcattgaagcggcccgtgccggagaaagcggacgcggttttgcggtagttgcagaagaggtgagaaagcttgctgaacaatcggcggtttcttcacagcacatcagtgaaacggtcaaacagattcagatggaaacgaaagaagccgtttcagcgatgacagaagcaagcaagatgaatgaagtgcaaaatggaatgattcacgaaacaggtgaagcgctcagcaaaattactgctgaaatgcaggcgctcgtcaactcaattgaccacatttattctgaaatctcggatatgagcggagagcagcaaaaaatgtccgattcgattcagagcatttcagccatttcccagcagtctgccgcggctgcggaagaggtcagcgcttcggccaacgagcagctgacagcgctggaaagcatcgcaaaatcggctgaagcgctgagcgaggccaaccaagaattattaaatgcgatcaataagtttaacgtgtaataaagaggtccctcttgttgaaagagggacttctcctttttcaacattcacaatcccaattttcagaatatacgtgttacactataagaaggaagggagtgatcattgtggacttaaagatgaatggcaaaacagcgcttgtggctgcaagcagcaaaggacttggcaatgcgatcgccaaagccattgcgaaagaaggggcaaatgtcatgctgtccgggagacacgaagcggacttgaaaaaagccgcggaagagctgaacggactcggcggcggcaccgtctcttatcaagtatgcgatcttgcagacgccgacgggatcaaagcgctcgttcaaaagaccgctgacacatttggaacgatcgatatgcttgtcaacaatgtcggaggaccgaagggcggcagcctgcttgatctgacagacgatgactggacctcatcatttgaattgcatctgctcagctatgtccgtttaatccgcgaagcttttccatatctcaaaaaggatgggggacgcatcgttaatatcgcttcatcatcagtcaaacagccgattccgggcttgctgctttccaacacgtttcgaatgggaatcgtcggtctgacaaaatcgattgccgaagagttggccgaacaccgcattttgatcaacacgctcgcccccggaagaatcgcgacggaccgcgtggcagagcttgatcggctgaaagccgagaaaacaggcctttccgagcagcaggtgaaagaaagctatgagaaagaaattccgctcggctcctacggaaaacctgacgactttgcacagtatgcaagctttcttttatcagagtgcaatacatatatgactggacaaacgctgctgatcgacggcggaatggtaaaagcaatttaagggggatgagaccatgaaaaaaacggtcggatttatcggactcggtgtaatgggaaacagcatggcctcgcacattttagccgcgggctatcccgtcagcgcctatacgagaacgaaacacaaagcggacagcctcgtggaaaaaggggcggaatggaaatcatccgtcaaagcactggcgcagtcgtctgatgtgatcatcacaatggtcggctacccaaaagacgttgaagaggtttactttggaagcgaaggcattattgaaaatgccaaaaaaggttcctaccttatcgatatgacgacttccaaaccttcgcttgccaaacaaatcgagactgccgcaaaagagaaaggactttacgctttggatgctccggtttcaggcggggacgtcggcgcgaggaacggcacgctcgctatcatggtcggaggagaacggaaagcttatgatgaatgctacccgctcttttcgatcatgggtgaaaacatccagtatcaggggccggccggaagcggccagcatacgaaaatgtgcaaccagattgcgattgccgcagggatgatcggcgtcgcagaagcgatggcctacgccgaaaaatccggactcgatcccgacaacgtgctgaaaagcattacgaccggcgctgcgggaagctggtcgctctcaaatctagcgcctagaatgctgaaaggcgactttgaaccgggtttttacgtcaaacactttgttaaagacatgggcatcgcgcttgaagaggcggagctgatgggcgagaaaatgccggggctcgagcttgcgaaaagcctttacgacacccttgttgaaaaaggcgaagaaaacagcggcacccaaagtctgtacaagctttggacagaatacaaataacgaaaaaaaccacttgctgcatgcaagtggttttttgctggttcttattttccgatgaactgctgagtccagtagttgccgtccttcacatatccgacaccgatatgcgtgaagttaggattcataatgttttttctgtggccttcactgttcatccaagctttgacgacttcttgaggcgttttttggccttttgcgatgttttctccggcagtgcggtatgtgatgccgaatttcttcatcatgtcaaatggagaaccgtaagtcgggctgttgtgatcaaaatagttgttatctttcatatcttgagatttcgtgcgggcaaccttgctcagcttttcatccaatgtaagaggttttagcccttgtttctttctttctgcattcgtcagttcaacaacttctttttcatacgcgcttacagaagaagatgcaggcgctgtattttgcttttgctgtgaagtctgctcttttgaagccgcaggctttgaagctttaggagcagaagccttcggtgcagaagctttaggctgttgagttgcttgtttcatataagaatgaagcagggactgaattttttcttggtcagctttagaaagctggttcatgttttggatattcagtttgcccgcgagatcagttacatttatggaatgaacggttttgacttgtacttgctgctgctctttagcgtctgcgtgctgaacgccgctgaatgtgaagagcgttgctgcagctgctgctgataaaagaaaagcttttttcataaacagtaatcctcctaaatgttgtagtagttgttgtttcgtacactagaatcataacatggcttttttgaaataatagatccatatattccctttgacaaggtattattgttaattttgacataaaaaaagaaaaaccctttgctgccaatatgcaaccagatcgttcttttacacgtcttgtcataaacgtggtaaaatttaaatttgttagttaaattttaatataaaaagagattgacagcttttttgaaaactttagattgtaacaaccattacaaaagtgttacaatatatctcagttaattaatgtaaaattgaatattgtgagaggagagagagtttcagtgacagaatctcaacatgatccggctgaaatcaaaaagagcaggcgttcgcgtttatggcggatcaacctgtacttctttgcggtgttcactttgttcgctgcgctgattgtcaagctgggcctcgtgcaaatcgtcaatggagaggcgtatgagcaggaagcttcgaaaaccgaggcgaaaattgcgtcatacccggcaccgcggggtaaaatgtatgacagatacgggcgggtggttgtcgacaaccaaagcgttcccgcgatcacatatacgatgatgactagcacaaaaacggaggaaaaaatcagcacagccaaaaaactcgcagaattgatcgatatcgatacttcgtttctgaaagagagagatctgaaagattactggcttgccagacacccgaaaaaagctgctgcacttctgaaagacagcgagaaaaccctcaagtctgatcaaacatacaagcttcaggtggaccgcgttccggcggaagagatcaaagcgctggaaaaggacaaagatgagcttaaagtcgcagcgattttcagaagattttctggcggctatgcgtatgagccgcaaatcgtcaaggcgatgagcccgaaaaccgcggggaaaaacgatgcgcagctccttgatgagaaggcttctaaacagatgccggccaacgatttgacgtatgaggaagtctcacgcgtttccgagcatcttgaggaactgcccggcgtcgacgtcatcatggactggaccaggaaatatccttatgaaaaaacgctctactccattttcggaggcgtcacaacgcctgaacaagggcttatcaaggaccgggaagacttttacctgacaaggggatatgcccggaatgacagagtgggaaaaagctatctcgagtatcaatatgaagaatatttaaatccgaaaaaagcgaaagtccaatataccgaaaaccgttcaggaaaggttatcagccaggaaacggttgatgaaggaagacgcggctacgatctgcagctgacgttcgacatggagctccaaaagaaagtcgaagaggctatcgaagaggagcttaataaattccgcggctcaaactacatgctggacagagcgttcgtcgtcatgatggacccgaataacggagacattctgtccatggccggaaagcggatcgtcgacggcaaaatcaccgactatgcaatcggcgcgtttacaacccagtacgaaatgggatcggcggtcaaaggcgcgaccgtgcttgccggctatcaggacggcatgccgcatgggcagagttatttagaccaagagctgagcttcgcagggggagttaaaaaaggttcctacagaggaaacactatcggttgggctaatgaagttagagcgctggaaaaaagttcaaacgtttatatgttctatgtggcaatgagaatggcaggaattacgtatgtaccgaacggcccgcttccggcgaacctagaggacttaaagaaaatgaggtattacttcaatcaatttggccttggggtaaaaacaggcatcgacttgccgcaggagtcggccgggatgcagacaaacccaaaaatagtcgggggtctcctcctcgatgaagcgatcggccagtttgacacgtacacgcctttgcagctcgcccaatatgtttcaacgatcgccaacggcggatacaggttgcagccgagagtcgtgaaaagcattcaccagccagaaagcgaaaaactcggtccggtcattgaagagcgctctgccaatgtgctgaatcgtatcaacaattctcaaagcgacatcgccatcgtcaagcaaggatttaaacgagtaacccagacgggaactgcagccggcgcattcggttcgcttgacgtatcaggcaaaaccggaacggcgcagacgcaatactacggcacaaaccgaaactggtgggggactaggacttacaatatcacctttgccggctattacccgtcggaaaatccgcaggtcgccttcagcgttgtcgtcccgaatgtcgacgacaaaacgaagatgaacaaaaacatcgccgccaaaatcgtcaaagcctatgtcgatctgcaaaaaaaatacagcaaagattagacaaaaaagaacacggattttttccgggttctttttttgttatcaaaatttgacgaatgctagaagttttgaaggagatttctcgcattttagcgaatccttttaagcaaaatagttttaatgaatgctggtcatgaatagggtataaaggagggatatgatggaacaaaaaacaaaacgttttgagcaatataagcctcatatgaatttacaggcagtcctgtcagctaacggccgttttatatacatatctgcaaattgcaaagagctcttaagctacgagcagaatgaactgatcggtacgtatttgaaggactatttacacgaagacgatctttttctggtagaaagctatttttacaatgagcatcatttgctgccctgcaccttcagatttgtgaaaaaagactacacgatgatctggatcgaagcatcgatcgatttcgtgacgacccatgttggagaaaaagaacgcgaaattgtactcaaaatgaaagtgtttgaagaccgtccctctaagaaaagcagctccataaaagaggaagacgctccggaagaagcctccaggctgccggcaaaagaggaattcgaagccatgatcgaaggcttgccaaaccctctgtgcatcagcgttcaaggggaaatagtctacgtaaatgacgccatggtcaacctgctcggagccgagcataaacggcaaattatcggaaagtattcctacgattttatcgagaaagagtaccatgacatcgtcaaaaaccgcattaagcggatgcagcagggacttgatgtcggaatgatcgagcaaacgtggcataagctcgacggcacgcagattcacctcgaagtcaaggcggcgccgaccatttatcaaaaccagaaagcggagctgcttcttctcattgacatttcatcgagaaaaaaatttcagaccattttgcaaaaaagcagggagcgatatcagctcttgattcaaaactcaatcgatacgatagccgtgattcataaaggaagatgggtctttatgaatgaatcgggcattcgtctgtttgaagcaaagacgtatgaggatttaatcggcaaagatatttacgaacacctgcacccatgcgatcacgaagatgtcaaagcgaggctgaaacggatcacagaccgccaatccgaatctgaaatcataaaacagacgtggtatacatttgaaaaaaggctcatctatacagaaatggtttgcatccctacgacatttttcggggaaacggcggttcaggtgattttaagggacatttctgaacgcaagcagaccgaagagctgatggtccgttcggaaaagctgtcgattgccggacagcttgcagccgggatcgcccatgaaatccgcaatccgctcaccgcgatcaaagggtttttgcagctgatgaagccgacaatggaagaaaatgaacattattttaatattatcttttccgagttaagcagaatcgaattgatcttgagcgagcttctcatgctggcaaagccgcagcaaaacgcattgaaagaaaagcttgatctgatcaggctgatccgcgaagtgacggcgcttttagaaacgcaggccaacttaaacggcattttgatcaatacgatcctcacagacgacaaaatttacattaaaggggatcaaaatcaattaaagcaagtgtttatcaacctaatcaaaaacgccgtcgaatccatgccaaacggcgggacggttcatttgacggtcagagaaaccgacgattcggtcgtcgtcgaggtggaggacgaaggagaagggatacctgaacatgtcctgaagcggatcggcgagccgtttttgacgacgaaggaaaaaggaacaggcctcggtttgatggtcaccttcaatatcatcgaaaatcacaacggaaccatcgaagtcgacagcaaagcagaaaaaggcacgacatttaagattctatttccaaaataaaataaaaaaacaacggcgtaaaagccgttgtttacgtagtctgtatcgattgcctcttattgaaaacaaaggactccagccggtcaagaccttcccttagcgtatcaggagaatatgcgtaagagatcctcacatagccttccccgtattcagaaaacgagctgcccggcacgatcgcaagcccctcttcttcaagaagcgacatgcagaagtcaaaggaagacattccaaacgatttgatggacgggaaaatgtagaatgctcccgacggtttaatcacatcgaggcccatcgtcacaagtctgtcgtacacgtagtccagccgttttttatactgctcgcgcatgatcagagcgtcatcaaacccgttggtgacggcttccagagcagctttttgagaaatcgatgaagcgcaagatacgttgtattgatggacttttaaaatatgctttgcgatttccttcggtgcgaacaaaaacccgattctccagcccgtcatgctgtgggatttggaaagcccgccgatgacgatcgtctggtcccttagcacagttgcgatcgagtggtgcggtctgtcaaaagtgagttcgctgtatatttcatctgagagcacaaagacgtttcggccttttaaaagggaggcgatgtccttcagctcttcttcggacagcgtcattcccgtcggattcgacggatatggaagaacaacacattttgtcttcggcgtcagcgcttcctcgatcaattttgctgtcagcttaaagccgtgggacgtggtgtcaatgatcaatggagacgctccgcacattttgatgatcggctcatagccggggtataccggccccggaagaatgacttcatcgcccggagataaaatcgtgcggaatgccgaatcgatagcctggctggcgcctgttgtcacaataatctcgctttccgcttcataatttaaatcggcttttttcttcatataaagctgtacagcctgcctcagctcaggatatccggcgttgtgagtgtaggatgtttgattctcatctatcgcttttttggcggcctgtttgacatggtggggggtgaagaaatcaggctggccgattgttaaagagattacgttttcgtactgggatacaaggtttgagaacttgcggatccctgagatttcgatttcttttacatttggattaagcaaatgttccatttagcatcaccttaaaaatgttatggtttatcttattttaccatcatcagaccaattgtcatcttttaatcaatcaattttataaaaactcgtaacaagtatatgcgaaacgatgcaaggtatgcggacatgcggacggcggcagatagaaaaataagacaatcaaacgattgccttacgttatgttccgtttagtagccgtaatcggagtcaaaatcttctttccacgaaatatatatttgttcttcactgtctgaagcttccttgagcatttctgtgtaaacggcccggctgacctcttctaaaatggtcatttcatgatttttaatcgctacaattgttcccatcataaacacctttcctgaaaaatccttgaccattgtaacacgataaatgtcaaagtcaatgaaaaacttgtgatccgtacattaatttaactttaaaaaaatgcgatacgtattgataatgttcagccagtcttagtagtatatagaagtcaagatgttaggaggaaaagcacattggaattggaattagacaaacacgaaactgctcctgaaaggagcgagtatgccggaatcggcgcgcgttttgtagcttccctgctcgacggattgattctcgggattcccgcatatattttcacgtacgttttaacagcgacgttgatgttgggaaattcggatatcatgctcatgatggagactgatcccgagtatttgagcgatcaggaagtctttacgtttatcatcagtatgttcaaaaccgtagcgatcgttggaagtattacttttattgtgtattttctttattacacgctgatggaatcatccaaatggcaagggacgctaggcaagaaaatcatgaacgttcaggtggcgaaggcagaaggcggaagaatctcattcggccgtgcagccggaaggtttctggccaaaagctttctatctccgattttgatgatcggctacattatggccttttttacagaaaggcgccaggcgcttcatgatatgttggcaggaaccattgtcgtaaaaaaataacgggcaaaagacagcacgctttcagcttgaatgcgtgctgtcttgttcaggaaaatgtttcacggcaggaataaaaataaggaggcatcaatccagatggatactcagccggaacgtgaacaagctgtaaagcgggcgcaaagaacgggaatcaagctcttttttgacgctgccgattctttcttgggcgttatacgattttgcaaataccattttttcatcaaatattgtgacgatcttttttcctttttatttgcaggaggcagtcggcgaaaatgccagcatgaatcaggtggcaagcacttttatctcctattcgaacgcagccgcaagctttctgcttgtcattttcacgcctttattcggagtgctgatcgaccgaacgggcagaaagaaaaaatacatcggcctgtttacgatgatttgtgtttcatgcaccattttaatgggggtttttgccggggcttcgtttcagaaggacatatacgggcttccgctatccttgatccttgtcgtcatcatgtttgtgaccgcaaagtttttctatcattcaagcttggtgttctatgatacgattttggctgacttggggacaaaagaagaaatcccgctcttatcaggtttcggaattgcaatcgggtatatcggcactttagccgggttaacggtataccttcttgtcggcaaccaggattttcaccgcgcattcatcccgtcggctctcttgtttctgtttttttcacttccgtatctgctcttcacgaaagagaaaagaaaaccggaaccgaaagaaaagaaatcgtttttcagcggatactgggaaattgtgcagacattcaaagacattcgtctatataagccggtcttcttattcatgatcgcctactttttcctgaatgatgcgcttgctacagcaatagccatgatggcggtttattcaaaaacggtcatcggttttacgaccggacaattcgttttgctttaccttgtttctactgtatcaagcatcatcggttcatttctgctcggctttgtgacgaaaagaatcggcgccaagcacgcggtcagccttgtcgccgccattatgatcaccgctttgacgattggagcatgcacgacgtcaacgctcttgttttggattgcggggagcttgttcggcatttcgcttggaggcacatgggtcgcatcaaggacactgattatcgagctgacgccagaacataaaagaggcgaatttttcggattgtttgctttgtcggggaaaatctcttccattttcggtccggtcctctacggatcgattactttgctgttcagggatctcgggaacatggccagccgaatggctttcggatctttagtgttattggcggcgatcggcctgatcattcatcaaaatgttaaggcaaaagcttgagccggagcatcaacttttaacaaaagacgccgatataaaaagtaaacacaaagtaggatagagagggatatcagtgtcttcaaaccaacaggaaattttattaagttcgggaaccaatgaattagaaatcgtgaagttcgaggttggtctcaacattttcggcataaatgtcatgaaagtcagagaaatcattcagccggttgaaattacgaaagtgcctcattcgcataagcatatggagggcatgattacattgcgcggggaaattcttcccgtcattgatttattctctttctttggcgttgagcacggtgatgacgagcatcaagaaaaatacattgtgacggaatttaacaagcggaaaatcgtctttcacactggagcggtttcacagattcaccgggtgtcatgggaagaaattgagaagccgactgctttgaatcaagggatggaccgtcaccttaccggcatcattaagctcgacggcaccatgattttcctgccagattacgaaaaaatcatttttgatcttgagtctgagtcaggtatggacccttatcaaatgaaaaatgaaaaattcgatcagagacggactgacaaaaagctgatcattgtcgaggactctccgctcctcttgcggctattggtggaaaagctgaatgaagcgggatacaacaacatcgtgtcttttgaaaacggaaaagacgcttacgagcacgcgcttcaattgatggaagacggcacagctcttcacgaaaaagtcgatctgatgatcacggatattgaaatgccgcagatggatggacaccggctcacaaagctgctaaaagataacccgctgagtacggagctgccgatcttgattttctcttctttgattacagacgatcttcgccataaaggggaacaagtcggagccgatgaacaaatcagcaagccagagctcaatgaactgatcgaaaagcttgataaatatattttcaagaactaaaaaaagcctcgaaaggaggcttttttttttattaaaaatagctttcgccaagcttcttgaagacgggttttgaggctggacgcttccggtttgtgacgagcggtttttctttgattcccgtgtagttttgaagaagctgtttcgctatattcaaggacatatgagctttagggttccgatacgaatgatttaatgtacctaagtgtggaaggtttgcgaagtcttcttttgttggaggcatgtgaaaaaagtagtctccgagagatatcagcacatctgactgctgctggctgaatcttggatttttcgaaaaatgcaggcctacctttttaccttttccttcattaagcagcttttgcaaagctttctttttcagaagatacaggtatttgggattagtcgcggttttcgcatggcggttaactgtataaatcgcttttgaaaggttttcaactgtcggttttaattctttcgtatgattatggtcgtccattttttctctcctatccattcgtttctagatcacctcctaaagatgcaaggcttatgtctaaattatacgaaatagaacagaaaatgcaaatatcccatagaaaaaacgcgcgattttttatggaatcgcgcgttttcatctttataaaacagagttcattttcgctatagtatttttttgcctcttcagcgccgcttgaacgtcgatttccgcactctcggcgcttaatttaagcagggcgataaagtagtacagcgccgccagcagaataattcccgccaagccgtaatatatataatccacatcggcgatgattcccgggaataggacagcgatcatgccaagcgctgaggattgcgccagcattgtcagcggatcggtccacccgctgacccttcccatcagccttggatggacgattttgggaatccagccgccaagagctgtgttgatcggcccgatgcatatcccggcaagaaatgcagccgagtagtatacgggcaattgatctgtagagccaagcaggatgataaaggcacccgcgataaaaatcgggactgacatcatgtatgccggcttcacttttttttcgagcagggcggcgacggcaatcccagtcaaaagtccgatgcccagtacgattgtgaagagggaagtatgccactcataactgtcaggggacagctcatacttcattttaaacatcggcagaaccgaaagtccgccgcttacaagcccgaaaataaaatatccgaatacaagagaggcaagcaatttattttttaatatataaacgatgccttccttaaaatcgcgcatcgaatctttgacggtcatgtttttccagcctttatttccgttcggcttccgcgctgcaagcggtatatcgcaggaacggattaaaaagccggagacgataaagctcacaaaatcaagagcgattgctccatgcaagccgatcgtcttgtacataaatgctccaattcctacgccgaacaatagaaacaggctgaaaagcatctggttcagtcctgcagcctttgcatactggtcctttcttaaaatggcctggaccaaacttgcttcggccgggtagaaaaattttgtaaccgcgcttctgataaataggactaaaaacacaagcggtataatttgaagatacaatacaaagaaaagaacgacagtcagtcccgctctgatccaatcacagttttccgcgactttcttgcggtcaaaacggtcagcgaccaccccgacgataaagaatacgaaaaccgtcggcaaggaatacatcagctcggcgattgtcgtataggccggctggctgctgaaccggtcgagcaagaaaaaggcgaaagccatatttccgactgtcgttcccatttgagaagcgaaagctgcgaaaaaaagtcggacgaaattacgatttttaaaaagatccatatatacgctccttaccctaaaggtcccattatatcttaatacaagatgttgtattgttcaaattgcatttgtctggaaatgtactcgtctaaggtgtaatggacactcgggttccgttgggtacgatagaagcaagttccagaacatcccgattgtgcatgcggatacatccccttgaaacagctttgccaattgacgaagggttattcgttccatggatgccgtagtgctgttttgacaggctcagccagtaggcgccgaacgggccgcccggatttggctgccggttgacgatgacaaattcgcctctcggcgtctgtgtgaggatttttccgacggcaatcggatatgtttttacaagtctgtctcgctcatacaatctgagcgttcttccgttgagagacacggcaatccggtatggaattgtgtccggatttctgatgccgggaatgataatcgactggcccgcggacacttggccgccgtttaagccaggattcgcctgcagcaacgcctgccgggtcgttctgaaatcggcggcgatgctttcaagggtttctccgggtttgacttggtacatcagcaataatcagcacatctcctttcaaaaacgaaaagagagccttttccgctgctaatatatagacggaagaggctgaggaagttccgtttttttgatgggattggatgaaatggagcgggaatgtttttacttaatgtatgcagatgccttttgttttgagccaaaagaccgggcaagatttaaatggattcaagctggaacacggtgatttcaggctttgacagaaagcggagcggcagcctgctcgtgccgattcctcaaatgacataaattttcattccggctgttgcatacattccttgcgtataaacgtctacgtacggaggcgtaatcaaaggaccgaatacaggaatctgaatttgtccgcgcgtgggtgtgtccggatatttgcagattgacggggtattgatttgccgttaaagcggcatcaggctcatggacgagcaaaatcgaaaaggcttttttgctcagctttgacaggatgccttcgtagtcaggtctgccgagcatcaaatcatcgagtgaagcgatctcaattacgcttccgtctatcaattcaagcttcagcaaatcgtttcgcagcacccgaaaaccggccgatgccatgagcgtctgatagacttttgttccatagcctccgtgatcatggttcccgaatatagcaagctttccatagggggctgaaagcttttttaaggcgcttacagcacgctcgtgttcccggtagcgatgcggtttatctattaaatccccgctgaatacgataagatccggggagagggcgttcacttggctgacaacatttgaaagctcgtctgctgtaaagtattcgcttaagtgggtatcgctgaactgaacgatccgaaactgatcaaaccctttaggaatgagccgatgccgaatgggaataaagtttgtttcaagcatgtgcggttcgagatagcgcgcatagcccaagccgccggcagcggtaaagagccctgctgcggcaaggcctaagaagccttttaaaaattgtcttctggacggatttttcataatcaaccaacctttaatagattctctacattatatcatccagaaaagccattttaggacagtccgcatgttttgttaattttttttaatttatatgataaactatcaattgaatgaatactcattcataacaagggggatggatatggacagaaaagttgtaatcgtgaccggcgggtcgagcggaatgggaaaagcgatcgccaaaaagcaggctgaagaaggatggaatgtgatgattacgggcagaacacaagaaacgctcgaagcggccaaagaagaaattgaaacttttgccgggcaggtggccgtatgccggatggatgtccggtctgttgaagatgtggaacagatgatcacagaggcggcaggacggtttggcacgatcgacgctttggttaacaatgccgcaggcaactttatctgcccggctgaaaaactatcggtcaacggctggaaggcggtcatcgatatcgtgctgaacggcacattttattgcagccaagcagccggccgctactggatcaaggaaaagaaacgcggccagattttaaatatggtcgcgacgtatgcatggggcgccggtgccggtgtcgttcactccgcggcggcaaaagcaggcgttctgtcgctgacaaggacgcttgccgtcgagtggggaagtgcatacgggattaggtgcaacgccattgcgcccggtccgatcgagaggacgggcggagccgaaaaattatttgaatcggaagaagccgcgcacgcgacaatcaaaagcgttccgctcaaaaggctgggcacccctgaagaaatcgcgggactcgccgcatttttgctttctgagcaggcgggatatgtcaacggggagtgtgtgacgatggacggaggtcaatggctgaatccccgtccgttttagatttcaaattcaaaggtgcgagccggtatggtataatcagacaaagattagaagcaggtgatatgccatgttggatccactcgatattttaacgaacattgaagatgtcattccatactatcagccgatcttcagtgctgaagaacaaaaggtgatcggctatgaagtgctggggcgcatcaaggtagaaactgaagtgaagagcctcgggccgtttttttctgatccgacaattccggaagaatacaagaaagaggttgatctcaaggtgatccgccaggcgctcgatcattttctggacagcgggcgcgacctgctcatcttcgtcaatcaagatgcaaatgtgctgatgatggatcacggcgaatcgttcctcgacctgttgatggaatatcaggataaagggctcgagctcagccgtttcgttatcgaaatcacggagcaaaagtttgaaggggatattgaacagcttcatcatttgctgacctattaccgtacatacggaattaaagtcgctgttgataatatcggtaaggaaagcagcaatctcgacagaatcgctcttctttctccggatctgttaaagatcgaccttcagccgctcaagctgtcttctccttcgccttcctatgaatatgtgctttacagcatatctctccttgccagaaaaatcggagccgcattgctttatgaagatattgaagcgagctttcagctgcaatacgcatggagaaacgggggccgatatttccaggggcagtatcttgagctgccgaaggataaatttatcgaacgggatgtattaaaggaccggctgcaggccgagtttcatcaattcatcacgcatgagaagaagaagctaaccattctgtacgatcactccgagcagttttacaaacgggttcatcagcttgtcacatcgctaaagaaaacggctcagtcagacgatgaatttctcttcaatctcggaaaagaactgacagattgcagctttagaatttacatgtgcgatgaagacggtattcagctgacgaaaaacgtgtttaagcatgacggagcatggatatttcagcctgagtacatcggcaaaaattggagctggcgcccttattttctcgagaatatcatgaggatgagaacgatgagaaaagggtttttcagcgatttgtacagcgatatcgaaacgggggaaatgatcagaacgttttcctatccgatggatgaagaattgtatctgttcattgacctgtcctactcatatttatacgaacaagacggattaatttaagcggcggcctttcgccgctttttctttttgaaaaaatgaatcccgagaggtttgtttcgcgtatataaaggaaaatgtgaaaatataaatgctaaaaaggggtggatcatatgaagaacgtttggtcatccttactgtgcgcgcttctggctgcggctcttgtattcttctgcgcggattttgccaaagccggagaaaaaccgacaagagcatcgttatttgagacccttcaatccgtatcggacgtccattttcagctgaccgaaaaggaaagaacgaaaacagacatgatatccctcttggaaccttatatggagcacgccatggcagtgaagtatgtagaggcgaacgcctttcctgaacaagcggggtggattttttacgggacagacgcgcctgaagttgcaatccctttcttcagctatggcggagacacaaaagtggcggggaaagacggaagctataccgtatatgaatttgttggagatcaaaacgacggccctgtttcatatcaaaaaaattatcagacggtgacgctgaagaataccggcggcagcttcaaagtaacggatatcggccaatctgatacaaaaccggctggagaagaaataatgtccaaacaaccggatgaaaaagaaacaagctcgaattttgcggataaaggggaaggagaccaggctgcatttccgctttttgccaccgatgttaactggacattggccggaattttcagctagcaaaagaatttaaagaaaatcattgacaatgatactgataatcattatcatttaattatagagagatgaacctctctgttccccaacccctctatcagatcaagatttaaaaaacttggcgctgcccccgccaagttttttatttgcatggaatcccgcacttcaaatagctgcgggatttttgggcattaggcgcgcgcaggaataagacaatcctttgctccataaatctaaattggtggttcaaatagactcctctgcagtcaaaaaaatatttttcatgtatgacatgaaaaaagaaaactcaaactatgaaaaagcggtttttctttttcatgatcaaaaaggaaaaatgtcatcggctgatactttgtggtatgatgctttgtagaacttgtattataattaatacttgttgatcctgaagttgtttttttgaaaggagtcttttttagaatgtcacaattaatgggtatcatcacgagactgcagagcctgcaagagactgcggaggctgccggagaaccgacgcagcgcaattttgaagtgaacggagaaaaaatttgcagcgtaaaatattttgaaaaaaaccaaacgtttgagctgacagtttatcaaaaaggagataagcctaccacatttccgtttgacaacatcgatatgatttcaatcgaaatctttgaactgcttcagcaataggaggatatggcatgaaagcttttccaagcgttatttgtccgcattgcaaaacaaccgagcatatggatcaagttctgacggcccagtccaatcagaatgtgatttacagatgtgagagctgcgggttcagcttgaaaaatataccgaccaaaaaaggatagcagacagacgaatcgttccatcttcggtgcagatcaaaaatgaaaaggggcattccaatggctgattcttttcttttttacaatctttctgaagatcaaatgacatttcctgaagtgatcgggagactaaagtcgttcatacgccaagatccgagggcaagctatctgctgtccgtcggaacagactcgcagatccatcagaattgcacaaaatttatcacagctatccatttgcaccgcaaaggcaaaggagcgtggggctgtctgaaaaacacggttgtcaacagaccgatacatagcctcagggagaaaatatcgcttgaaacagcttacagccaagagattgccgcatatcttttaaatgattattttaatgaaatcatggatctgcttcttccgtttacagacgagggagcagatttaacccttgaagttcatttggatatcggaaaaaaaggaatgacaaaggatttaattcaggaaatgacaggacgaatcacttcgatggggatctgcgccaaaattaaacctgactcctatacagcttcaagctatgcaaaccggtacacaaaataattgtttgaaagaaaatcgaacagatgtcgaaatgtgcggttgacgtttgattttcaatttcatattctagccctatagaaactagagagaacatattgtttctgactctagctaaatcaattagggggctggttaagaatggaacgcttttcagaagaagagagaaaactgttgctgaacgtacttttggaccatgagtatgccgtagagctactaagcagtgagatcaatgatatagaaactggtacaaaaaatgtggatagcctgacatataagaaactggttaccttatatgaccgtgtccggtctgaaaattaggtcagattatatcaattgatactcattagagtatcttttttgtttcctaaaaggatattgaatgataaactgaccttgggagaaaggaaagttttcgacaaatattgatattgtttatattattgtagtatagggaaattatgcgttgatggattaaagctgaaaaggagtcgaaaaatcatgattagtttgcaatcagatgaacttcttgaaacgacagtaggtcagtttatgatcgatgctgataaagtagcccatgttcaagtcggaaacaatctggaacatgcccttctcgttttgacgaaaaccggatataccgcgatccctgtacttgatgcttctttccgtttgcacggattaatcggaacgaatatgatcatggataaaatcttcggcttggaacgaatcgaatttgagaagcttgataagattcatgttgaagaagtcatgctgacggacatcccccgcttaaaaattgatgatccgattttaaaaggattcggactcgtcatcaacaacgcgtttgtatgtgtcgaaaatgaagagcaggttttcgaaggcatttttacaaggcgtgtcgtattaaaacagctgaataagcatttgaggacgttgaataaataggcgcggcagcggcctattttttatttgcagcgctccatccaatcctccgcacattccccgatgcccgacttcccgcttgattaaaaaacagccgtttgattaaatgtatgataagaaaaacttattggaatgaggaatgtccatgcagcttcaagagcttcacatgcttgtcgttctggcggaagaattaaatatgcggaaagcggctgaacgtctgtttgtttcccagccggcattatcccagcggctgcagaccatcgagaaatcatggggaacgaaaatttttttaagatcgcaaaaagggctgactgtcacgtctgccggagaaaaaattatccagtttgcaaaagatgtaacattggaacaggaaaaagtgagagagaatatagatgagctggagggcgagatacacggtacgctcaaattggcggccgcttcgattatcgggcagcattggcttccgaacgttctgaaaacctacgttaaacaatatccgaacgtcaaaatctccctcgtcaccggctggagcagcgaaatgctgaaaagcctctacgaagaccatgttcatattggcattatcaggggaaacccggaatggaaaggccctaagcactacttgatgcgggacgaattgtaccttgtcgatacagagatccgaaacattgaggacattgccaaaacggaacggccgttcatccagttcaaaagcgacagcacgtactatcaggaaattcagcactggtggcaccaaaagttcaaaacatcgccgaaacaaaccattattgtcgaccaaattgaaacatgcaaacagatggctttccacggaatcggttatgcgatccttccatcggtgacgcttcacggaagcgggagccatgttcaccaaatccctttgcttgatgctaaaggaaaagcaatcggcagagatacgtggctgctcggttatgagccggctttccagctgaagcaagtacaggcgtttgtagaagttgtgaaagaatgtacggcaatggaataaacactagaaaggcaggactccaaaaaggggactgcttttttttgtacgatttattgacattgataatcattatcatttaaagtgtatctatacaataatgaaaatcattatcaattatagaggtgattctgttgtctaaagcattgattgcatatgccagcatgtccggcaacacggaggatatcgctatgatcattaaagatacattgcgagagtacggttttgatgtcaccattcaggaaatggatgatgtcgataccgactcattggctgaatatgatcttcttttaatcggcacctacacatggggggacggggatcttccttatgaagcggaatcgttttacgaagaggtctcttcgcttgaccttaaaggaaagaaagcggcatgcttcggatccggcgattatgcatacccccgattttgcgaagcggtcaacacgttttacaccatgcttgaacgaaccggcgccgacctttatcaagagacactgaaaatagagcttgctcctgaaacagatgaagatgccgagtgctgcaaggaatttgccgaaggctttataagatgggcagaacagcaaaaacggcgggctgagatccatgtttcataaaggtgcgacggccgtcgcttcggcaaagcattccggttactttgtcgccgtcaagcgggaaggcatttttcactattcacttgagcaaggctggaaaaggctctttcaattaaaaagcaaaatttgttccatcacctatatcggcgattatttattcggcgcaggggagagaggaacgattatcagatcgtctgaccaaggggcaacctggtcaatctcaagctttccgacaaacgccacgatttggtcgatcacggggagaacggacggctttgtgtgtgcgcatgggaagcattgcatttacatatccgacgatttcggcgtctcatggaaagtcgtcaagccgttttccggtttgagtcatccgcccgttatccgctctctgtgcctccatgaagagcgcctttacatcgggacgcagattcatgaagtgcacggcggtgtttgggcatacgatttggcatcagaatcggcttttatgatcaaaaaagaaaccggccgcatgaccgcctcgatgatcgcatttgaaggcgaatggctggtatgtgcgatgggatccaaaaaagggaatcacggtgccgtcgatttggtcaacattcacacaaatgatgaaatacaaatcaggcggggccttgttgagaatgaagaatcattcctggatgtgtccgaagacaacggaatcatctatgtcacatcggctcaggaccgagacggcttttcaagaatctatcagcttgatttctttgagagggagctgaaatggtttgacacgataaaagggcatgggttcagggtggccaaccaaaaggagaacttcttttgcgcaggtctttatgaatgcaaatttgtcaggccttatgaacagcctgctgcagcccactgattttatagcgttttataggaggaataatgatggggaaagttttgctggtttatgcaagcatgtctggaaatacagaggcgatggccgatttaatcgagaagggccttcttgagggcggggccgaagtggaccgtcatgaagcgatggatgtagatgcggcgctctttaacgattatcagcacatgatatttggcgcctatacttggggcgacggagaacttccggatgagtttttggatatttacgacgatatggaagggatggatttcataggcaagacgtttgccgttttcggatccggagatacttcttacgagcatttttgcggtgccgtcgacattcttgaagataaaatcaaggagctcggcgggaacgtggtgcttccgtccgtcaaaatcgaaatgaatccggaggatgaagaagaaggcatgctgctccaattcggcagggattttgcaaagaaatgtgaagtgccggcatagcttttgataaaaaaggaaacgggacatccctttcctttttttcttgtttttaaatctttcctttgatacagtaatgaggagaaaaagagaaggaggacttacataatgaaaatgatggatgcaaatgagattatctcatttattcaaaatagtaagaaatcgacacctgttaaagtgtatgtgaaaggcgaccttgaaggaattgacttcggcgcttcagccaagccttttattacaggcaatacaggggttgtattcggagaatgggcggagattcaagctgcgctcgaagccaacaaaggcaaaattgaagactatgtcatcgaaaacgaccgccgcaattcggcgattccaacgctcgatttaaaaaatattaaagcgcgcatcgagccgggtgcgatcatccgcgatcaagtggaaatcggcgataatgccgtcatcatgatgggggcttccatcaacatcggctctgtgatcggagaaggaacgatgatcgatatgaatgtcgtgctgggcggacgagctaccgtcggcaaaaactgccacatcggagcgggatccgtgcttgcgggtgtcattgagcctccttcagcaaaacctgtcgttattgaagacgatgtcgtcatcggtgcaaacgccgtcgtacttgaaggcgtgactgtcggaaaaggagccgttgttgctgccggcgcgatcgttgtggaagatgttgagccttacacagtagtcgccggaacacctgcgaaaaaaatcaaagacatcgatgaaaaaactaaaggcaaaacagaaatcaaacaggaattgcgccagctttaagaagcggcagcgaaaagtgcgtggatgtgacaatccacgcattttcgcatcgccggggaggttagaaagatgaaattggacgaattagcagcgattcgcagagatctgcaccaaattcctgaactcggttttcaggaatataagacacaggcttatcttttgaaccacttagcaaagcatccggaaggacggattgaaattgaaaagtggagaaccggactgtttgtaaaggttaaagggacggcccctgaaaagattttggcgtacagggcggatatggacgggctctctattcgggaagataccggatattctttttcttccgttcatcaggacaggatgcatgcgtgcgggcatgatttccacatgacgattgccctcggcatcatcgatcatttcgtccgccacccggttaaacaagatctgctgtttttgttccagccggctgaggaaggaccgggcggcgctgagccgatgcttgaaagcgacttgtttaaaaagtgggagccgagcatgatcacagcgctgcacatcgcgcctgaactcccggtcggaacgatcggaacgaaaagcgggctgctctttgccaatacgtcggagctcgtaatcgaacttgaaggaaagggcgggcatgccgcatatccccaccttgcagaagatatggtggtcgcggccagttcgctcgttacgcaaatgcagtcgatcgtagccaggaatgtcgatccgctggacagtgctgttattaccatcgggacgattacaggcggatcggcacaaaacatcatcgctcaggaagcaaggcttgaagggacgatcaggacgctgtccccagcgtcaatggaacaggtgaagaaaaggatcgaggccatggttcggggcctggaaacggcttatcaatgcagcggtaaagtcagctatcctgcagcatattatcaggtctgcaattcaagcgatttagtcgaagactttatgcagttcgtttctgaaaacggccttgcagaggtcgtccgttcaaaagaagcgatgacaggggaggacttcggctatatgctgaaaaagtatccgggcttcatgttttggctcggcgtcgattcaccttacgggcttcaccacgccaagctgcagccgaaagaggaagcgcttgaaacggcagtccgcgtcatgacggcttatttctcttccaaagccaattagataaagcggctggtataaaaaatcggcaaacgtggcatcttaattggtggaggtgtttcttcatgtcgaaaaaaatcggaatcgaacaatctctttctgatgtcgaggctgctttgaaggaaaaagggtatgaggttgtaacgatgaaaaccgaagacgatgcaaaaggctgcgactgctgcgtcgtcactggtctggacactgatatgctcgggatttcagatacgatgaccggagcatctgtcatacaggcgacgggtttaactgccgatgaaatctgtcagcaggttgagcaaaaacttcagtaatagacataaaaccgaagttccagcttcggttttaacttgttttccaaaaaaaacagctgctgcgtgttaaacggttgtttcctcatccggcggcatgttacaatttttttaaaggatttaaatagaacaaccgctaatttaaatttattatcaattaatattgacttaaaatatggtaagcattataatgaactatgtatgtgatattattaactaaatgagaatttaatatttgaattctcatttagatacgggtagcataacccaaaaatcacaattggagggatacataaaatggcagaacgcatggtaggtaaacaagcgccgcgctttgaaatggaagcggttcttgcaaacaaagaattcggaaaagtaagccttgaagaaaacatgaaaaatgataagtggacggttctattcttctatccaatggacttcactttcgtgtgtccgacagaaattacagcaatgtctgaccgctatgacgagtttgaagaccttgatgcagaagttatcggcgtatcaactgacaccatccacactcacttggcatggattaacacggaccgcaaagataacggtctcggccagctgaaatatccgcttgctgccgacacaaaccatgaagtatctcgtgaatacggcgtactgattgaagaagaaggtgtagcgcttcgcggattgttcatcattaatccagaaggcgaacttcaatatcaaacagtgttccataacaatatcggccgtgatgtagacgaaacattgcgcgtgcttcaagcgctgcaaacaggcggtctttgccctgcaaactggaaaccgggacaagcaaccctttaatttcgataagaaatctgattggaaaggtctaacatttgttagacctttttaaacgacaaaaatgacattggaggaaaaatcatgaaattacgtcagccgatgccggaactgaccggcgcaaaagagtggttaaacggagaagtgacaaaagagcagcttataggagaaaagccgacattaattcatttttggtccatcagctgccacttgtgcaaagaggcgatgccccaggtcaatgaattccgcgaccgctacagcgataaactaaacgtggtggccgtgcatatgccgcgttcagaagacgatttagacttgaataaaatcaaagaagttgccgctgaacatgatatcactcagcctatttttgttgacagcgaccataagctgactgacgcttttgagaatgaatatgtccctgcttattacgtgtttgacaaaacaggccagcttcgccattttcaagctggaggcagcggaatgaaaatgctcgaaaaacgtgtgaaccgcgttcttgccgaaacagaacagtctgctgaataaagatgaaaaaccccgttttcatggggttttttatttatttggctccccaattacaaaaaacaaaaaaaattcctctagcctccctttcgacaattaggccatttgacactgtttatttcatttgatgagtctggtggcctgtttttggttcgggagcatttcttacttaccccgtgcataaaagactgtggattcgacaagtgaaatctggaaattttaaatattctggatttataaggcggaataatcattgatatctcacactttccatcataattaaacagtggattctattcctaaattatgtttcattgaaaagtaattttctaggttccttcattatttaccatttttcgacaatgagcttagaataggccgaaatgcttcaaaaactcctcaggcttcaagtttttcggaaatttagttctattttcttaacggagagcaacagtagaaaaacgaaaaaatagttgataaaattagtttggtaatctaatatttttattggaaggtttatttattctgataggagggtataaacggtatgtttaacgagagggaagcattgcgtttaagattagagcagctgaacgaggctgaagttaaggtgattagggagtatcaaattgagcgggataacatatatgcaaagctgcgtgaattggatcgtccatccagctttaatgatacaaaaaaagattttcgcccggagcgtaaaactgaatctctccctgttttagctgaattggctgcacaggagatgaagagctaccagcaacagcagcaacagcagccgcaagcatctcaaaagaaccagcagcagacttctccgcaaacctcctcactgcctgccggaattccagatggaacgacaaggcgcagaaggggtacagcacgtccaggctcaaaagctgcaaaattgcgtgaagcggcgattaaaacattaaaacgccataatgcggccatcaaaagctccgaacttcaaaaagaaatcgaaaaagagagcggacttgagatccctaatatgacaacctttatgcaaagcctgattaaaatgtacccggaagtcaaaaaaccataccgcggtcaatatatattagagggtgagatttctactgagacagagcagcaataggtcaaacccttgctttttcagatagcgtttccattttaagggaacataaaggcggccgctttatacgccgccgcccaatcaactgcttgagacaatctactcaagcggtttttttgtaaaaaccaaattattccttaaagtggtatttaatttaaaggttttgtttctttgtctttgcgtttaatttgatagacccatttttgcgggggtgtttcttctttcgcctgttttttccattctgttattttttgatccattttcgtatcattttgttgaatggcgctcaattgttgttggagctgatcaacttgctctgtaacagtttgaagcaccgcctcgatctgttctgtccgttcaaaaacctcctcgttttgttcaagcgccttctccgtctgctgaaatgcatcaatatcggcaaaatgagaagcgatccacttatcactttcatcgagttgccttttataagagagaatcgtttcataaaacagcgcttcttttgttttttcagcctccaaaagccggcttttcgtttccgtcacccgctcttttaataccgcaacatcagtttcgatttgtttgagctgaagacttttagcatgaagttcatctttcaggcgggcattttcgtatgcagcgtttttgagctcctgttcctttttttccctcagcgttttttctctttctgcatgaagcttttcgtattctatttggctatgtaagctttttttctcttcttcggcttttacatttgttaaatgaaggcggtgcttttcttctatctcttgttttcttgcataggtttctttttgaagaagctcctgaagaacgacgattttactcagcaattcgctttttatccggttgagcgtttcggccgacttgtcttccttgtttgccgaaatccgctccagttcgaatgacagctgctgaagctgctgtttcattgctgcgttttcccggctgagcttatgatttttctggtgaaaatagcttgcttcaagctcgtgtatcaattgatgtgatcttgccagctcagcttttaaaaaaaggttttcctgtgataaatcttgaaaataaggcagcgaacccgatgtttttttcatggtgaccagccccctataaatgttacaactacaatatgcataaatgaaacccgccatgccttttgaaaaagagattttacagacttgttcggatttctaaagttttgctatgatgttcgcaggcaggaacacgcgaaggaaggttgagccgtatgaaagaaatacatgtcatattatcaggggggctttcgcgccgttttggggaaccgaaggcgtttgcccgctggaaaggcaagccgctttatcaatggtgcaaacaggcgctgggagacgacgtcctgatattgagccgtccgggcttgacggagcggtttatagaactcggggaaaaaagcggtgctggaagatatcgaaccgtacagagggaaagggccgcttgccggtatgtacacagccatggagcgggcggaaggggaatgctatattttttcggcctgtgacaccccgcttgtccggcaggagaccatatcggctttaaaacggcagttgaccccggcggatgacgccgtcgtgcctgtcgcagacggaagggcgcagccgcttgttgccgtctaccacagaagggtaaaatccgtcctccatgaacagcttcagcagaacgaactgaagatcagcagttttctcgaccgcattcgcgtcaagtacattgaagcagatgcggttggtgcagagccgtgggaatttataaatgtcaataaaaagtcggatttagaagaaatagagccgttctttccgggatgaaatattttatcatagattgcaagggtttttcggaaggtgtttttcaaagaacagcagacggaaaaatggtatgatatagaaaaggaagtaaaggggatcatcctgatgcatgaacggtattcaagacaaatcagatatcaaaacatcggacaggcgggtcaggacagaatcaggcagagccatgttttgatcgtcggggccggggcgcttggcacgtcagccgctgaagggcttgtgcgcgcaggcatcggcgcactgtctattatagaccgcgattatgtggaatggagcaacttgcaaaggcagcagctctacacagagaaagacgcggaggaaaggcttccgaaagcggcggctgcaaaagaacgtctttccgagatcaacagcggtgttgagcttcgtacatatgttgcagacggcacagttgaaacactcagaccgctgatcgaagaggcggatgccgtcattgatgcaacggataactttgagacccgcatgatcatcaatgaccttgcgcaggagacgggtactccgtgggtttacggcgcttgtgtcagcagtcagggcatgtatatgacgattattccccaaaaaacgccatgccttgcctgcctgtttgaagatgttccgattggcggggctacatgcgatacgtcggggattatttcgccggccgttcaaatggtgtcggcttatcagcaagctgaaattttaaaaatcttaactggacagcaagaagcgcttcaaactgcttttgtcacgtttgatttatgggcgaacacccattatcgcatgcagatcggccgcaatgagaaatgtccttcgtgcggagaaacgccggtttatcctttcctcagcaacatgagccaaaagaaagccgacgtgctgtgcggaagagagaccgtccaaattcgcagcgaaatgttaaaacggctgcctaaagaggagctcatgaaaaagctttcggtcatcggaaaagtggatgcgaatgattatttgctgcatgtacaatatgaggcgttcagaatcgttattttcaacgatggaagagcccttgttcacggcacaaatgatataaaagaagccaactccatattggcgagagtcatcggaatgtaacaacaggaggtttttttaaatgattgaaaaaagaacgcccattccagtttttgaagccgctgcgcgtgtctctcagcaccagaagctgggagatgcagagtggattcaccttgaggagagtctccatagatttttagccgaagatgtcaaggctgatcacgatgtacccgcttttgaccgttcgccatacgacggctttgctgtccgagcatgcgatacagccggtgcttcgggggaaaatccgctgcaattcgaggtggttgatcacattggagccggggccgtatcggataaaaagctgggttcttttcaagccgtcagaattatgacgggagcgcagattccggagggcgctgatgcggtagtcatgcttgagctgacaaaaaccttctcggaagacggcaaaaactatatggtgttgaagcgctcactacagccgggagaaaatatatcaaaaaccggagaagatgcgagaaaaggatcagttcttgtgaaaaaaggaacccggataacgccgggtgttgtcgctttgcttgcaacattcggatatgcagcggttcctgcagtcaaaaagcctgtggtaggcatcattgccaccgggacggagcttctgaatgtcagcgatcctcttgttcccggaaaaatccgcaacagcaatgcaggcatggcggccgctcaggttgaagaatcaggcggaaaacccctttatttaggaaagatttctgatcaatttgacgaaagctttgcagcggtggaaaaagctttggacaaggtggattttctgattacgaccggaggggtatccgtaggggactttgattttctgccggcaatttacgaaaagctcggtgccgaggtcctgtttaataaagtggcgatgcgtcccggaagtgtaacgacggtcgctcaattaaacggcaaattgctgtttgggctgtccgggaacccgtcagcctgcttcgttggatttgagcttttcgtcaagccgtccctgcgcacctggctgcatcatccgaagccgtattctttatgtgcagaagcggttttagccaaggattttccaaaacctaacccgtttacgaggtttgtccgctcgtttgtatccattcaagacggcgcgcttcaggcggagcctgtcggtctggataaatcgagcgccgtaacgtctcttgcagatgccaatgcgctgatggttttgccgggcggaacgagaggctttgaagccggggcaagagtgcatgttcttttataccgggatgagaacggaagtgaacagctgtggccgcacattttccaatcctccagatcgtagggtaccaaaacagcggcaaaacgacgttcgttgaaaaattggcgggaaagctcgatcagctaggagtcaatgttggctgtctgaaacaccacggacatggaggagaaccggacgcttttgccgaagggaaggattccgaccgcttttttcgggctggagcggctgcgtccggcgtagaaggtgcgggcgtttttcagcttacggcgcgcggcgagtggacgcttgatcaactgattgccgcttacggcgttttagcagttgagtgtctcctcatcgaaggatttaaacatgcgccatatcaaaaagttgtcatggtcagaaacgaagcggactgccggctcctgaaggaattggacggcatcatcgccgtcatttaccagcagagcgagccgaaaacagatgttccatcctttcatattgaagacccgggtgccctggcttttattctgaatcatctaaaggaggaaggcgtttgtctgaacgatttatcataacaaaagacccgattgtcatcgaagatgtcgtcaaaaaagttgaaagaagggaagccggtgccgtcacgacgtttatcggaacagtgagagaatggaccaacggaaaaaagaccctctatctcgaatatgaagcttatgttccaatggcggtcagcatgctcgctcagatcggcaaagaaatcaatgaaaaatggcccggcacagctgcagccattacccatcgcatcggcaggctggacatttctgacgcggccgttgtcatcgccgtgtcgtcgcctcaccggaaagcggcgtatgaagcgaatgaatatgctatcgaaagaataaagcaaatcgtcccgatttggaaaaaagaacattgggaggacggcgagacttggatcggcgaccagcttgagacaactgaatacccggaagggaaaccggatattgaagaggcggcttccggcagagaaagaggtgctgaccattgattaaaattttgctgtttgcccagcttgcggaacaagcgggtgcgcagagtatcgatatagatgaagaaaagacgacaacagacgagattagacagtttttaaaagaaacgtacaatcttcaggggacggaccgggcgatgatcgctgtgaacgaagtgtacagaagaggaaacagtgaggtcgagtcgggagatacggttgcttttattcccccggtcagcggaggatgagaacgtcggtcggttcaggcataagcctgtcaccgaccgacgttttttttagaaccgttctctatataaagaaaacagccgcgccgttctttcgaaatgtttggttctaatttttgaatcaggtcataaagctcactaatacggtgaacgttaaaattggttctttccttcagtttcattttcagttcttttgtcgttacaatttctcctttttgctgtttaataatgtctacgcaatgtgctgcataatactctttattggaacgtctatgtcgctggatttgtctgtcaagttctcccaaccttgcataaatcccttcgcgttctttccggaagtccttccagattttttgttccaattcacctaagaggagaagccgtttttttaaagcctctcttttcgacattgcaatcaactccgtcattcatagtttgataactttttctattattttacatcatcttccttcattcatcaaaaaatttcctttgacatcgagaaactattttttatcggctgtcacattttaaacaggctttatttcaaaccgaagaagggggaaaactccataataagactgaattttttaaaaacggtggaattttatttcgtaaaccgatatattagatgatgtgtccttgttttacatgaattggaaaggtgctggtgctaatggagtcccttaaaaaactaaaagatttttattggccttataaaaaaatgtttttatggtcgattgcgtcgatgcttctaatgacggcgattaccgttgtttatccgattattctgcaaatgacaattgatgaagtaattctcggcggaaaatacggtttggtcatatggatcagcctcgggttcatcgctgtcatggcggcgaagggcgcagccactttttttcatcagtatctcggagatatgttcggaattcgctctgtctaccggttaagaaaagagctgtatgcgaaattgcagcgtctgccgttcaaatattacgacagcgctaaaacgggagatttaatgtcaaggcttacggcggacgtcgaaggcatcagattctttttatctttcggctttgctgaggcgattcgatttatcctgcttgtcactttcagtctgtctgtcatgttttcttattctgtgccgctgactctggttacgattgcttctctgccgtttttaggagcggccgtctaccggtttgataaaaaagtgcatcccgcttttcggaacataagaaaatcattcgcccgtttaaatacgaaggttcaggaaaatatcagcggcatgaacaccgttaaatctttatcaaaagaagattttgagattcaaaactttactcattcaaatgaccattttcgaactaaaaatttaaacgcttcgtttatcatgtcgaagttctttccgctgatggagtttatcggcaatatctgcctcgtggctctgctgtcgttcggcggctggctcgtgatgcagaacagcttaaaaccgggtgagcttgtcgcttttttcagtctcgtcaattacttgatgtggccgatcatgaacctcggttatgtcatcaacctgttttcacaagcgaaagcatcgggagagcggctgctggaaattcttgatgccgaggaggaaatcaccgataccgaacaggcggtgaaaagcggcagactgaacggcgatgtcgcattcagcgatgtttcccttcaatatacaaaagaaaatgcggaagcattgcatggggtgtcttttcaggctgagcgcggcaaaacaattgggttaatcggcgcgacggggtcaggcaagagcagcatcattcaactgctgagccgcttttatgaaccgacatccggccggatcacgatcgacggcaaaccgcttgaacactactcattaaagatgctgcgctccaatatcggcgtcgttccgcaggaatcgtttttattttcctcaacgatcaggtcaaatatatcgtatggaaagcctgatgcatcgatggatgagattatcgaaagcgcgaaaagagcccaggctcacgattttatcatggagcttccgaatcaatatgatacgatgctcggcgagagggggctcgggctgtccggtggccaaaaacagcggattgcgattgcgagagcgatttgtatgaacccgggcattctcatcctggatgattcgacgagtgccgttgacatggaaacggagcaccgcattcaacttgcattgcgggaagtgatgcgggatcggacgactttcatcatcgctcacagaatctcatccttaaagcatgccgacgaaatccttgttctcgataaaggcgtagtcaaggaaagggggacacacgaacaattaatggaagcaaacggtttatacaaacggatttttgatttgcagtataaagatcaaaatgtgttgaatgagccgcattttgcaggataggaggctcttgctatggaaaaccaggcgaaaaaacaaacgttgatgaaccggtttttttatacttcagaccaaatcattgaaaagccttttaactgggcgcagatgtggaggctgcttaaatatttaaagccctaccgaaaaaatttgctgccgctgtcgtttttaacggtcatgatctcggcggcgatccggctggcggtgccgattttgatcggcgtctatgcgctcgaccaagcgatcgcaggccgggatatgaatcttcttgtgattctgatctccgtcatcagtgggttgtatcttgtcaattatgttagcaatgtgctgagaatccgctggatgaacaagcttggccagcatgtcatatatgatctcagacagcatttgtttacgcatgttcagcggctgtcgcaccgctttttcgacgagcgttcggcaggttcaatccttgtccggatcatgaatgacatcaattctttgcaggaactgtttacgagcggagtcatcaatttattgatggatattttgcttctttttggaattgtcgtcattctgttctcgctcagtcctgagctgaccatcgccattatggtgacgctgcctgtgatgttcttcatttctactaatctcagaaggaaaatccggcgatcctggcaaaaggtgcgcttaaagcagtccaagctgaattcccatttgaacgaaagcattcaaggcatccgggtcactcaggcatttactcaggaaaaagagaatatgatgtattttgaaggcgtcaacagtgagaactttgaagcctggcgggaagcgacgaaaaaaaatgcgactttccgtccgcttgtagaaatgacaaacgctgtcgggacggccattttaatctggtacggctcaagcttgatcatcaatgaaacgatcacgatcggtgtatttgtatcgttcgccttctatctcggaatgttctgggagccgatttcaaggctcggccaagtctacaaccagctgttgatggggatggcttcgtcagagcggatctttgaatttctggatgaaaagccgagcgttgcagacaaggaagatgcggtcaaaataaaagaattaaaaggccggatcgaatttgaacaggtggaattttcttatgacgggaaccgcaaggcgctgcacagcatttcatttgagatacctgcgggatcatcgcttgcgcttgtcggacatacaggatcagggaagacgacgatcgcaaatctgatcagcaggttttacgatgcaacaggcggggctgtcaaagtggacggtataccgattaccgatatctcgctttccgatcttcgttcgcaaatcagcatcgtgctgcaggacacgtttattttttccggaacgattatggaaaatattcgttttggccgtccgaacgccgccgatgaagaagtgatcgaagcagcaaaagctgtcggagccgattcgtttatttcagcgcttccgaatggatacgccacagaagtggaagaacgcggcaatgtattatcggcaggtgagcggcagctcatttcatttgcgagggcgcttctggcagatcctcgtattctaatccttgatgaagcaaccgcaagcattgacacagaaacggaagtcaaaatccaggctgccttgaaaacactgctccatggcagaacggctattatgatcgctcacaggctttcaacgataagggatgcggataaaatcctggttcttgaccacggccggaaaatagaagaaggaaatcaccaggaattgatcgggaaacgtggaatgtattatgagctggtaaaagcgcagtatcaaatgtttcagcgaaactaaaaccgtccgcggccgcaccttctaagaatgcggccggggcgtttttttgagaacagttgtgaaacattttaggacattctgcgtataaactggtaattcattttttaagggggatacatatggaaacgaatttagaaactgaaaaagtaaagaatccatcattgctcggattgattacccggcccggagaacagttcgagagaatgagagaaaagccggctttctggtttccgcttgtcattgttttaatcttgtcggttgcgggagcgtatatgctcagcgaaaaaacggcgttgtctaccgatttgtcggaaatgccggatgctgaagcatttcaagctgctatgaagggaatcggcatcatcggcgggatcttcggctttgtgattgccttgctgatcagcgctttaatttattggctgattgtcaaaatcggaagaggaacaaccaattttgttcacatgttttcgctgtctgtttttacatattttattgcggctatcggacaattcataggcggactagtgatctattattcaaatatcgatcccacgatcgtcgtcacgtctttaaacggcatcatcccggcagacgagccgctcaaatcggtattgggtgtatttgatattttcacgatctggtcgctctcattggttgccctgggtctccaaaaggttgggggcatctccaaaaaagcggcttggaccggtgtgatcattttatttgtgatctccattctgctcgctttaataggcggtatggcgatcaatttcttcgattcatttgaaggagcaatgtaaatgaaaaaaatatggatcggcatcgtcattgttggggctgctgcgctttttatcggactcaacctctaccgctcggttcaaacgagcggaggggctgaagaagcggttcaaaccgtgaaattggaagaaaaagagatttcttctgaagtcatggttccggggacccttcagtttgcaaacgaacaatacgaatattttgaacctgaaaaaggagaaattgccgacatcaaagtaaaagaaggcgataaggtgaaaaaaggagatgtgcttttcacctatacaaatgaagaaattcgcctggaaaaggagcaaaacgctttatccattcaatcgaaggatctccagcttgaacaggttaagcgaaaaatcagcagcctaaaaagcaaggaagacgagctgaaggctgagctcggagcggaaaaagccaagaggcaaattgatgaagaacggtcacagcttgaaatggaagaaaaatcgctccagcttgaactgaaacaagccgacctgcaaaaggaaacgctcgagaagaaatcggcagcgctgcaagtgaaaagcggcattgacgggacggttattaccgttgacaaacaagccgctgcaaagcaatcggatattcaaaagccggttatacatataggtaacgaggacaagcttgtcgttaaaggcgtgctctcagagtatgacacattgaaagtgaaaaagggacagaacgtgaccatcacgtcggatgtcatccaaaataaagagtggcgtggaagggtatcacaagtcggattggttcccaaagaagaggcgtctgcaggtgttgcgggaacaaaggagcaagctgttcaatatccgtttgaagtcaaaataaaaggggagcgtcctaaagcaaagtccggctttaacatgattctcaaaatccagacggacaaaagaatcgttcaggctcttcctgaagatgccgtcaagcaggatggtgatcaatcatacgtgtttgccgtaagagacggcaaggcaaaacggatcaatgtcaaaaccggtgagaaagcagacggcctcgttgaaattaccggcggtctgacaaacaaggacccggttatcgcaaacccggccgaggatatgaaaagcggaacggaagtgaagcttcaatgattgagctttccaaagtgaaaaaaagctaccaaatcggaggagaaaccattgatgttctcagggagatcgatatgaaaatcgagccgggagaatatctgtccatcatggggccgtccggttcgggaaaatcgacgatcatgaacattatcggctgccttgaccgcccgacatcgggtatttacaggctggacggcgaggatatttcatcatacggcgaaagggagcttgccggtgtcagaaaccgtttaatcggttttgtttttcagcagtttcagcttctgccgcgcttgaatgccataaaaaatgtggagcttccgatgatttacggcggcgttccaagaaaggagcggcgggagcgggctgaacgggcgctcgaaaaagtcgggctcaaggacagaatgcgccatatgccgaacgagctttccggcgggcaaaaacagcgtgtagccatcgctagagcgatcgtcaatgaaccgaaactgatattggctgatgaaccgaccggagcgctcgatacgaaaacaagccgggacatcatggagcaattcaccgaattgaatgaggaaggaacgacggtggtgctcgtcacacacgaacctgaaattgcggactatacaagccggaccatcatggtgagggacggtgtgatcgtctcgccggaaacagagcggagggggacggtgcaatgaatctcatcgaaaacttgagaatggctttaagttccatcctttcccataaactgcgatcgattttaacaatgcttggaatcattattggtgtaggctccgttattgtcgttgttgcagcggggcaaggaggagagcagatgctcaagcagacgatcagcggacccggcaacacggtcgaaatctattatcagcccagcaatgaagaattaaccgccaatccgaacgcctacttagacgccggcttcaccgaagaagacatcagaagcttaaagtcactcgaaggcgtgaaacatgtcgttgcgaaaacaaccgagtccatgaatgcccgcttccgggatgaaaatacggatgccgctgtaaacggcattaatgacggatatatcagcatcaattcgatggaaatcgaaaagggaagagaattttcagaagaggattaccttgctggaagcagggtcgccattatttcgccgaagcttgcggaagaactgttttctcagcagtcgcctctcggccgtgtcgtatggataaatagccagcctgttgaaatcatcggcgtattgaaagaagaaaccgggctgcttgcattggggatgaatgagatgtatgttccattttcaatgttaaaatcgtccttcggcatcagcgactatgactctgtctccgttcaagctgagtctgccgacgatctgcaggccgtcgggaagcgggctgcagcggccgtcaacaagaatcacggcacttcggactcgtacgaagtgatgaacatggaggccatagcggccggaatcagccagattacaacaattatgacgatgttcatcggttcaattgcaggcatttctttactcgttggggggatcggcgtcatgaatattatgctggtgtcggtcactgaacggacgagggaaatcgggattcgaaaatcgcttggtgcaacaagaggccagattctgatgcaatttttaatagaatcgtctttaattacactgatcggcggggtgtttggcatcggccttggatacggcggtgcagccctcgtatcgttttttgccgggtggccgccgctcgtttcctggcaggtggtcctcggaggcgtcctgttcagcatggcgatcgggattatctttggactcatcccggccaataaagcggcccgccttcatccgattgatgcattgaggtatgagtaagatggttgagaaacttgaagcagttgcaggaaaaacccaaatgcacgaatggtccatgccagtacgtcagactatcgacaatattgaaaccgcctgagcaggcggtttttttatggaaaagcaaatttgatcaggcatatggtgtatggatgttccggttaaacatgcctatataaagggatgcttggtgcttggtggctacattccggccgagaagcctctattaaatctacttggaatatgcatcagcagccggagaacgatggatcggcatttcaattatatttatatccatgttgcggcctgtcttactatatcaatttatagaaaatattcagtaatcggaaacaggatacagatttgctgtaaaacctcatgcggtgagcatggggttttatcctgtgacctgaatgatgtttgaaggaatagataataataatgtcacatatttttgcggatttttatagtttatacagtttacaaacggtacatatcacgttaatattttaaaatgtgaaagattttgatggttattgaatgaatttgaaagatttttgttgagttatgtcgaaaaagcgtttacaatgaaattgtaagcttaatgaaggcgtttccaaaaggggtgataatgtgttgactcccgaacggcatcagctgattattgacgagattgaaaagcatgatgtcgtgaaaatccagtacttaatgaatttaacgaacgcatctgagtcaacgatcagaagagatttgtcgacgctggaagcccgcggatatttaaagcgtgttcatggaggggcatcaaggctttccgatattcgtacggagcctgacatgctagagaaatcatccaaaaaccttcatgaaaagcgaaaaatcgctcaagaagcggcctcacttcttgaagaaggcgattgtatttaccttgatgccggaacgaccacattgcaaatgatcgattttatcaatccagagatggatattatcgtggttacaaatggagtcatgcacattgaggcactaggtaaaaaaggcattactttttatttattaggcgggtatgtgaagtataaaaccggagcgatcgtaggcggttcggctttatcagccatcagccaataccggtttgacaaaagcttcatcggcgtcaacggcattcataaggaagcggggttcacgactccggatcctgaagaagcgcttttgaaaacaaaagctgtcaaccaggcgaaaaaagcatttattttagctgacgtttccaagtttggggaaatttcattttctgcctttgccggtttagacgaagcaactatcattacagcaggatctgcaaaacattcatttgataactatcaagaaaaaactgtcgtaaaggtagtgaaaacatgatatacactgtaactctcaacccatcggtcgactatattgttcacgttgaagaattttctgtaggcgggctgaatcgttcagtctatgacacgaaatatcccggaggcaaaggaatcaatgtctcacgcgtactgaacagacaccatgtaccttcaaaagttctcggttttatcggcggttttaccgggggatatatcaaatcatttctcgaagaagagaagcttgaaacggcttttcatgaggtgaatggcgacacgcgcatcaatgtcaaattgaagaccggggatgagacggaaatcaacgggcaggggccggtcatcagcgaagaagatttcgcggcctttttagaccagttttcagcgatgaaagaaggggacattgttgtactggcgggcagcattccttcatcattgccgcaggacacatatgaaaagattgcggaaaaatgcaaagagcaaaatgtccgggttgtcgttgatatttcgggtgaggcccttttaaaagcagcagaaatgaagccgcttttaatgaaaccgaaccatcacgagctcggagaaatgtttggaacaactatcacctcggccgaagaagcggtgccttacggaaagaaactcgttgaacgcggggctgaaaacgcgatcgtttccatggctggagaaggcgcacttttatgtacaaaagacggtgtctaccatgccaacgtacctaaaggaaagctcgtaaactcagtcggtgcgggggattcagtggttgcaggctttctcgcaggcattgaaaaacagcttggcatcaaagaagcttttcgcttaggagtcgcttcaggaagcgcaactgccttttcagaggagctgggaacggaagagctcgttcacaagctgcttccggaagttcaagtcaaagcgatataaaggaggaaaggttatgaaaataactgagctactaacaaagcatacgatcaagttaaaccttgagagcagccagaaagaaaacgttatcgaagaactcgtcagcgttttggatcaggctggcaagttgaatgataaagaaggctacaaagaagctgtgatcaaccgcgagaaacaaagctctaccggtatcggcgaaggcatcgccatcccgcatgcgaaaacggcaagcgtcaaagagcctgcgatcgcgttcggccgttcaaaaggcggcgtcgattatgaatcccttgacggccagccaagccatctcgttttcatgatcgccgctacagacggtgcaaataacactcacctcgaagcattgtcaagactgtcgactttgcttatgagggaggagattcgcaaacagctgcttgaagcttcatctgaagacgaaatcatcgacatcatcaatcagcatgataaagatgatgatgaagaagaagagcaggccgaagaggctcctgcaccatcagcaaaaggaaaaatccttgcggttacagcatgcccgacagggatcgcccacacgttcatggctgcggatgctttgaaagaaaaagcgaaagagcttggggttgatatcaaagttgaaacgaacggttcaagcggtattaaaaatggtctgacggcccaggaaatcgaagatgccgttgcgatcattgtcgccgccgacaagcaggttgaaatggaacgctttcaaggcaagcatgtcattgaagtacctgtaacagcaggtatcagacgtccgcaagagctgattgagcaggcgctgaaacaagacgcgcctatctatcagggtaaaggcggcggtgcaaccgcttctgaagacggagctgccaaaggaaaaggcggcggtttctacaaacacttgatgagcggtgtcagcaacatgctgccgttcgtcgtcgggggcgggatcttagttgcgatttcgttcttctggggaattaacgcgaccaagccgggagatccgacttataatgagttcgctgctgtattaaataatattggcggaacgaatgcacttggattaattgtcgctgtattggccggatttatcgcgatgagcattgcagatcgtccgggatttgcgcctggtatggtcggcggtttcatggcgacacaagctggcgcaggtttcttaggcggcctgattgccggtttcttagctggttatattgttgtcctgttgaaaaaagtgttcgctggtctgccgcaagtgcttgacggtttaaaacctgtgctgctctacccgctgtttggaatattcttgaccggaatcattatgcaatatgttgtcaatacgcctgtcaagtacattatggacggcatgacacattggcttgaaggtcttggaacaggaaaccttgtcgtaatgggtattgttttaggcggtatgatggcgattgatatgggcggtccgatcaacaaagcggcctttacattcggtatcgcaatgattgaagctggaaactttgggcctcacgcagccatcatggcaggcggtatggtgcctccgcttggaattgcccttgcaacgactttctttaaaaataaattctcaaaacgggatcgcgaagccggaattaccaactacgtgatgggcttgtcatttattactgaaggtgcgattccttttgcggcagcagatccggcacgcgtcattcctgcttgtatcatcgggtcagcagttgccggcggtctgtctcaatttttccatgtcacactgcaagcgccgcatggcggaatattcgttctcttctttacgacgaatcatgcgctgctgtatctcctcagcatcttgatcggtgcggttgtgacagctttgattctcggcgttttgaaaaagccggttccaactgaaaaataagtgctgaaagtgccacagtaatccctctcgtggcactttcttttttactgtttttgccggaagtgagcgcggggattatgtattcagcgggaacttgtgataaagtataggaaagcttttattttggcatgtatgctgtgacagactgtttttaggaggaagcgttttgactgaagaaaaatccaccaataagaaaaactctctctttgaatgggtaaaagccattattattgcagtcgttctggcgttattgatcagggcatttttattcgaaccgtatttagtggaaggtacgtcgatggacccgacgctgcacgacggagagcggctgttcgtctataaaacggttagatacgtaggcgaatttaagcggggagatatcgtcattatcgacggcgacgaaaagaatgtccattatgtaaagcgcttgatcggcctgccgggagataccgtgcaaatgaaagatgacacgctgtacataaacgggaagaaggtgtcggagccgtatctttcggaaaacagaaaagaggcggaagcagtcggcgtcaagctgacgggcgactttggccctgtgaaggttcccgaaggcaagtatttcgtgatgggagacaatcgccagaggtcaatggacagccggaacggcctcggactgattgataaaaaacgagtggccggaacttcgcaatttgtgtttttcccgtttaacgaaatccgaaaaacagactgaaaaatgcctgatgtccatttggacaatcaggcatttttgcttgatttatgcggataatgatgccagcactgcgataaacagtacggtaacgaacacagaggccataatcagaagaacgctgtacaagattctgatttccgcggcttcttttccccgttttgacagcattcgtttcgccgcgatatgaacgaacacgtaaatcatggcaatcccgatgtaaagccccagatcccgtgctgtaaagccggttatggcaagatagacccctgcaaaaaaaataaacatgcagtattccgtcaaagtgataagcttcatggtttcctccgtctaacgatccgagttttcttcaaatatcacctttttataatatatcttttggagccatcccacaaggaggccgaagccgatcagcagacaggaaaatataaaaaagtcagcggtccacatatcaaaccctttgaaaagcccgatagacatcgtagaaatcaccatggccactgacgcgaaaagcgcttggcgcggcctcgaattaatccatctgatgatatcagggtcatctttcaatttcattattccttcccccattcttcattaattgtaacatattgtcacaaagaaagtggaaataagcgtttttttgatatatttttctttcaaactttatcgtaaaaaagcaaagcatttctcttgcggaattttcgtgttatactcattttaatgaagtatagatggaggatattaaatgatagctgttcaaaatgtcagcttgcggtttgcagaccagaagctgtttgaagatgtaaatattaagtttgcgcccggaaactgctacggattgatcggagcaaacggcgccggaaagtccacttttttaaaaatattgtctggcgaaattgagcctcagacaggcgaagtccatatgagtcctggcgaacgtcttgccgtcctgaagcagaaccactttgagtatgaagagcatgaagtgttgaaagtcgtgatcatgggacatagacgactttatgaagtcatgcaggaaaaagacgcgatttacatgaaacctgatttttcagatgaagacggaatccgcgccgcggagcttgaaggcgaattcgccgagctgaacggctgggaagccgaaggggaagccgcgatcttattaaaaggactcggcattcctgaagaacttcatacgaagaaaatggcagatttgggcggctctgaaaaggtgaaggtccttcttgcacaggccctgttcggaaaacccgacgtccttcttctcgatgagccgaccaaccacttggatattcaggcgatccaatggctagaagagtttttaatcaattttgagaatacggttatcgtcgtatcgcatgaccgccactttttaaataaagtatgtacgcatattgccgacctggattttaacaagattcaaatttatgtcggaaactatgatttctggtatgaatcaagccagcttgcgcttaaaatggctcaggaagccaataagaaaaaagaggagcagatcaaacagctccaagagttcgtcgccagattcagcgccaacgcctcaaaatcgaagcaggcgacatcgagaaaaaaactgcttgaaaaaattacgcttgacgatattaagccttcatctcgcaagtatccgtatgtacatttcgcacctgaacgcgaaattggaaacgatgtgcttgttgtcaaagacctgtcgaaaacgatcgacggcgtcaaggtgcttgactctgtcagctttatgatgaataaagaggataaaatcgcctttacaggccggaacgagctagccgctacaacgctctttaaaatccttgccggggaaatggagcctgacagcggatcgtttaaatggggcgtcactacatcccaagcgtttttcccgaaagacaacagcgagtattttgaaaacagcgatttaaaccttgtcgactggctccgccaattttcgccgcatgaccaaagtgaaagcttcctgcgcggatttttaggccggatgctgttctccggagaagaagtgctgaaaaaagcaagcgttttgtcagggggagaaaaagtccgctgcatgctgtcgaaaatgatgctgtccggcgccaatgtgctgatgcttgatgagccgacaaaccatttggacctcgagtccattacagcgctgaataacggtttaatcagctttaaaggcgccatgctgtttacatctcatgaccatcagtttgtccaaacaatcgccaaccggatcatcgagatcacgccaaacggaatcgtcgataaacaaatgagctacgacgagtttttggaagacaaaacggttcaggacaagcttgctgaactttacgcgtaatgatagaaaacccgccttaaaaagcgggtttttttttataaaaaggagatggttgctgtgtcatgccgaaaggctcttgagcaatatattcaagcaacaaacacacatgagtttgagaatgtcaaagccctccttgaccccggcgctgtgtactggttttcggatcaaacgtgctcgggctttgaggagattcagcgttattttgaaaacgcctggaagcaaatcgaaaatgaagtatacagcgccggtcatgtcagctggatcacggaaacggacgaacaggccgtctgtctttatacatacgaatggaaagggttatataggggcgaaccggttcaaggggcaggccgtgcgacaaacgtatttgtaaaggacgagtcaggacgctggaaactgaagcatgaacatttaagcagtttgcccaagcgatgaggcggcggagcatggacctgattttcagctgttacagccgccatgcatgtacagggaagtttaggattgcgggcggcatgcggacacgatataaaaggacctcagaagttttctgaggtctttttttgcggaaggctttatatcgcccagttgccgtttctgaatatcggctctctttttccgtcagcagtgattccgtctatattcatttctcctgaaccgatcataaagtcaacatgtgtgatgctttcgtttaatccttctttcgccagctcctcgcgcgacatctgttttccgccttcgatgttgaatgcgtatgcactgccgatcgcgaggtggtttgaggcattttcatcaaacagtgtgttgtaaaacagaatattggacttggaaatcggcgaatcgtgggcaacaagcgcaatttcgcctaagtagtgtgaaccctcatccgtttcgatcagctcttttaaaatttcttcgccttgtccagctttgacatccgtaatccgtccgtttttaaatgtcagtgtaaagccgtcgattaaattgccgccatagcttaacggcttcgtgcttgaaacggtgccgttcaccccgtcttttttcggagcagtgaatacttcctctgtcggcatattggccatgaactcgacgccgttttcgtttgtgcttccggcgccgacccacagatgcttctcgggaagctcgatcgtcaaatctgttccctttgcttggtaatgaagggcgtgataatgcttgtcgtttaagacgcttactttatcgcgcaaggtttgatcgtgatctttccacgcttgaacgggatcttcacggtcaacgcgggtcgttttgaaaatctcattccatagcttttgcacggctgtctcttcatctgcctcagggaatacttttttcgcccaggccggcgaaggcgctgcgacgacagtccagctgactttatccgattgaatcatttgcctgtatgtatgcatcgcttttcctgcggctttctgctgtgcggagatttttttggaatcgatgcctttcaaaagatcaggacttgaagagacaatggaaataaaagcagcgccttctttggcgagcgtctcaagcccctttgcttcccattcagggaactcttcaaaggcttccgcaggagccagctcgtatttcagccttgtgacctcatcatcctgccagcggaccgtcacgtttttcgcccctctttgataggcgcttttgacgaggagccgtgcaaaatcgcgtacttctgttgacgcgttgatgacgacttgctgtcctttttgaacgtttacgccgacttcggccacaagctttgcatatttgctcagtttatcagtaaacgaattcattggcaaaacctcctttattgtccataacatcatatcaaatatttgattgaaaagaaaaaaagaagcagcccggttcaggctgcttcttttttaacggttgattttggccgtttggccggggggcgagcttggcatgtttgcaagggagatgctcatccccccgagaataataccgcttaaaataacggtgatggccaggcgtcttcccatatctctaagcatggtcttcctccttatcgtttctccattcctcacgatatgaaagaagccgggaaaaaagacgcgaaaacaaaaattatttagccgctttttgcaatttatcgatcacttcgagagaacgacccgttccgatagcgacagattcaagcggatttgcagcaacatgcacgggcacaacgatttcctgtgacagccattctttgatgccgttcaaaagcgcgcctcctccggtcaaaatcacgccccggtcgacaatgtctccgctcagctccggaggacagtcttctagcgtcgctctgatggcttcgataatatgcaggagcgattcgcgcatcgccttctgaatttctttcgattccagggtaatcgttttcggcaggcctgtaacaaggtcgcgtcctctgacttccatcgttttcgtctcatggtcaatcaatgcgtagccgatctcaattttgacttcttcggccgtccgttcaccaatcagcaggttgtatttttttctgacgaatgacacgatgtcttcatcaagctgatcaccgccgatccggatcgagtggcacgagacaacgcctccgaatgaaatgatcgccacttctgtcgtgccgccgccgatatcgacgacaacgtttgcgacaggttcatcgacaggcagatctgcgccgatggcggcggcgacaggctcctctatcaaatggacttgtttggctccgcagtttttgacagcatcgctgatcgcgcgcctttcaacagcggttgagccggacggcgtgcagacgacgacgctcggctttctgaacgtaaagccgatgttctttccggcttttttcataatctgcttcaagaggtctgtcgtcatgtcataatcggcgatgactccgtctttcatcggcctgaccgcgacgatttttcccggcgtttttccgatcatgtttttggcttctgtgccgaccgccaatacgctctttgtttccgtgtccacggcgacgacggaaggctcatttaaaatgattcctttgtttttgctgtaaaccaatatgttagctgtgcctagatcaattccgatctcggttgtttgaaacatgttttcacccaatctctatttaaaatttttccgaaaaacgaaattttcttcgtgctgaaaaaatgaatttcatttaaattttctcaaatcatcggcgatttttgggggtttgtgacgattttgaaaccaatctgtaaaatgctgtcctcatatttacatgatgagaaaattatttcatttttatgaccggatttttgtcgaagaaacgcttgataagggaaacctttttcagtcttcattcgtctatcgttatgctaagacaatatcttagaaaaatagaaacaatagaggaagtaggcgaaagttttgaaagcaataggagttgtgagaaaagtagacgaactcggcaggatcgtgatgccgattgaattgagaagagctttggatatctcgatcaaggacagcatcgaattctttgtcgaccaagataaaatcgtcctgaaaaaatataaaccgcacggtgtgtgtctgatgaccggtgaaatcacttctgaaaaccgcgagtatggaaacgggaaaattacgctcagtcctgaaggggccgaattgcttttggaagaaatcaaagctgccttaaacggagtgaaagcataacattcgacgcccttcatcagaagggctttttcttgcgccgggagcagataaaaccgccgtcactgaaaaattcagccatagagacgataaatacttcgaacaatcctctcaaatgtggtgtaaagaatgttacaattgactgagaaatacaagtggcaggtgggggtatgaaaagatatcaaggacgaatcattgcaaccgtgctggcaatgacttttatcatgttttggaattttttattctatggggtgttgggaaataaaatcaattggacggttgatctgctgtttacgctggtgacattaatcagcgtttggtggctcacactttatatcgatgagtcaaatcagcttgtctataaattgaaggaaagcgaaaagaaatataaagagctttcctcagaaaccaaccgcataatggataatcttcaggaaatcgtctttcaaacggaccggataggatacattacatttctgaatcaggcgtggacaaccctgaccggatacagtgtcgaagagagccttggaacgatgtacaacgattattttgaccatgaagaacggatctcgaatcacctgatcgcccagttgaagaacaaggagcccgaaggcaggatcgaggtgctctaccatcgcaaagacgggagcaagttctggggcgaagttcactataaactttattataaaaacggtcaatttacgggcagcttggggacgctgactgatgtgacagaacggaaaaaagcggagatggaactgtttaagtcgaatcagcggctggccatgcagtctcaaaagctggcgatggccgggcagctcgcagcggggatcgctcacgaagtcaggaacccgctgacatctgtaaacggatttttgcagctgatgaaagcggaatatcctgaccggaaagattactttgacattattttctcagagattaaacgaatcgattctgtgctcggagaactgcttgtgctggccaaaccgcaccaggttcaatttaaaaagatcaaaatcaattcggttcttcagcaagtggcaacgcttcttgagacgaacgccgtgctttcccacattaagatcgaaaaagcgtttcagcacggggaggagtgggaaataaacggtgatgaaaatcaaatcaaacaggtattcatcaatttaattaaaaacgggatagaagcgatgcctgacggcggtaaaattacgatttcctcaaaggcagaaggagactgtgtgaaaatcagcatcaaagacgaaggcgggggcatttcccaagccgacttggcaaagctcggggagcctttcttctcaacgaaagaagaagggacaggtcttgggctgacaatttgcctgaatatcatcggcgcccacaacggagaaatgaaaatcgacagcaaattgggcgagggaagcacattccacattttgcttccggtcgataaaggtgcggcgtccgaagagaacgacattcagcaaggatgctgcagccgcgcaactataaaataaaagaggaaaaattccacttcatatgatagaatttgttcaagattgacccatggaggaattaccgatgaaaaaagaatttgcagtaattggactcggccggttcggcggcagcatttgcaaagcattgagtgaagaagggcttgaagtaatggcgatcgacagagatgaagatcgcgtaaacgaatacgccaaaattgcaacacatgctgtgataggagacactacagacgaatctgtgctgaaaaaccttggactgcgcaattttgaccatgtcattgtagcgatcggggagaacattcaagcgagcattttgacaacgctgatcttaaaagagcttggtgtgaaaatgattaccgtaaaagctcaaaacgattatcatgaaaaagtattatccaaaatcggagcggaccggatcgttcacccggagcgtgaaatgggaaaaaggatcgcccacaacatcgtctccaacaatgtgcttgattatctggaactttctgatgaacacagccttgtcgaaatcgcagcgaacggcaaactggccggaaatacactgcttgaccttgatatccgggccagatacggaattaatattgttgcgatcaagcggggaaaggaagtcatcgtatctccgcttgccactgaagaaattcagaaagacgatattttaatcgtcatcggctcaaatcctgacattgagagatttgaaaaaaaagtctttcaacattaaaatgccaccgattaaccgcgggaaccccacagcccgcggtttttttgatcttttcattgactgtttcaagcgattcggctacgatattgaaccatatacatataaaaaagagaggggacatatacctttggacaaagagatgttcattcgccggcttggcgccgccagtcatcgcaaaaaagcggaaactgtaattaaaaacggaaaaatcatggatgtttttaatcaggaatggttggagacggacattgccatcacagacggggccatcgtcggcttgggcgaatatgaggggggaaatatcattgacgctgagggacaaatgatcgttcccggctttatcgacggtcatgtccatattgagtcctcgatggtgacgccgcccgaattcgctaaagcggtgattccccacggtgtgacaaccgttgtcaccgatccccacgaaatcgcgaatgtctcaggtgtgaagggtcttgagttcatgttggagcaggctgagatgaccaggctgaacatttattttatgctcccttcttgtgtgcctgcggcaccattcgaaaaatcgggtgcgattttgaacgccgcggatttacatcctttttacagccgcgaagaggtgctcgggcttgcggaagtgatggactatgtggccgttgaagctggagagccggatatggtgcaaaagctcattgatgccgataaagcgggcaagcggatcgacgggcatctggccggcttgtcagccgggtttgtcaatgtctacagagcggcgggcgtgcttacagaccatgaggtcacaacacctgaagaggcgcttgaacgagtgagaagagggatgtacgtcatgctgagagaaggttctgcggcaaagaatacgcgtcatgttttacctgcggtcaacgagaaaaatgtgagacgcttctttttctgtacggatgataagcatctggacgaactggtcgatgaaggaagcattaactaccaggtcaagcttgccattcaagaggggcttgacccgtttctcgcatatcaaatgggcagcctgaatgcagcggaatgcttcgggttaaagacgaagggagcggtcgccccgggttatgacgcagatcttcttttcatcagcgattttgagaacgtgagcattacaaagacgatgattaacggcgtgatctggagcgggacagagcaaagccaatcgacgggcggcaaagcggcatccggtctgcttcaatctgtgcatctgtctgatttacatgagaacgatctgcaaattccgatcgttcaagagaatgaaatcagggttattgacattatccccaatcagctcgaaacaaagctgtccctggccaagccgaaaagcggagctttttttcagccggatctggaaagcgatctgttgaaaattgcagtggttgagcgccatcgcggcgttaaagaaatcggactcggcgtagtcagaggcttcggtttaaaagaaggcgccatcgcgacaaccatttctcatgattcccacaatttaatcgctgtcggtacaaatgatcaagacattttaaaagcgattgaacgcctcggagaaatcggaggaggcctcaccattgccaaaggagggaaggagcttcaatccgtcgcactgccgatcgccggcctcttgtcggacaaaccgcttgagacggtcaacgaaagcttgaaatctctccacgcggcaataacagagacaggattttcaggagcgtttaatccttttctgacgctttcttttttagcgcttccggtcattcccgacattaaaatgacaacggaaggattgtttgatgttaaagcgttcaggcatatcccggttcaaccataaaaaaacggatgcaccccggtgcatccgttttttgctgtatccgcatccgcgattagacttccataataatcggaaggatcatcggccggcgttttgttttttcatagaggaaaggagcaagcgtgtctgtaatctcgttcttaatttcagaccactgtgtcgttttgcgctccatcacttttttaaggtgtcctgcaatcagttcctgggcatcattgattaaatcaccggattctctcatatagacaaatcctctggaaattaagtcaggccctgcggacactttgaattctttcatgttgatgctgacaacgacaatgacgagcccttcttcggaaagaatccggcggtcgcgaagcacgatattgccgatgtcgccgatgccgcttccgtcaatataaacattgcctgacgggattttacccgcaactgaggcttcttcgcttgtcaaagcaagcacttccccgttgtccataataaagcagttttcctcaggaattccgcagtctgtcgccagtttgacatgcattttctgcattctgtattcaccgtgaatcggcatgaaaaactttggcttgatgaggcggagcatcagtttttgctcttcctgtccgccgtgtcccgaggtgtgaatgttagtcacagctccgtggatgacatcggcacccgcccggtaaagctggttaatcgtgcggctgacgctgatcgtattgcccgggatcggagatgatgaaaatacgaccgtatccccgggattgatggagatttgccggtgtgtgccgtttgcaattcgagatagagcagccatcggttcgccttggcttccggtacagagaatcgtcactttcccggcagggagcctgttgatttcattcgcttcaacgaaagtgtttttcggacacttaatatatccgagcgtttggccgatttcgatcgccgactccatgcttcgcccaaatacggcaaccttccgtccgtttgcaacagccgcttcgatcacctgctgcaggcggtggatgtttgacgcaaaggttgcgaagatgatcccgccttcgacttttccgaaaatatcatcaatgctttctccgactttgcgctctgacatcgtgaaatcagggatttcactgtttgtgctgtctgacagcaggcaaagcacgccttcttttccgatttcggccatctttgtcaagttggcgggttcgcccaccggtgtaaaatcgaatttaaagtcaccggtatgtacgatgtttccttgcggtgtttttacgacaatcccgtatgagtccggaatgctgtgggtcgtcctgaaaaaagaaaccgacgtttttctgaatttgacgatatcgtcttcttcaatgatatgaagctttgtttggcgaagcaaaccgtgctcttcaagcttcttcctgagaaggccgatggcgagctgtccgccgtaaaccggaatgttcacctgtttgagcaggtacggaattccgccgatgtggtcttcgtgtccgtgcgtaataaaaagacctttgattttttcttcgtttttgactaaataagtgtagtcagggatgacatagtcgattccgagaagctcgtcttccggaaacttaatccccgcatcgatgagcacgatctcgtcctggaactggaccccgtacgtgtttttgccgatttccccaagtcctccaagggcaaatacagccgtttggtcatttttaacaaatttcattcattcataactccaatactttaaaattttcgctttgcttttcatattctaaaaaagcgccttcaacttgctgtataaactcaatattgtagttgtatggttttaatttagatctgacttcacgttcagattgagcttccacaaaaattgaatctgttttttcacgaacaggtacttcgtcattgcttgcttgataaaataccttatagatcatccaaatctctccttaactgccgattgttagactcgtctttctattatattcgaaattggctcataagaaaagcgcctgagaaaaaaaggacccttccacacgagtgaaggtccttttaggcaatcgactttctgcgcatcatgccattcagctgtttttttaattttttccgcagacggcgaagcatacgggttcctcctttctctgacttgtctgagtaacttccgtatctctttagttctattatatgatgaatccgtctattgttacatggatattattggcatgttgatttagttttgattttggagtgaaaaggttttctcgcgtacgcagtttttgtatgatggtacaggagaaccatcaatcatactagctaagggagaaggattcactgccatggataaaaagctgattttctttgatattgacggaacgatttatgatcacaataaacgcattcccgccaccgcaaaacaggccgtctccgatttgaaagcgcacggccatcatgttttcatcgcgtcaggccgtgcgccgtttatggtcaggcctgttcttgaagaactgggcatcgattcttttgtctcttataacggacaatatgtcgtttttgaaggagaggtcatttataaaaatcccattgccgagcagtcgttagaagcgctgcttgcgcattcggacagctgcggccaccccctcgtcttcatgggggaagaggggatgcgctctacaactgccgcccatccgttcgtcgatgaagggatcggcagcttaaaagtcaatccgccggaagaggatcgtacctactttaagggcagggacattttccaggtcctcttgttctgcacgcaagacgaggaagagcggtacagccggtttaaagagtttgatctcgtccgctggcacgagcgctccacagatgtgctgccttcaggcggatcgaaagcggaaggaatcaaaaaagtcattgaaaaacttccgttcgacagagaggatacttatgcgttcggggacggtctgaacgacctgcagatgatcgaatttgcgggaaccggagtagcgatgggcaacgctgtgcccgagctgaaaaaaatagccgactttatcacaaagcccgtcgatgaagacggcattcaatacgcggtggaagcgctcggacttttgaaatcataaaaaacggatcagaaatgatccgttttttttatgactttacctgcctacaggcgttgcattttcaggttgtttcagcgggttttctttgtcgatgtggtcgtaaaacataatgccgttcaaatgatcgatctcatgctggaatacgatcgccggatatccttttaagcggatgtcgatgttttcgccttcaagcgtcgttcctttgactcggatccgttcatagcgcggaacatatccgggaatcggctcgtcgacggacaggcagccctcgccgcttgtcaaatagcatctttgaacagagtggctgacgatcttcggattgaaaagcgcatagctgtatagtgtcccgtcttcgctttcggcatgaacggcgatcattcgtttattgatattaatttgcggagcggctagaccgacaccaggacgaaggttgtactttttagcgatttcggggtcctggctgtttttgacaaactcgatcatttcgctcagctgtttgatttcttcttcgcttgctggcaattgaacttcttcggcgacggttctcaaagcaggatgaccgtcgcggacaatgttttccattgtgatcaacatcttcactcccaacgattcattatgtaaagtatagcggatcttgctctttccgcgcaatctctgtgcatgataaaatgaccagcctaaaggaggctggtcatgacggatccatcaggggctagcagcctaaataagcggcccctacaataatcagcaaaataaagagaacgacgatcaaagcgaatgtgcggccgtagccgtatccataaccgccgccgtacccgtatccagggcagcaataaccgtacatataaagacctcctccgttattttacgcacagccttttctttttagtaggcatggcgtctaatataaactatgtaaaagtccaaaggttgtatagtcgaatgcccagcttcaaggaattttccctaaaggtttggtctaaaagcgaaggcggttgcataccgatctgatatcggcttgtccatatctttagacttctgttgtcaaacaagcgaattcattttatagtggaatttgtcgagattgggggaagttcatagtgaaattttcaaatatgcgggtgcccgcaggcatcgtcgttttttgcacggctgcatttgtattaacaggctgtctctggaaggatcctgtcgagtcgtttcacggctcgctggagaagatcgtggaattggaagagccttttaaacaagagcagggttcacttaaaagtcttgaaaaagccgaatcgaagctttacgaggaaatgatcaggctcaatatggatgattttgaccggatcgctgcgctctccgacaaagcgctgaagacagccggcaaacgcgagaagcacttgaattctgagaaagaaagcatagatgaagcaaagcaggagtttgaagcaaataaagcgtcggcagaaaaaatcgatgatcagaaggtcaggaaaaaggctgagaacgctgcatcttatatggaaaagcgctacaaagcatacgactctctttatggcgcctatcaaaacgcaatcggccttgacaaagagctgtacaagctgctcaaaaataaagggcttaaactggatgaccttgaggagcagctgaaaaaaatcaatcaatcgtatgacaaagtgctgaaagaaagcaagcatttcaatgagtatacaaaggactacaacaaagccagaaaagatttttacaaggctgcggggtttgagatgaaagagggctgaattgttcagccctctttttttcgacaaaatctgtatcgctattgtaatacagattgttatctatactagaacagtttgcagcagtcttgacaacgctgaaacagaaatccgataaagcgaatacatttattgaaattcaggaatgaaaacgattgacgatcatgatcggctggtgtaaacttagccttggtggaacttgttgtattagtttgtcataaactataagtgatacagttttagaacgcgttgtgctgtccttacataaaagtttcgacaaccatcaaagcggctaataagaaataaatatgagttgcgcccgtcaatttaggacaccctaattctgtatgtataagggatacacgtctatgactgtcaaaagaaaggaagaggtgactttatatggctgcaaaaacgaaaaaagcaatcgttgatagcaaaaagcaattcgatgccattaaaaagcagttcgaaacgtttcaaattttgaatgaagaaggcgaagtcgttaatgaagcggcaatgccggatctatctgatgatcaattaaaagaattaatgcgccgcatggtgtatacacgcattttggatcagcgttctatttctttgaacagacaaggccgccttggcttctacgcgccgactgccggtcaggaagcttctcaaattgctacgcatttcgcgcttgaaaaagaagacttcgttcttccgggctaccgtgatgttccgcagctgatctggcacggacttccgctttatcaagcattcttgttctctcgcggacacttccgcggcaaccaaatgcctgacgatgtcaatgcgctttcaccgcaaattattattggtgcgcaatacatccaaacggctggcgttgcactcggcttgaaaaaacgcggcaaacaggctgtggcgatcacctatactggagacggcggtgcttcccaaggtgacttctacgaaggaatcaactttgccggtgcgtataaagctccagctattttcgttgttcaaaacaaccgctatgcgatttcaacacctgttgaaaagcaatcagcagctcaaacaatcgcccaaaaagctgcggctgcaggtatcgtcggcgttcaagtagacggaatggatgcccttgctgtatacgctgcgacacgcgaagcacgcgagcgcgctgtaaacggcgaaggccctaccctgatcgaaacgctttgcttccgttacggtcctcatactatggccggtgacgatccgacaaaataccgtacaaaagaaatcgagaatgagtgggagcagaaagatccgcttgtccgtttccgcaagttcttggaaaacaaaggcctttggtctgaagaagaagaaaacaaggtaattgaagaagcgaaagaagaaatcaagcaggcgatcaaaaaagctgacgaagagccgaagcaaaaagtgaccgacctgatcgacattatgtatgaagagcttccttacaaccttgtagaacaaaaggaaatttataaagagaaggagtcgaagtaagccatggcgcaaatgacaatgattcaagcaatcactgatgcgttacgcacagaactgaaaaatgacgaaaatgtcttagttttcggagaagacgtcggtgttaacggcggcgtgttccgtgcgactgaaggattgcaaaaagagtttggtgaggatcgcgtatttgacactcctcttgctgaatctggtatcggcggccttgcactcggcttaggcttacaaggcttccgtcctgtaatggaaattcaatttttcggctttgtgtatgaagtgatggactctgtttccggacaaatggcacggatgcgctaccgttccggcggtcgctggaattctccggtgacaatccgttctccgttcggcggcggtgttcatacgcctgaacttcacgcggacagcttggaaggactcgttgcacagcagcctggacttaaagtcgttattccttcaactccgtacgatgctaaaggacttttaatctctgcgatccgcgataacgatccggttgtcttccttgagcacatgaaactttaccgttcattccgccaggaagttcctgaagaggaatacacaattgaaatcggcaaagccgatgtgaaacgcgaaggaaaagacctttccatcatcacatacggagcgatggttcacgagtcattaaaagcggcggaagagcttgaaaaagaaggcgtatctgctgaggttgtcgaccttcgcacagtcagcccgcttgacattgacacgatcatcgcgtctgtagaaaaaacaggccgcgcaatcgtcgttcaagaggcgcaaaaacaggctggagtagctgcaaacgttgttgccgaaatcaacgaccgcgcgattttgagcctcgaagctccagtgcttcgcgtcactgctcctgatactgtattcgcattctctcaagctgaaagcgtatggcttccaaaccataaagacgtgcttgaaactgcgaaaaaagtattggaattttaattagatctgaacaattcaaaagggaaaagctgatatcagcctttttcccttcatgcatttccacagtcagtcggagaaactgtagccgtgtactgacagtcggcctaaacaagaggccgaccactatatcaactacgtaataatcttaggaggtcgagaactgtggcatttgaatttaaacttccggatatcggggaaggaatccacgaaggcgaaatcgtgaaatggttcgtcaagccaaacgacgaggtaaacgaagatgacgttttggcagaggtacaaaacgataaagcagttgtagaaattccttcacctgttaaaggaaaagtattagaattaaaagttgaagagggaacagtcgcaaccgttgggcagacgatcatcacatttgatgcaccaggttacgaagatcttcaattcaaaggcgacgaatcaggcgaagcgaaagcggaagaagctgaaaaacaagaaactgatgcacctgcagaagcagcggaagcaaacgagcaagcggatgcagatccgaataagcgcgtcattgcaatgccatctgttcgcaagtatgcccgcgaaaaaggcgttgatatcgtgaatgtttcaggttccggcaaaaacggccgcgttctgaaagaagatatcgacagcttcttaaacggaggaactgccggagacgctaaggctgctcaagctgaagagaaagcagaacctgctgcacagcaacctgcagctgcggttcaagtgcctgaaggcgaattccctgaaactcgcgagaaaatgagcggaatccgcaaagccattgcaaaagctatggtcaactcaaaacataccgctccacacgttacattaatggacgaagtcgatgtgacaaaccttgtcgctcaccgcaagcagtttaaacaagttgcggctgatcaaggaattaagctgacttacctgccttacgtggtaaaagctttgacatcagctctgaaaaaatatccagtcctgaatacatcaattgacgacaatacagatgaagtgattcagaagcactactacaacatcggtattgcggcagacactgaaaaaggcctgcttgtgccggttgttaaaaatgcggaccgcaaagcgatttttgagatttcaaacgaaatcaacgagcttgcgacaaaagcacgcgaaggcaaacttgctcctgctgaaatgaaaggcgcttcttgcacaattacgaatatcggctctgccggcggtcaatggttcacaccggttatcaaccatccggaagttgcgatccttggaatcggccgcatcgctgagaaagctgtcgttcgtgacggcgaaatcgtcgctgcacctgttctggctctttctctaagctttgaccaccgtatgatcgacggcgcaactgcacaaaacgcgttgaatcacatcaagcgtttgctgaacgatccacaattaattttaatggaggcgtaatgtaatggtagtaggagatttccctattgaaacagatactcttgtcattggtgcgggacctggcggctatgtagctgccatccgcgctgctcagcttggacaaaaagtaacaatcgtcgaaaaaggcaatcttggaggcgtatgtctgaatgtcggatgtatcccttcaaaagcgcttatcaatgcaggccaccgctatgagaatgcgaagcattctgaagagatggggatcactgctgaaaacgtaaaagttgactttacaaaggttcaagaatggaaagcctctgtcgttaataagcttaccggcggtgttgaaggccttctgaaaggaaacaaagtcgacatcgtaaaaggcgaagcatactttgtagacagcaattctgtacgcgtgatggatgagaactcagctcagacttacacgttcaaaaatgcgatcattgcaacaggttctcgccctatcgaattgccaaacttcaaatatagcgaccgcgtactgaattcaacaggcgcacttgcactgaaagaaattcctaagaagctcgttgtcatcggcggcggctacatcggaacagagctcggtactgcatatgcaaacttcggtactgaagttgtcattcttgaaggcggagaagaaatccttccaggatttgagaagcaaatgagctctcttgtgaaacgcaacctgaagaaaaaaggcaacgttgaaatccatacaaaagcaatggctaaaggcgtagaagaaaaagctgacggcgtaaccgttacgttcgaagtgaaaggcgaagagcaaacgatcgatgcggactacgtacttgtcactgtcggccgcgttgcaaacacggacgagctcggacttgaacaagtcggcgtcgaaatgacggaccgcggcatcatcaaaacggacaaacaatgccgtacaaacattccgaacatctatgcgatcggtgacatcatcgaaggtcctccgcttgcgcataaagcttcttatgaaggtaaaattgctgctgaagcgattgccggagaagctgcggaaatcgactatcttggaattcctgcggtcgtattctctgagcctgaacttgcatctgtaggctacactgaagcacaggctaaagaagaaggtctttcagtgactgcagccaaattcccgtttgcagcaaacggacgtgcgctgtcattaaacgaaactgacggtttccttaaacttgtaacacgcaaagaagacggcttagtcatcggtgcacaaatcgccggagcaagcgcttctgacatgatttctgagctgagcttggcaatcgaagcaggaatgactgctgaagatatcgcaatgacaatccacgctcaccctacattgggagaaatcacaatggaagctgcagaagttgccatcggcatgccgatccacgttgtaaaataaatcaaaaaccccctctgcagggggttttttatgttttctcttattcgggtgcatgacaaattgcccgggatacatgtgaagcagaaaaaaaatccccttgcacatgaactgacccgttaaaatgagacttagaaaaaacacctatgctgcctgtcccctgtattccagtggggacaggtagtttaattttgcctgaattcgtacatgattatatcgatacatgtattgatttacaatttgtactactttagaattggatatagatgctctactttgagcgttaaatccttccgactttagcgaggagtgaaaggattcaatgacggcattatcatggcagtttccttttcgagacatgcttgtggtaatgcctttttctttggccaaattctgatatgcatgtgaagtatagacagatccctggtcgctatgaagaagtaaccctactggtttacgtaattctacagcttccctcaatgtgtctaatactaggttaatatcttggctcgtacctattttgtaagccactatttcgttgttatataagtccataatcgttgataaatataacatagtcgagccataaggtaagtaggtaatgtcggttacccatttttcatttaatcggcttgctttaaaattacgattgagagtgttcggcacaataatattactctcaccacaaatgtacttttgtcgcttcttcttaacttgacactgaatctcaaacttttgcataattttttgtacagttttgcggtttacatttatcccatactttctgtttaagatggatttaattttacgatgaccatagtgatagaagtttttcttacacagcttgattactagctcttctaatgaagttagctcaacttttttatacttctttttccaacggtaatatgttgacttaggtatgcctaatactccaagaatatcaattattttaaaagtggctgagagttcttctacaacttggacaatgactcgtggctccaactcctttcgatctcctggtacttttttataattgccaattgagcctctagctgtttattctttagttttaattcttctagctcactcatttcctccgattctttaccgtaggaatattgttttccaacttgttgcgaaaatcgataggtttggcctgttttgtaccatcgcatccatgttttaatttgagtcttattttttatccccagttgttccattatttctttgtttgtcattccagcttgtttcattttaattacttcccattttacttcttctgcgtaatgtactcttgtgcccatagaaaaacaccctcctaagaatcatattgtattaatacgattcagggggtgttttttccttgtctcatttatttgggtctctccacacatgcacagggggcttttaatgtttcaattccttttgaagaagccttacaattttatctttatcttttatttttccttcaattttaaccagtactttcttatcattaacaagcagcaagcttggaaagactttaacctcttttttccactcgcctttatcatgtgaaatttccatacttgaaacctgttcgggaaattctttttttaaatccaaaagcgcatcataataagccacttcctgctccatatgctcgtcatcggaaaaaaagatgagcttgaggtggcggtgattggtgctttgatgctgctggtcaggcatgatgtgagataaagaacatccactcgtcaaaaaaaggaaacaaattgcggcggtgaatatcgctcgaaaccacatgacgtctcttcacctctctatataatgcaagccgattttcctgttcgattagtaaacaattcctattttatcatgataattgaaataatttttcgttgttacccatttgttacacaattgataactgccgttttatttatgagatgttgtaggttgagcgtgtttgatgggtacatcgtcggaatcagccgggaagcgttctgcttataccttaagcaggaatacatatataacatgatggcctttttttagaaaaagagcaaaaatgatttaaatgtgttatacaatttaccgttgacaatattaatgtgacataatattataggggtaacaaatttaaacgcttccattttgaaaagaaaaggggaatgaaagatgggcacgatcgtttgtcaagactgcaatgaaaccattcagcattttgaagatgagaaagtgacgatactttacggaacgtgcggacagtgcaactgccatcttaaagaggaagaatagaaaaaagcatgcggccatttacagtgccgcatgcttttatgtttttacaggattgcctgctgttctttaataacgcggatcatatggagggtgtcatcttccggtccctgaacaggcagcccagcttccaggttcttttcgatgtagttgatattatcctcggtaatgatctcgcccggaatgaagatcggtatccctggcggataaaccataacaaactcggcaatcattctgccagctgcttttttgaacggaatgatctccgtgtttgcgtaaaaagcgtcacgcggtgtcatcgcaagcgccggaatgtttggcagaagcacttcaggcttgcgtctgttttccgcagatgaagcggcctgttgagcaatctcggttaatcctttaattaacgcatctgcatcctctttccggtctcccggtgtaaaaatgcacaggatgttgtataagtcagaaagctccacttcgatttggcatgactcgcgcagccatttttccacatcatgaccggtcaggccgaggtctttcacagatatgatcaatttggtcggatcatagtcaaaagccgctttggagccgaggatttccctcccgacgcatgaaatcccgttgatattattgatgcgttcccttgtttcgttggcgagcttaatcgtttgttcgatcagttcgtgtccctctgtggctaagcgttttctggcgacatcaagcgaagcgagcaatagataggaggtcgatgtcgtcgtcagcatgcttaaaatcgattgcaccctttcctttgaaaccagaccttctttcatattgagaatcgaactttgtgtaagggatcctccgagcttatgaacgctcgtcgccgccatatccgctccggcctgcattgccgaaagaggcagatcttcatggaagtggatatgaacgccgtgcgcctcgtcaactagcaccgggacatgaaaagaatgagccagctcgacgatgctttttaagtctgcagctatgccgaaataagtcgggttgatgacgagcagtccttttgcgtcaggatgctcaagcagcgcttttttcgctgattcaggggtgatcccgtgtgaaatccccagctcatcgtcgatttccggatggatgaagatcggtacggcgcctgagaagacgatcgctgacatcaccgatttatgaacatttctcgggacgatgattttgtctccgggtccgcatacggccatgaccatcgtcatgatggcgccgctcgttccctggacggaaaagaacgtgtagtcggctccgaatgcttcagccgccagatcctgcgcctgtttgattattcctttcggcgcgtgcagatcgtcgagaggctcgatgttgattaaatctatgcttaatgcattttctccgataaactccctgaattcagggtccatcccagagccttttttgtgccccggtatatggaactggatcgggtttttgccggcgtgtttttttaatccggtatataggggtgtttcgtgctgcaacaattgttttcccaccttcatgataaacctgctatttccttaaagactattctttatcaaaaatcgttgagttattttgcgtttttgcttgatggcataaaacaaatgaattatattatgttcttgaaagaatgtaaagaacattttatcatctttcctgtaaggggcttctaggtccctatggatagtcgcaaaaaagaaaaccaatactaaagctatacaagccgtcaggctgaactgcacaaggagatgaaccaaatggaagaagggtaccaatatccgatgaatgaagactggagcacagaggaagcgatagacgtcatatcgttttttcaggcggttgagctcgcttatgaaaaaggcgtagagcgagacgtgctgatgagtgcttaccgccgctttaaagaaatagttccgggaaaagcggaggaaaaaaagctgtgcagccagtttgaagaagcgagcgactactctccgtatcaagcagtcaaaaaagcaaaggaacaaacggaagatacgaaaattaaaatgtaatgagaaaatccaaaacaaaaagggatggcaccaccggccatccctttttgattataccgatactttctgcgtcaggcggtaaaggaaggcgagcttttcaaaagccgcttcgatttcggatagaaacgcctcttcactcatatgcagcacctcgtctttagaaagctgaataccgcaaagcgcttctgctttcttcacgttgacgagccgttcaaacaggttttccagatctttttcattcatctcagactgtctcttggcatccggtttcgtatgatcggccgaccagaaaaagcgacttggaatgctgctctcaatatccggcagatgcttcttaaacagctggccgtattcctgcttgagaggggactcatagatcaatgcaaaccatacgaaaacgtgggtttcccataaaccaatttggaaatgcggcagctttttatagccgcgcttattgtttgcgaaagcaacccagctgtcgtccggcggattgactgagcggcgcgcgtgcttggcgacgtggacaaacatttcgtctcctgtcaaagcggacagaacaggcgcaaaatgatcgccgagcccttgaagtttcgggcgcactgtgtctttcagaacgctcatccgcgcatctaaaccttctattgtaaatgtacgaaaatcctcttcagtaaaacgcagactgctcattgtgttcctccttgtccaatcagtaaagatattgtatcacagtcggcttttcaaacaaaaaattacgtttcgccttgcggaatttggggaatcgttaggtaaacacacaatttttagaataacgttgcgaatgtttgagcacttcatacgatatgaataagaaattaatatatatcacgcttaggacttaaagccagaaggattccttttgaaatcaattttctctggagggggcgtagggcacatgaaaccaatagtaaaacaaggattgaaagaggaaaaagacaatcgggccgctgtttggaggcttgaggtcgattatgaacttgcaacgctttttgaagctatggaaaaaaaggatgaaacccaaatcgagttgagcaagcgcaaactggaacgactcagaaaagaatggatcagattacatggttgaaaccataataaaaacgaaccgtttgagaggttcgtttttatctgggctgcctggatatttgtcatttttcttgatttttcccggttaatatcagtatgctatgaataaatcaacaggtatacatagaaaagaggtagtgtgatgacaaactggaaggaaatcgatcgcctggcgaaaagctgggtgaaagaagctggtcagagaattaagcaatcaatgaaagaaaagatgacgattgaaacgaaatcgaatccaaatgaccttgtcacaaacattgacaaggaaacagagcgttttttcattgaaaaaattcaatcggtttttccggatcatcatattcttggcgaagaaggccaaggggacaagctcacatctttggacggcgtcgtttggatcatcgatccgatcgatggtacgatgaactttattcatcaaaaacgcaattttgcgatttcaatcggcatttttgaaaacggaaaaggcaaaatcggcttgatttatgatgtgactcacgatgagctttatcatgcttttcaaggcgaaggtgcttacatgaacaatacaaagctcggcaagatgaaagaagtgccgcttgaggaatcgattctggccatcaatgcgacatggatcaccgagaacagacggatcgatccaagcgtattatccccgcttgtcaggcgcgtcagagggacccgttcatacggttcagcggctttggaactcgcttatgtagcggcaggcagaatggatgtgtatgtgacgatgaggctcgctccttgggattacgctgccggctgcattctgcttgacgaggtcggcggaacatatacaaccattgacgggaaaccgctcaattttcttgaaaaccacagcatcgtagccggcaatccggcagctcaccgggcgattttcgacgaatatttgccgcatgaatagcaggtctttctcttcttctgatctcgccttttttgaagagctggccgaagcgagccccgggtgggtgaaggaagagcttgacggaaacagcctggaacgctatatgagtgcttatgcgatgtataacggtgaatggctcgtgtgggaagacgggggactgccggcggctctcagctttcatctcgaatgggcgccttctaatggcaagccttggctcggaacgcttcttgtccatcccgatttccgcaaaaaaggccgggcaaaagaagtgatcaaaacgatcggaaaacgcttgagagaaaaggggcataaagcgttgtttgcggcagtgccttatgagaaagacgaatggttgaacatgctggcccgttcaggatttgaacagctgaaaacggaaaaagatgaaaagggaaaacgatatttgatcatggttttgccccttcccttgtggctgcaatgagacttgtttaacaacaggtctcttttttttatgattttatgaaacaatatgcagcgtcgtttgtctataaagatgaggccttaatttgatgtaaaggaattgtggacattgatcgaactatttagtgattatgtgctccattttgaacgttattttgttttaagcagacagagcatgcttgtcattcagtggtgtgtgacaggccttgtccttttgtatgccgtgtcatttcatccaaaagtgtgcaggcggcgcctctttttttatgcaggcatcgttctcaggctgatactggttggcgccctttcgtttgaattggctcaccaaatgaaagccgctgagttttcaaacctgtacatagacgaacaagatgcgcttctgccttttatgcagtttttgctgttcggctatattttgcttgtctcttttcattatatgatgacactcgcggaaaaagggggcaaggggctgttttttgcatttgacattgcggtgatggcgatgccgcttttccaatcgctgttcagctttgccgcctatttgaaggaatttggagcggaggagcttgaagaattgccgctcgttctgttgttgattgtcggaataccgggactgatgatctgcttgttttttcagctttattggaaaagaaaccgttacgttctccttttgattttttatattgtgacgatcggcggtttcttcatcaaaaagcttggatacgaattttttccgctgaacgtatttctgacaatgatcggttttcttatgacatatcacttgctgaatgactcgagaaagcctttgttgatggtgaagcgtgttttagccgcgggcaccgccgtatttttcacgcttcacctcaatcctttttacaatttggcggatgccgcttttacaatctcacacccggaggtttcagacgtggttgatgccaattttcggcctgtttcggttaaagaagcgaagcagactgtcagctcgttttttccgacagagagctttatctatttgtcagctaccaaccaggattttcataacgtttatcatttcaaaacgaaagattacgatgcggacgttgacggctggacgggaatgatcaccaattatcacaatcaaaaaaagcctagcgggaatatcctgtccggtcaggcatatatcaagcggtcgaagcaatttctaagggaacacggccgcgaacttgacaaacaaatcaaggcaaaggtcagccgtgatgacggcgaagctactgttgaattttaccgtgaaggcgaggatcctgaattaagcacaatgtggtttacttggcggaaggagactctgatgggattccatgaggacgcgtctgtttacagcttagaaagcgtgaaccaagcccgcgtttctggtgaggatatcgagcggggagttgaagccgtctatcgtaagctgggcatacccgtctcatcttatcggctgacagatattgatttattattcccattcagcctcaactcggcatccatcaacataaagacaagtgacggaatggggatggagttccaccctgtaacaggtgcattaacggctatttcgatcaaatctgaaagcgccttgccttatcgcggacaagagcttgaaaaacgcttgctttcattatttgatcaagacatttccaatctgaaaagggtggagttagaaaaggatctgatagaatttcagaaaaaagaaagcgatgctgtgttaaatacggtctggaccatgacgaaacatgaagagggagcttatctgacggtgagaaaaaactttcaaaaagcagatgaaaaacccccctacacgtatgcagacggggaaaaagcttttcagaaagtgtctgaacgctatcaaaaagggctggtctatcataaacggacgaagcttgtaatcgtttcagacggggatcaaaagagccgttatgcgtggcttgtcatcatccagccgttcggctcaaatgaacatgacgcatacttggttgatgccgagacagatgaggtgaaacattttgatgacaaatgaagaaaaaaaagcggtgtttatcgatttgtatgagctctatcaagaaagtgaactggaagaggaaacgatgatctggatgaaagagcatgagcagttttttcaggatcaggctgaagcggcagcagccggtaatagagagctccccggcatgcaaaaaacagatgatcatcagaagctccttcatatcaagatttttgtttactcgttatatggtgctttcctgctcctatcgatttggatgacggtgtggttttttttctaaatggctcacaataataaacagacgattgaagaactgtacagggaatattatcatgacatcatgtactatttgtacaggcgaacccatcagcttgagacggcgaaagacctggcgcaggatacgtttctaaaagcttttgcgggcctggagtctttcaggggccattcctcgatcaaaacatggctgtatacgatcgcacatcatacgtttatcaactggtacagaaaagataaaaaaatccaattttccgacgtggcggcctgcggcgatatggaacagcacacatttgaaatgcctgagcgccatttggcaaacgccataatgcaggaagagctgaaacatcacattgaccggctgaaagaagattaccagactgtcctcattttaagagagtttcaagagctgtcatacgaggaaatagcggaagtgctgaattggaaactgtcaaaggtaaaaaccaatcttcaccgggcccgcctggagctgaaaaaaagcttggaaggcagggaggtttaacaatatgaaatgccatcttgtaagagatttactgcctttatacatagaaggcgattgcagccgcaaaacggaacgtttggttgccgcacacattaagacatgcgaggattgccgggaaatgtacgacatgatgagggaacctgtcaattttcatggtgacggaggattgccaaaggaagcagaagaagcggaagaacaaaagttcaggaaagcgtattatcaaaggctgattctcaaaggggcagcgctgtttggcgggggctacttgctgatgcttttgatttacttattctttttataagaactggcggcaaccagccgccggttttttgatataaaatcaaaagccccttcattcggtaggggcttctttcctattcaagcaggcctttttcgcgcattctttttttcagtgtgaaaccgcttcccataatgacgatcagaatcgcgatggcgattgcgacgccggctgcgcttttttcggcgactgcaactccgatcatcatgatgctgatcactgcagcaagtgcgaataataagaaaatccatttgatttgtttcactgtttttccatccccttagtatgaagtctactgttagtttacagaaaatcgcgctggatagaaaggggcaatgggagctgaaaatttgaaacaaattgaaataactttgtttgtcagttataatatgaaagattatctgaatttttttaggagatgaaaatgtgaaacttcgagaagatcttcgcaatatcgctattatcgcccacgttgaccatggaaaaacgacgctggtggatcagctcctccatcaggccggtacattccgtgcaaatgaaaacgtggctgagcgcgccatggattccaatgatttggaaagagagcgcggcattacgattttagcgaaaaatacggcgattaattataaagatacacgcattaatattttggatactccgggacacgcagatttcggcggggaagttgaacggatcatgaaaatggtcgacggcgttctgcttgttgtcgacgcttatgaaggctgcatgccgcaaacccgctttgtgctgaaaaaagcacttgagcaaaacttgacgccgatcgttgttgtcaataagatcgaccgcgattttgcccgtccagaagaggtcgttgacgaagtgctcgatttgtttatcgagctagatgcaaatgaagaacagcttgaattcccggttgtttacgcttctgcgatcaacggcaccgcgtcagcagatccgaagcagcaggatgaaaacatggaggctttattcgaagcgattgtcaaccatattccttgtcctgtcgataaccatgaggagcctttgcagttccaggtggctctgcttgactacaatgattatgtcggccgtatcggaatcggacgcgtgttcagaggaacgatgaaggtcggacagcaagttgctttaatgaagcttgacggttctgtcaagccgttccgcgtcacgaaaatcttcggtttccagggcttgaagagagtcgagattgaagaagcgaaagccggcgaccttgtcgctgtatcaggaatggaagacatcaatgtcggagaaaccgtctgcccgattgagcatcaagaggcgcttccggttcttcgcattgacgaaccgacgcttcaaatgacgtttgcggttaacaacagtccttttgccggtcgcgaaggaaaatatgtcacggccaggaagattgaagagcggcttgaacagcagctgcagacagatgtcagccttcgagtcgatccgacgccatctcctgacgcatggatcgtgtcaggacgcggtgagctgcatttgtcgattttaatcgaaaacatgcgccgcgaaggctttgaactgcaagtatcgaagccggaagtcatcattaaagaaatcgacggcgttcgctgtgagcctgttgaacgcgtacaaatcgatgtgcctgaagagcataccggatctgtaatggaatcaatgggtgcgcgcaaaggtgaaatgatcgacatgatcaataacggaaacgggcaagtccgcctgattttcaatgtcccttcacgcggattaatcggctactcaaccgaattcctttcccttacacgcggtttcgggattttaaatcatacgtttgacagctatcagccggttgagccggggcaagtcggcgggcgccgccaaggcgtgcttgtctcaatggataccgggaaagcttcagcctacggcattcaaggcgttgaagagcgcggcgtgatttttgtcgagccgggcacagaagtatatgaaggcatgatcgtcggcgagcacaaccgtgaaaacgaccttgtcgtcaacatcaacaaaatgaagcagcagacaaacgtgcgctcagcgacgaaagatcagacggtcagcatgaaaaaaccgcgtatcatgtcgcttgaagaatcgcttgaatacttgaacgaggatgagtactgcgaagtcacacctgaatccatcagattgagaaagaaaattctcgacaaaaacgaacgcgaaaaagcagcgaaaaagaaaaagctggcaggattgtcgtaatatttgcagaacctaaaaaaagagcaacccaactaagcaaaggggaggggaatctttttgactgatgtaagtgaacggctgtcgttttttgccgctctctataaagtggaccagaatcccgaggcgggaatgtggtggctttatgccaccatcttcgtcctgtctgcggtcgtctttaaactgggtttcgccaaacggctgccgctgttgaaaacggcgatcatttacttttttctggcattaggctgtacgtttttaacttttttcggcgtttttctgccggttggagaagggctgatcgtagctgttttaatcctttcgatttataaaatccgcctgcaccgttcgaaaaaagagcagacgggggcgaatacgtagaaaagacatagccgaagaaggctatgtcttttctgtatccgcgagaaaatccgccgttaataagtcccgaaacaaagccctggcaaaaaggatctcatcaaatgaataccggcttaaaaatcgtttaaatctttgttcgattttatcgtgctcccgctggtgaaggtgatggatgcttctccctttatggcttaaacggaagtagatttcttttttattatcgctgagctgtgttttgctgacgagccctttttcggtcagctttgcggtgatccttgagaccgtcgcttttgaaaattccatcttctcggaaatcgaggtgacgttgatcggttcgtggtcgccaatgcagctgatcgtatggatgtcagacatattgagtctcatttcagctccgaattcgcgctccatctttttcatttctgcggagatgcgctctttcatgacggtttcttgctgctcctgctgatgaatgagcctgatgtacaggtcaaatatttcttgtttggcgtgtgttaaatgttccatgcagaaaaccggctcctttaatcgattattctgctttgattataccattttgttacgcgtgaaacaaaatggttaaacagattgcagattaagcgtttccgcaccagcggcggattccatcggcaatcaattgctccgcgttttccagggattcgtccacagcccaggctatgtggccgtcggggcggatcagggctgcttttacgccattccattcaggccgtccgtcaatcgctttcagttgcatgagccggacatgaggcagtctggaaaattccttcggttcttttccgaatgctgctaataagaaacgtccatcgcggtgaaatgtgtaaagtcgtttgacagtaccatctgaaagggtcaggtcaatatcgggcaggcgtttaccgttcagctcatgttcaggcattttttcatctgcttcatactgcacgctgagcgctgcaatttgttctgccagatagcgattgacgtctgaaaatccgagtatgccggatagcaattcacggaggtacagcccttcacgcgtaaaatcaaacagctttgtttggatttgtgtattgacgatcagcgctttgccgacagggtgtctttcatgatggtaactgtcaagcagccagccgggacaccgtccgttgatctttgctgcgagcttccagccaaggttcatcgcatcttgaagcccgacatttaaaccttgcccacctgcgggaaaatgtatatgcgcggcatctccagctaaaaaaattctgccggaacggtaatgctccgccaacttgctggcatttccgaagcgggacatccaaaccgggctgttaattccaaagtccgtaccgcaaatgcggctgagttctttttttaattcttccagtgtgacgggctcgtgaagcaaagcttggggcatatgcggcgccgttatgaggacgcggaaaatgccgccgtctaaaggcacgatcacaacgccgccttcacggttcacgcaagtatagaaatgcgattccggcggattttcaagcgacacatcaccaagcattgcggtgatattcgcatcagttccggaaaaagcgatgcgcgcctgcttgcggatggtacttccggccccgtcggcaccgacgatataggaagcggttagtaaggacaggccgtccggaccctggacgacaagctcggcggtgtcttcatgctcgcggacagcgagaacttcatgaccgcgaaggatgcagacaccgagattcctcgcgtgttcctcaagcaccttctcagtttcgtactgggggatgaacagtgtaaaattggctcgcgtgtcaagcgcagaaaaatccaatccagtcttcagacctgcaaagtgccccgaaccgagcggcttgccaatttccttaaatcgttctccaagccccctcatttcaagtatttcgattgagcgaggatgcagtgtgagcgcttttgagaatggagaaggctcattcagccgttcgacaatacaggtccggacgccggccaaagccagctcggaagccgtcagcagaccgacggggccgccgcctgcaatcaatacatcaaaatccatgatcaatcactccttttttgttgcgtatgaaacaattttaaaatactacaaatgaaaatttttatcaactatattctattatttttgttacttatgtaacaaaaagagataaaaaaagcatggtgcttgtccatgcttttatgacttgatctgctctttatcttttctgtgcggatataacttaaaacggccggttttcatccggttttcggttttgattttaattctttcgctgcattcatggcacatataggtatgtatcggccggtttcggagacgtttggcaatgagtgtgtcgtcatcgattttttcgattttgtcacacaatgaacactttaccctcacttgattcacctcgcttacgatccattataccttaatcgatctgacaaataaattttctctattagaaaaaaggaaaaagcctataccgtcaagaaaacagtggcacaggctttttaaagttattgctgccgatttttcatatgtttgttcgattgattattctgcttcttttcgagttgtttttggtttctctcattcagctggtcgttgttggattttgtaggatttgtttgctggttgtctgttgcgtcgttcggcacttcaggaaggacgcgcccgacaatggctgccagctcatcgagaatccctttgacaggacgtcccgcttgaatttctctgcccattgcccgcaggcggtttacagtgtcgggatccgcgacaacggcggcgtttgctccataagggtcattctgcagagcttcagcgaccgaatacttaatggattcgactttgctgcgttccaaattgtctttcacatcaattccgacgacggcgagcctgcctagcacgacggcggtcgcatcattgacacccggaacgctttcggtgatctttacaaggcgccgtgagatggcttgtccgtcttcgcggttcaccggctcctgggcgctgttttttacatgaatcggtctgttgccgggaagctcatttgcttcatttcgggcattattttgaatgccgcaggctgaaagcagcataacggtttgaattaggatcaaaaaaaagattcgcacttgaggttgcctccttaaaaatgctttcattaatttttattgttgaattaaccttctatctttattcacaaaaacatatattttagcgggcgctccatcagcttttaacccaaatgaaaataaaaggctaaaaatcctgatcaggaggcggaagattgagtaaaatttatgtgctagatacgaatgtgttattgcaggatccgaattcaatcttttcttttgaagataacgaggtcgtcatcccggctgtcgtattggaggaagtcgattcaaagaaacgttacatggatgaaattgggaggaatgcaaggcgcgtatctaaattgatagatgatttgcgtttaaaaggaaagctgtatgaaaatgttcctctccctaacggaggaagcttgagaatcgagcttaaccatcgctcttttcagcagcttcaggaaatctttatcgaaaaaactagcgacaaccggattttagccgtagcgaaaaacctcagccttgaagaagaaacgaaagaaggcggcagaccggttattcttgtcagcaaagatatgctgatccgcgtcaaagccgatgccatcgggttgatgtcagaggattttttgcacgacagggttgtcgacaatgatgatatatacagcggttatacggacgtgtacattcgctcggatcagatgaattcattttttgaacatcattatttgcagcttgacgaaatcagcgaggagccgctgtgtccgaaccagtttgtcgtcatgaaggacgcgctcggcggatcatcttctgcggttggaatcgtagatcaaagcggaaaagccgttaaaaagcttgtttttgaccaggagcaggtttggggcatccgttcccgaaacgtacagcagacgatggcgttggaacttctattaagacaagatattccgcttgtcaccctgatcggaaaagccggcacaggaaaaacactgcttgcgctggcagccggattgctgcagacagaggatctggggaattttaaaaaacttgttgtcacaaggccgatcgttcctgtcggaaaagatctcggctatcttccgggtgaaaaagaagaaaaacttcgaccgtgggtccagcctatttttgataacctggaatacttgttcaatgcaaaaaaaccgggggaacttgatgatattttggcggggatgggctccattcaagtcgaagcccttacttatataaggggcagaagcattcccgaccaattcatcatcattgatgaggcccaaaatctgaccaagcatgaagtcaaaacgcttctgacacgcgtcggggaaggcagcaaaatcgtattgatgggagataccgaacagatcgatcatccttatttggatgcgatgaacaacggcctggcctatgtagtagagcgctttaaagatcaaaaaatttccggaaacgtgaagcttttaaaaggagagcgctcccggcttgcaaggcttgcagcagacctgctgtaaataaaaaaaacgggcttttaacccgggtttcaacttgcatggcacgccggccgggtcgtctgcaaaagccgaaaacccggccgggaaaagaagaggcggagttttttccccgcctccggcgcacccgttacagtgttgccgctttaaataatgtgaatttcttttactcgtttcacaggattcatcttgttagaaccgtcgggaaaataaacgtgtacaggcccgtcttcgccaagcggcttgcctttgttgctgaagcagagaatcatgccgcccgcttcttcaattggaacggaaacgtcttcaccttccgttttgaagaggcatttgacggcggagcctgacacctccgcgtttttcaaaaaaggctcaagcttgattccgaaagtgccgtcaagcaatttttccttttcatactttttctctgatttcagcgtcggcggcgatacagcaccttctctgatttgccgttcccggtcaatcacaaggtcgtcatcttcatcctgtacctctccgaaatgtgaaaagaactgctcgagatcgaattttcggtcatcaaaaatccagacgctcggatcgagcgtaatcggatactttacatttcctgtgatcgttacaatgctcatgtctctaccactccctcacaaaaaattataagcgctttctttcgaattgtcacttctcataacaaaagccctctcggggaaagataacagcaatgacgctcggatggagggaaaaaacttgaattgccggcataataaggagctcgaatattttgtcacagaagcgaaaaaagtgacggacaaaggaaaggttgcatcttacataccggctttggccgaattatcggaggacgatttatcggcggcggtctactttaccgacgggacttgtatatcagcgggggatgtggaaaaagcattcactctgcaaagcatatcaaaagtattgtcgcttgccctcgttctgatcgatcacggaccggaaaaagtgtttcattacgtaggacaagagccgactggcgatccgtttaactccatcatcaagcttgaaaccgtcaacccggggaagccgctgaatccgatgataaacgcaggagcattggtggtcacaagcatgattaaaggagagacgaacgctgataagatcgggagactgcttgattttattaaaaaacttgcaaacaaccggagcattaccgtttgcgggaaggtcgccgaatctgaatttgaaacctcgatggtcaacagggcgatgtgctattacatgaaagagcacggcatttttcaggctgaggttgaggatgttatggatgtatatacaaaacagtgcgccattgaaatgaacagcctggacctggcaaaaatcggctctgtttttgctttgaacggcaagcatcccgaaacgggagaacaaatcataccgaaggatatcgcgagaatttgcaagacatttatggtgacatgcggaatgtataatgccagcggcgaattcgcaatcaaaatcggaattcccgccaaaagcggggtttcagggggcatcatggggctatccccataccgtttcggcatcggcatcttcgggccttcgctcgatgaaaagggaaacagcattgccggaatccggcttttagagctattatctgcgaattacagcttaagcattttttaaaacgttagcggaagcttaaaaagcgagtctttgaaatacggcgaaaggacagaaatagcttgctttttttcggctgaggctttatcataaatagaagaattaggtactcgcctggggaacggagggatacttttggcgtctgagattgtagtcgaccatcgtgaaaaagcacttgctctgttaaaacgtgatgctgataaaatcttaaagctgattcaagtgcaaatggacaacttaacgatgcctcaatgtcctctttatgaagaggttttagatacacaaatgttcggactctctagagaaattgattttgctgtccgccttggattagtggatgaagaagagggtaaagaactgctttacaggctggagcgtgaattgtctgcattacatgatgcatttacaaaaaaataaaagaacacctcagcagaatctttctgtctgagtcagcttgtcgacaacgtttcgatagaaacaaactgccggcaggctttttttattatggaatgagaaagaaaacgccagttgatgaaggaatggccgctgttcacgccgaataaacgaagacgcatgatttgccgataaaaaaatagaatggcagtcttggaacagacggacttttctttctgaggagattcgaagtcttatgaaaagggtatctttcgtgcttttttaagaaagtgtagtaaaataacgaaggaactaccacaaacacattttgaaggcaagtaaggaagaggataatatgataaaaagaatgctcaaatcctatgattattcattaatcttcgctgtattcctgctgtgcgggttcgggctcgtcatggtgtacagttcaagcatgatcacggccgtgacaaggtacggacaaaacagcagctacttttttgacaggcagctgatgtttttggcgctcggaaccgtcatatttttatgcgcggcgctttttccgtataaggcttttgccaatcaaaaattccaaaagtttttgctgctcatttccgtcgtcgctttgttcgggctgtttgttgtcggacatgtggccgggaatgcccaaagctggttcagggtttcgaattacggcatccagccgggggagtttgtcaagctgaccgtcatcttgtatctttcttccgtctacgccaaaaagcaaagctatattgacaacttgggagccggaatcgcccctcctgcgatcatcacgctcttcatttgcgccttggtcgctgctcagccggatgtgggaacggcctttatcatcgctttaatcgcattgtgcatcattttgtgctcgggattcagcggcaaaacgctgttaaagctcgtgcttttggccgggattgtccttgtgctcgtcagcccgctcatttatttcaactgggacagcattttaacagaaggacggatgaagcggtttgaaagctatcaaaacccgtttaaagatgcgggagattcgggctttcaagtcgtcaactcctacttggcgatcggttccgggggactgttcggcctgggcctcggcgagagcgtccagaagtatgggtatctgcctgaaacgcacaccgattttattatggcgatcatcgccgaggagctcggtattttcggtgtcctttttgtcgtgctgctgctttctttcatcgttttaaaagggttttatatagcgaggaaatgcgatgatccgtttggaagcctgctcgcgatcggcatatcgagcatgatcgccatccagtctttcgtgaacctgggcggcatatccggcttgattcctttgacaggggtgacgcttccgtttatcagctacggagggtcatcgctcattctgctgatggcaagcgcggggatattggtgaacatcagcatgtttaatgaatattttgatcggttcaaacgaaaacagcctgtcaatactacaaaaacgaaagaaaatcaatataaaaaaagtataaatttttaaaaaactaagcgtgtacaatgaccatccgattcatttagaatagatacatacttataacagcggatgagggggaacgacatgtcacaacagtctattcaaaaagttcttgttgcaaacagaggggaaatcgctatccgcgtatttcgggcctgcacagaactgaatatccgtacggtagcgatctattctaaagaagacagcggatcttaccacagatacaaagccgatgaagcatacctggtcggcgaagggaaaaagccgattgacgcttatcttgatattgaaggcatcatcgagattgcaaaacgcaaccatgtggatgccatccatccaggctacggcttcctgtcggaaaacattcagtttgctaagcggtgtgaagaggaaggcatcatctttatcggaccgacctccgagcacctcgatatgtttggagacaaagtaaaagcccgcgaacaagctgaaaaagctggaattccggtcataccggggagcgacggaccagtggcggatatagcggaagtgaaacaatttgcggaaaagttcggatatccgtttatcattaaagcgtcgcttggcggcggcgggcgcggcatgcggatcgtcagggacgaatcggagctggtggagtcctataatagggcgaaatcagaggcgaaagcggcctttggcaatgatgaagtttatgtcgaaaagctgattgaaaagccgaagcacattgaagttcaagtcatcggagataaagaagggaacgtggttcacctttacgaccgcgactgctctgtgcaaaggcgtcatcaaaaggtcatcgaagtggcgccgagcgtttcgctttctgaatccctccgggaaaagatttgcgatgctgccgttaagcttgcgaagaatgttgaatatgtcaatgccggtacagtcgaatttttagttgcgaacgatgagtttttctttattgaagtgaacccgcgtgttcaggtggagcataccattacggaaatggtaacgggcgtcgatatcgttcagacgcaaatcctgatcgctgccggtctcagtctggacagcagcgaaatcagcattccgaaccaggatgcgatcacgctgcacggatatgcgatccagtcaagggttacgactgaagatccgtcaaacaatttcatgcctgacacaggcaaaatcatggcatatcgctcaggcggcggtttcggggtgaggcttgataccggaaacagttttcagggcgctgtcattacgccttattacgattcgctgcttgttaagctttcaacttgggcgctgacgtttgaacaggcggcagccaaaatggtccgcaaccttcaggaattcaggatcaggggaatcaaaacgaacattcctttccttgaaaatgtggcgaaacacgaaaagtttcttacagggcaatacgacacgtcttttatcgatacaacgccagaactttttgtctttcctaagcagagagaccgcggaacgaaaatgctgacatatatcgggaacgtaacggtcaacggcttcccgggcatcgataaaaagaagaagcccgagtttgataagccgcagatcgtcaaaacagatgtcgatcagccaatcgcaagcggaacaaaacagattcttgatgaacgcggagccgaagggctcgtcaaatgggtgaaagatcaagaggaagtgctcctcactgatacgacgttccgcgacgcccatcagtcattgcttgcgacaagagtcagaacgcatgacctgaaaaaaatcgccaatccgacggctgcgctctggccagagcttttcagtcttgaaatgtggggcggcgccacatttgatgtcgcttaccgtttcttgaaagaagatccgtggaaaaggctcgaggagctgcggaaggaaattccgaatacgatgtttcaaatgcttttgagatcttcgaatgccgtcgggtatacaaactaccctgacaacctgattaaaaagttcgtcagcgaatcggctgcggccggaatcgatgtattccgcatttttgacagcttgaactgggttaaagggatgacgctcgccattgatgcagtgcgcgagtcaggcaagcttgccgaagcggcgatctgctatacaggggacattctcgatccgaacagaagcaagtataatcttgaatattatacgtcaatggcaaaagagcttgaagctgcgggggcgcatattctcggcattaaagatatggccggcctgctgagacctcaagcggcatacgaactggtgtcggctttgaaagagacgatcgacattccgatccacttgcatacacacgacacgagcggcaacggtatttttatgtatgcgaaggcgatagaagcaggcgtcgacatcgtcgacgtagcggtcagctcgatggcgggtctgacatcacagccaagcgcaagctcgctttaccatgcgcttgaaggagataaacgccgtccgcagttcaatgtcgatgcggaagagtcgttgtctcaaaaaaaaaagtctgtcagaaaatattacagcgagtttgagagcggcatgattgcgcctcataccgaaatttacaagcatgaaatgcctggcggccaatacagcaaccttcagcagcaggctaagggagtcggcctcggcgaccgctggaatgaagtgaaagaaatgtacagccgggtcaaccacctgttcggggacatcgtaaaggttacgccgtcatctaaagtcgtcggggatatggcgctttacatggtgcaaaataacctgacggaagatgatatttacgaaaggggagaatctctcgattttcctgactcggttgtcgagctttttaaagggtatatcggtcagcctcacggcggattccctgagaaattgcaaaagctgattttaaaagggcaggagccgattacagtacgccctggagaactgcttgaaccggtttcatttgacgctataaaagcggaattcttggaaaagcatggtatggagctttccgaccaggatgctgttgcatatgcgctttatccgaaagtgtttaccgagtatgtcaagacagcggaactgtacggggatatctctgtgcttgatacaccaaccttcctctacggcatgaccctcggcgaagaaatcgaggtcgagattgaaagagggaaaacgctgatcgtcaaacttgtctctatcggggaaccgcgtccggatgcgacgagagtcgtttattttgaactgaacggccagcctcgcgaagtggtcattaaagacgaaagcattaaatcgtccgttcatcaaaaggtgaaagccgaccgttcaaacccgaatcatatcgcggcatctatgccgggaacggtaatcaagcttcttgtaagcaaaggggaccaagtgaagaagggcgatcatttgatgatcaatgaagcgatgaaaatggaaacgaccgttcaggctccgttttcaggaactgttgaaaacattcacgttacaaacggagaagccattcaaaccggcgaccttctcattgaactgaaaaaataaaagcacggccgctgacttttgtcggcggcctctttttatgaaaaaatcccccgcaaaaggcggaggatcaaccgtttatttttatttttgcacctgcctgcgatagcgcgcaacaagcagcaggaagtagcaaaggattccgaacaggcaggaaataaagaatgcgtgggcgagtgcaaaacccaaatccagtctgctgtagacaaccgcaattcctgaggcagcctgaaggatgatcaggatcagggaaatcatccagccccaataaatgcgtttttgatttttatactgtcttgctgcatgtaccgctgccgcgatgatccaggcgaacagaagaagcgccgcagctctgtgtcccatctgcacccattcgtgaaacttcccgggaagccagccgttttccgtgctgcacatcggaaagtcaaggcacgcgaggcttgaactcgtatgccggacatatgcgcctgtataaacgacgacatatgtgtatataatgattcctatcatatgaaactgcatggtttttcctatataaaacgattcggatttctgtttgctgtcagcttcaaacaccaggagcgtcaaaagcagcacagaagcaaaggaaataagcgagattccgaagtgcaaagccatgatcagggccgatgacccgaagacgaccgctgcagcgcccaaaagcgcctgaagaatgagaaagacgaccgacatcaccgcgagaaatttcgtttctctgatatggccgatttttttccatgtccaaatggcgagagccagcacaaggacgccggatgtgccgctgacaaacctgtggctccattcgataatcgattcaagggttaaagccgggaatatgcttccgttgcaaagcggccaagatctgccgcagcccattcctgaacccgtctttgtgacgagggcgccgccgatcagcacgaaaagcatggcgatagttgtgataattcccaagccttttaatgctttattcataaattcaattctcctttttaatgcaaactgactaataaaaagatatttaccaccttcaagtgtaagcgaattgatgttctgctgcaattcataatgattattgttcacaaaaatgcaatagaaggcgttcacatttttattggttttgaagacttgataattgtggcttcgtttgatagaactatattagaatgacagtggttttccgctcttgttcacaacttttccttcatctgtaaagaaagtcataaaaagttcacaaatataaaccggtttgtcgattaatatttaataggctgtttttttccatccggtaatcttgtatgatagagttgtaggttttttatgaatataccgcttctcttgacgtgatgaaggtttgagtaaggggggttagtattatggctgaaacaagaattacagctgatacagcaatgaatggacaaatagaagagacgacagcatggaaagatttcctcgcccttatcaaagtcgggattgtttactcgaacctgataacaacttttacgggcatgtggctcgctttttacttttcaaatctgagctttctaggaaaccttgatatcgtgctgttcactttagcggggtcctcgcttattattgcaggctcatgcgtcatcaacaacttttatgaccgtgatattgaccagctcatgcagcggacgagaacaaggccgacggtgactggaaaaatccagccttcacaggcattgtggttcggcattctgctgactgcgctcggttttatcatgctgctgatgaccaatctgacagctgccggagtaggatttgtcggcgtctttacgtacgtgtttctatacacgatgtggtcaaagcgccgctataccgttaatacgatcatcggaagtgtgtcaggggctgttccacctttgatcggatggaccgctgtccaaggttccatcggagtcgaggcgtgggtgctgtttttaattatgtttatttggcagattccccactttctggcgcttgcgattaagaaaacggaggaatacagagccgcaaatataccgatgctgcctgttgtacacggttttgaagtgacgaaaaggcagatcatcatttggattgcctgcttaatgccgctgccgtttttcctgggcggactcggactgccgatcgtcattttggggacggtgcttaatatcggctggctcgtttgcggtctggtcggttacagaagcaaaaatatcatgaagtgggcaacgctcatgtttgtatattcattaaattacttgaccattttcttcgttgccatggtcgtatttacactttttaaaattggatagaactctataattcatcacattgaaggctgtcaattaacacttcaagcagacaacaatcatgtaaaagccgccttatcgattttttcgattatgtttaacaaggcggctttacgttcatacatagatggtattttgagtaaaaaacctcattatttatgaaatgaggaaatgtaagtgctttaattggagtggggagtcagatgaatgaataggtgtcctataaacgtttgaacagtgaaagtttcaaaaggattgattgaaaaggggttgggaagaaatgttaaagaaatggcgtctgatgtcgctgttcactattttggcgcttgttttagcagggtgcggagaaccgtttatatcaacgctgcagccggcgggcgaggtggctgatcagcagtatttcctaatgattctcagcacgctgatcatggttgttgttgtagtagtggtaagtttcattttcgtatttgtcatcgtcaagtacagaagatctaagctcggtgatgaccacatcccgaaacaggttgaaggaaaccgcaatttagaaattttatggactgttattccgattatcctccttcttatcctggttgttcctgttgtcgcacagacctttgatcttgctgatacgaaaccgatggataagaaaaacagggatccggagaagacgctcgtcgtcaacgtgcgggcgaacctttactggtgggaattcgaatatcctgactacggcgtgattacgagccaggagctggtcgtgccgaccgatgaacgcatttacttcaagctgaaagcttccgatgtcaaacattcattctggattccttctgtcgggggcaaggttgatacgaacacagacaatgaaaacaagttctacttaacgattgattcaaaacgggcggaaaaagccggagactatttctacgggaaatgcgccgagctctgcggaccttcccacgctttaatggactttaaagttaaagcggtttcgaaggatgagttcaagaaatggatgagcgatatggaaaacaataaagcggaagcgaaaaccgatctcgctgttgaaggagaaaaggtgttcaaagagaaaaactgcctgagctgtcatgcgaccgattcaaaagaccaaagggcggaagcggccagaacggctccgaacctcgcgacttttggagacaggtcgacgatcgccggcgtgaaggaattcaacgatgaaaacttgaaagcgtggctcaaggatcctgaaagcataaaaccgggcaacaaaatgaccggcacataccctgatttgagcgacaaggaacttgatgcactgactgaatatttaaaggggttaaaaaccgaagactaacgcttcaaagggagaatgagggaggttacattgtgagtacgcttaagaaaaagcaaggttttggggctgtattatgggactatttaacgactgtcgatcataaaaagattgccatcctttatttgctgggcggcgggttcttctttgtgctcggcggaatcgaagcgatgctgatcagggttcagctgatgataccgaacaatgacatcatgagcggcggggtctacaatgaaatcatgacgatgcacggcacaacgatgattttcctggcggcgatgccgctgttgttcgcattgatgaacgccgtcgttccgctgcagataggcgcgcgggatgtcgcgtttccattcttgaactcgctcggcttctggctgtttcttttcggcggcatctttctgaatttaagctggtttttgggaggggcacccgatgccggctggacgtcttatgcgtcgctttcccttcattccgaagggcacgggatcgatttctatgttctcggtctgcaaattgccgggatcggtacgctgattgccgggattaactttctcgcgacgatcatcaacatgagggcgccgggcatgacatacatgaggctgccgcttttcacatggacgacattcgtcgcttcggctttgattttgttcgcgtttccgccgctgaccgtaggcattgcgctcttgatgctggaccggttgttcggaacgagctttttcaatccggaattaggcggaaatacgatcatttgggagcatctgttctggattttcggacaccctgaagtttatattctcgtactcccggcgttcggcattttttcggaaatcattccggtttttgcgagaaaaaggctgttcggctattcttcaatggtatttgcaaccgtattgatcggctttttaggcttcatggtttgggctcaccatatgtttacaacgggactcgggcctgtggcaaacgccatttttgcggtggcgacgatggccattgccgtcccgactggtattaaaatcttcaactggctgctcacggcgtggggcgggagcatcaagtttacaacgccgatgctttacgcgatatcctttatcccgacgtttgttatgggcggggtgacaggcgtcatgcttgctgccgcaccggctgactatcagttccatgacacgtactttgtcgtggcccacttccattacgtcatcatcggcggagtggtgttcgccatcctcgccggagctcattactggtggccgaaaatgttcgggaaaatgctgagcgaagcgttgggcaaaataacgtttgtactctttttcatcgggttccacctgacgttcttcatccagcattggctcggattgtggggaatgccgagacgcgtgttcacatacttgccgaatcagggatttgacatggcgaacctgatcagttcaatcggagctgtgtttatggcggctgcggtcatcatactcgtgatcaatattatcgtgacgactgccaaaggggaaaaagtcggcagcgatccttggcatgacggaagaacgcttgagtgggccgtttcttcgccgcctcctgaatacaacttcaaacagctgcctttggtcagaggccttgatgctttatggatcgaaaaaagagccggcaagcagtcaatgaccgccgcggagccgcttcaggacatccatatgccaaacggatcgattcttccgttcatcatgtcactcgggctgtttatatccgccttcggctttatgtaccggacggaatttgcctgggggctgcctgtcattctgatcgggttagggatcacgttatttatgatgcttctccggtctgtaattgatgaccacgggtaccatattcataaagaagatctgatggatgatgacgacaaaggggtgaaggcataatgcatacagaagagaaattgacggctgaaaccttcccggcttctcctgaaaaagctacgttagaaggaaaaaataaatttatcggcttttggctatttctcgggggagagacggttcttttcgcgtctctcttcgcaacataccttgcgctgaagaattcgaatgcaggggggccgaaaacgaccgagatgttcgacatggggctggtctttcttgcgacaatgctccttttgacgagcagtttgacgagcgtgtatgcgatgtatcatatgaaaaacttcgcttttaaaaagatgcaggtttggctcggaatcaccgttctgctcggtgcaggctttctggcgcttgaaatatatgagttcacgcattacattcacgaatatgggttcaccattcaaagctcggctctcggctccgctttttatacgcttgtcggcacacacggagcacacgttaccttcgggcttctctggattctttctttgatgatcagaaatgcgggccgcggattaagcctttacaacgcgccgaagttttttgtcgcaagcctctactggcattttatcgacgttgtctgggtgtttatctttaccgttgtatacttgatggggatggtgggataaaaatggtgaataacgaaaacagagggaatcccaaaacagatcttgcctaccgcaaaaagaaaaacgcggaggacatgagatatcaggttatttcattcggtttgatgatcggcctgaccattgtcgcttttttaacggtcgcctcagatgccggcgtatggtttacggtgccgtttattctgctgctcgccgtcattcaggttgcgtttcagctgtattactttatgcatatgagtcagcgggggcatgaagcgccgactttgttcctttattcgggcgttttggtcgcttttgttaccgtgttggcttttgtaacgctaatctggtggtaatcgaaccgacatacagaaaggaggatgctcatgttgggcagccttgaaatattcggttttcgcgccctttggagcccctatttcctaggggctgtcgttttcataaccgccctttacttttttctgatgaaacgcttaggatcagaaggagagcgggcgtccaggaaagaaatcggtttattcctgacggcgatgattcttttatacgcgtctaagggcagtccggttgatttgctgggacatattatgttcagcgcgcatatggcgcaaatggcggttctgtatttgatcgtgccgcctctgatcatccttggcataccgccttggttttggaaaaaggtcatttttctgccgatcgtcaagccgctgttccggtttttttccaaaccattgatcgcgataatcgtgtttaacggtctattttcgatgtatcacattccattggtgtttgattttataaagacggatgccgtttatcatgccgccattaccgtgctgatctttattgcagcgtttttcatgtggtggccgctcgttcacaaggtcgaggagcttccgcagatgagcggacttttgaaactcggctacattatggctgacggcattttgctgacaccggcgtgcgcgttaatcatgttcagcgatacggctctgtattcgacatattcggatccgtcagcatgggcggaggcaatgaagctgtgcgttcctctcgatacgctgagcggaatgacgcttacaggtccggaaatgttcagcagcatgcctgttctcgaagatcagcagcttggcgcgattgtcatgaaaatcctacaggaaatcgtgtacgggacatttttggcgattatctttttcggctgggcgaggaaggaaagagccaaagacgaaaaggacctggaagaagaatcatattctccgtctacggttcattaaggtcaaaaaagggtacagcctcaccgaggggctgcacccttttttatgtacgcctgctacacttcaagcgctgaaaccttttctttgatcgaattcagcaccgtcttgcttgttttgaggagctgcggcggaaaatgttcgtcttcgccgtattccactccatgcggataataatatttgcccaaaagcggcgtcatcagtttgattaccgcgcgccgggcgcccacgtcaccttcgatggcatatccgaacacgcgaaggtagaatcttccttcgaccatatcgaatttgcggtcatatgtgacgcgttcataatcccattgtccagctcttacgaacccttcgttttccatgatgtcgtctaaccggttaaggtcggcagtcaatccttcaattccggattcttcaaatttcatcccgtaaaacccccttaaaaaaattacctttactgacaatcatagtatgaaagcgttaaactttcaatcctgcctgagccgatatataaatatttttgtggacagtatgaatcgcgcgcggcttgacgacaatatgaacaaacgaacgacaagaggaggtcttctgattgacacgtgtgaaagatatcatgacaaaggaaacattatattgtacggttcttgataatgtatacgaggctgccgtgaaaatgaaagacggggatgtgggagcgattccggttgtgcttgatgacggcttggaactggttgggatcgtcactgaccgggatttagtgctgcggggaatcgcagctaaaaaaccgaattcgcaaaaaattacaaatgtcatgacgactgatctcattacggtaagtgaagacgattcaattgaaaaagcggtcgatctcatgggagattatcagatcagaagggtcccggttacacggggaaaaacgcttgccggcatcattacgctcggcgatgtttcaactcacaataaatcgaaccgccaggctggcgacgcgctgacatttatatctgaaaacgaagagcggcctggagattttcttcattaaaacatattttgtctcacatcttaataggctgtattaacattgaaaattcatgtcagttctgtttaaatgacactaaaggcaagtttttgatgcgtgcgcagcttaatggatagattgatccgtcagtcggaggtgaaagtttgaaaaatatattaagagcggtcgtgatccttctcatcgttgcggcttcatacacgctgtttattcaatacggctcaacgcctgagaaaattgcgaaggaagacaagccgcaagtctcaaacgaagatgcaaaaaaagagaagcccttgaacattcccgattccggcctgctttcctttatcggggaatcggccgagacgatcgaaaagaaactggggaaaccggacagagtcgatccttcagcgtatgattatgaatggtgggtctataaccaagggaaaaaacagtacgttcaaatcggcttgctgggcggcaaggctgtgacattgtttgcgacaggcgacggggtgaacaccgctccgtttaaaatcggacggccgtcaagggaagttttcaaaacgacccagatcgccccgtatgtcaatgttcaatataaaggcagttcataccgttttgagttttccgaggaagatatgaatacaaggccgacggttaaagtcggagacatctatgttcagctgtacatggataaattcgaggggacgctttcaagcatcagggcatttgatgcgccgactttaatcaagcaaaggccgtatgaagttgtctacagaggcaccctgatcgagcctaaagcattgacagaatcggattggaagaaaatcgagaaagcaaatgagaagcagatttttgatataacaaacgttatccgcgcaaggcacggcctgtctgagctcacttgggatgaaggcgtatcaaaagtggcttacggccacagcagcgacatgaaagagcaccattacttctcccatgtgtcagaaacggaaggcaccctcaaagacaggcttgaaaaaggaaaagtcaattttgagcaggcgggggaaaatatcgcgctcaactatgtcgacgggcctgcggcggttgaaggctggttaaacagcgaagggcacagaaaagcgctcttaaatgccgactatacccatctcggcgtcggggtggatgagaaatattatacgcaaaactttattaaagaatggcaatagagcccgggacaatacccgggcttttcgttttttgagaaatcctgaaatgtcggctgctcaccgttcctgtaaaaagaggaattttaggcgaacattttttgccggggcggattacactatagtaggcatatgttttcggagggggtgtagacgttggcaaatcaaaacgcgcaatcatccatcaatgaatttaagcaatttataaaacggcatcctaagttgatttccgaagtccggaaacaagaaaaaagctggcaggaagtctatgaaaactgggttttgctcggggaagacgattcgatatgggatccgtacagggaagaagcttcagcggaaaaggagccggacgctggcggcaaaaacgatttcatttcgaaaatggtgacggccgttcgaaagatggatgccaatcaaatgaatgagcagatcaataaaatgagccagtctatttcttcgctgcaaagcttgctcagccagttttcgggcggaagccaaaaacagcagaaacaaagcggcggcgagcatccgttttctttccgaaaagattagggaaggagaaagacatgcgtaaagaagtgcaggagtatgtgttcgccgacgaagagcgccgccggttcatccgtgagcagccggtctggtaccgcaagctttcgcggaatccgaatgatctgtcagcctttcatctcgatatgatgaatttttatgaaaaaacgattcctcacagggtcaaccagttatcgggcagcattcagatggcccagatgatgctgcaaatgtttcatgcgatgcgcactcaggattaatttaagcctgagtctttttttgtgatgataaatcgcgccattctggtaaagctaggtgtgaaggagttgatctgtgatgaagaagtgctggcttgtaatctttctgtgcctcttgctggccggctgcgccacccataaaccaaagcccaaaggcttatctgattggcgcgattccgcttgtgaaagcgaagtttttggaaaattatagttcggaggcggcatagacatttttgaaaacggctgttttgtgatacactatagctggaggtgcatgtctatgtttgccacaatggaatcgttgcggcttcaaaatgaagcatatgatttggccaacatgattcttcaatcagaggcggctgaacattacagaaaatgctacaagcgtctccgcgaagatgaagaggccggacgtattatcgcttcgtttacgaaaataaaagaacagtacgaggatgtgcagcgctttggcaagtatcatcctgattataaagagatatccaagaaaatgagggaaatcaaacgggagcttgaccttcacgatacagtagccgaatttaaaaaggcggaaaccgagctgcaatccattcttgatgaagtcagcgtggaaatcggtcatgctgtgtcaaaacatatcaaagtaccgactggaaacccttattttgataatctttcatcttgcggcggcggctgcgggtcaggcggaagctgcggctgtaaagtttcctgatgaggctcggtcgccccgagtctcgtttttttatagaacttcatgcacagagcgacaggcaggtgaacaatttggaaatcaggcgtcaaggtttaatcgtttggctgcactccttgaagcaggcgaaaatgctcaggaaattcggaaatgttcattacgtttcaaagcggctgaaatatgtagtggtgtattgcaatatggaagatgccgaaagaatcatcgcaaaaatacgttcgtactcttttgtcaaacaggtggatctttcatacaaaccgtttttgaaaatggagtttgaatccaagcaggataaagcgaaagaatacgactataaagccgggctctaacttggtttatgttaaaaaaatccccgcagaagtacctctgcggggtccttctattccttaaaaaattaaggagaaggcaaagggagaggagaaaccggaggaagaacttatggggaaacgtaagtcttctccgcggttggcaacaacatcaatcgatgctgttgctattattatcaccaccgagcctttttgctatacatatgaatttgcactttgggtgtttgtgccagaaaacactttatgataagataggaatgatttttttcgagttttaagaaaaagtggtggaagtatgagagtgatttctgggacgtataagggacgtgccttaaaggcggttcccggcacgtcgacaaggccgacgaccgataaagtaaaggaatccatctttaatatggtcggcccgtattttgaaggcggcaccggccttgatctgtacgcgggaagcggcggattgggcattgaagcgctgtcgcggggatttgaccgcttcatttttgtcgaccgggattttaaagcgattcaaaccgtgaaaggaaatttgaaaacgctgggcttagaaaagtgcgccgaagtgtacagaaatgacgcagaacgggctctgcatgcactggtgaaaaggggcgcaagctttgatgccgtctttttggacccgccatatcgagagcaaaagctggaagcgcttttatcgatcattgatgaagcggatatgctgactgaaagagggtttattgtggctgagcatgcgaaggaagtcatgctgccggatgcggcgggcggacttcagcttgcccggcaggaaatatacggcttaacaggcgtgaccatatacagaaagagagggaatggggatggctagcattgccgtttgtcccggaagttttgatccggtgacttttggacatttggatatcatcaggcgcggggcgaaagtgtttgataaagtttatgtatgcgttttgaacaattcttcgaagaagccgctgtttacagtggaagaacgctgtgggctgcttcgcgaagtgacgcaggatatcccgaatgtgcaagtggaatcttttcaggggcttttgattgattatgcaaagagcaagcaggcaaacgtcatcctgcgggggcttagagcggtatctgactttgaatacgagatgcagggaacctcgatgaacaaagtgctcgatgaaaatattgaaacgttttttatgatgacgaataaccaatactcgttcctcagttcaagcattgtcaaagaagtggcaaaatataaaggttcagtcgcagaactcgtgccggaagcggtcgaggctgcacttgaaaaaaagtttgcaaaaaatgagcggccgtaaccggctgctcattttttaacaggggcgtaagatttggcataaagaatgatatagatgagaagggtgccgattgttaggagcggaccgatctctgctaaagtgttccacatctccagaaagaaaggttccgtcttcccggccgtcagaaaggagaagaccggctccgtcggagaatagaacgatgtgtaaagaggcttccaaagaataagaacaaagatcgctgcataaattccctggaggatgcgagcgataaaaaacggctaaagcggatatccgtttcagcaagaatgcctgcaacctgcgcttggacgcagaagccgctgaaacccaaaataaagctgacgatcaccgcttgctggagaagcgccgcatccgttgcgctgaccagtttgctgccgagcgtaatctcaaacaatcccgataataaaggcttatcaaaatcaccgggcaattgaagagccgtcaaaatcattcttgtcgcgtgcgaaagaatgtcggtgatgtgcatcacagaaagaatgttattaaaaaccgaaaaaagaatgatgaagccgcccaccattagcagcgtttgaacggaggagatgacagcatcgctcaaaagtttgccgagcggccgcttttcttcaagtcttgcctgatggagcgcttttaaggcttctttaattgaaggcacaggaagcttctttcgcacggcggtgcggttttcttcttttcttccgtaagtgcgcatcgtcagtccaactgcgaaattgcccaaataatgggccgccgcaagcacaacgccaagagaaggattatggaaaaagccgaccgcaacggctccgaaaataaacagcgggttagatgagttggtgaatgaagcgagccgctctgcttcgacccgggaaatctgccgttcctgtctcagccttgaagtcagttttgcgccggccgggtttcccgatgccattcccattgcgagcacgaaccctccgacgccgggtacgcggaacaccggtctcatgaaaggctcgagcaacagcccgacaaacctgacgacaccaaacccgatcaagagctctgataaaataaaaaaaggcaaaagggaagggaatacgacctcccaccacatggcaagtccacttttagaagcgtcaaatgattcttgcgggtgggtaatgacggcggctgtaaatgaaagcagcaaaacggcaatcatgagtgtctttacctttgacatgtccatttctaaccccctttgcggctgtgaatacacattggaaacaggatcatgataaaataaacgaaaagcttgcccgatttgtgcggtagccttctccgtgaaacttctttatcattatacgaaggctggtccttattttagaccaccagattgcagatcggcgatgaaacaaatgaaccggaagctctttaaacgcgcggaaacccttctccttgatgagcatcaaaagaaggcatttcatacatctgtgaattcatgcaggctgaaaattcgaagccggatcaagatgtgagccggtgaaaataaagatggagggttacattttcatgctgaaaaaaagaattatacgcatcgcactattgctcgttatcatcgtggccgcgctgtcatttgtgaagctgccatattacatcaccgaacctggcgaagcgaccgagctgaaccctttaattaaagtcgataacggctatcctgaaaaagggagcttttctttaatgacagttaaagtcggtcctgccaatccgcttacatatatatgggcaaaaatgcgcccttaccacgaaattcttccggaagaaaattttaaacaagaaggcgaatctgatcaggaatatatgaagcgccaactgcaaatgatgagagattcccaggaaaatgcgatgatcgccgcttataagcgggccggaaaagaagtcagctacacgtttaacggcgtatatgccatgtcggtcgtcagcggcatgcctgcagaagggaaaatacaagtcggggacaaaattaaaaaagcggacggaaaatcgttccggtcagcggagagcttcgtccgctacatcgagtcaaaaaaagccggggaccgcgtgaaaatcgtagttgaacgggataaagaagaaaaaacatatgagatgaagctgaaaacattcaaagaagatccaaagagagcggggctcggcgtctccctcatcacagaccgcaatgtcaaggtgaagccggaggtcgatatggatattgaaaacatcggcggcccttcggcagggctgatgatgtcaatggagatctataaccagctgacaaaagaagacgagacgaaaggacaccatattgctggaaccggaacgatcgacgacgaaggcaaagtcggtccgatcggcggcatcagccagaaagtcgttgcggcagacaaggcgggagccgacatcttttttgccccgaacgaaggcggaaaaaaaggatcaaactatgaagaagctgtaaaaacggcaaaagatattaaaaccgatatgaaaatcgtccctgtcgacacgatggatgatgcgattcattatttggaagataaagtgaaaaacacctgatgtccatcaggtgtttttatttgcgcaaaaatatccggctgtcttcgtcatacctgatcggcgaaagggaatattcctgctctgtcagcatcgtccgcaccggctctttgagcggggcgctgtatacttggcccgcttttatgtcaagctggagggaaggatgggaaaacgatcccgtctttgtaataaggggtgcgctcaagctttttttcttttcagccaaataggcctgccctttttttgtcattccgagaagtctgatatatgccggatgtgtttcgtttaacatgcgcttaacgtcggctttcttcgtttttgtgaggatatgggtgttcatgcgctgcagtcttgtccacgtatagcgcttcgttttcaaaagctccatgtattccttaaaagagcctgctttccggatcgcttttttgacgcggtgctcaaggccttcttccacttcgtatatccctttcagctcttctgtatccattgtatgcaggctgtatttcaaaaaggggaaataatcttcaggcgagtgccacatgccgaaagtccgggcgtattcatcgagctcatcgaccgttgtctttggaaggtagaagcggctgtccgcaaggcttcccgtttcaaaaatcgacttgcgtatgctcgtagcgcttgcgattcggtccgcttcagggaatgttgaatcgtgatagcctgaggaccggcgcttgacggtttcgggcttcatgcttaattgcttttgcatgatggctttcacataatggaatccgagaatgttgttcggctttgaaaggtcaacgatgttaccgccttctcttgttacagaccggaacgcttttgccatcgcttgcgggtagctcagcccaaacgctatctgctttctggcttcttcgttgagcctgtcttcgtgctctatcgtgtgtgcggctgtattgagaaatgcctcaatatcgccgtgctcgcttccgaaaaacaaagaagaacaccctaattcatttaaaatcgagacggcgccttcagcaaacgtttccgctttttggacggcgaatatgtaagggagttcaacgacgacatcggcaaaagatgcgagcgccatcttcgtacgcgcccactttgatacgatggcgggttcgccgcgctgcaaaaaggagccgctcataacggcaaccgccacctcgctccgcgtttctgattttgcttcctttatatgatataaatgtccgttatgaaaaggattgtattccacaacaaggccgaccgctttcattttttcacctctcttgcatctcttgaaatagttatgatacatttacacatggaatgtccagacgcctcgcgaaaacagcgtttttcctaagtgtatgaattgttgttcacgatgtcaacgaatgaaaggcgcaggcgcatatctgtaaagaaaaaatattgacaaaaaacatgatgaaagctataatcatgtttgttgctcacttagaggtgatacaatgaaatggacgatacatcagctgaatcaaatgccgaagaaggactttgaatttgatgaaacagttgatttaagcgaactctctcaaagctcggaaatccgcagcatttcaccggtgcgggtgaaagggcgcgcggaaatccgctcaaagcaggctgcatttgattttaccatttcaggcgagatgatcttgccttgctcaagaacgcttgttgatgttcgttatccattcagcatttctacaaaagaactgtttatatttcataagaccgaggaaatggaagatgaagacatccatattgttgaagatgacctcatcgacttgactccggtcgtgaaagaagaaatccttcttgagatccctatgcaaatcttttgtgagtctgttcaaaaagaagaaggtgctccgcaggagggcaaggattggcaggtcattacagaagatgaccggaaagaccggatcgatccgagacttgccggactcgggaagctcttaaaacaagaagatgaatcttaacgctctttaaggaggtgggaataatggctgtaccttttagaagaacttctaaaacgaaaaaaagacttcgtcgtacacactttaaattgcaagtgcctggtatggtagaatgcccaaactgcggtgagatgaaactttcacaccgcgtctgcaaagcatgtggatcatacaaaggaaaagacgtaaaaagcaactaatcgtcaacaatgaaaacacaagacttcatgtcttgtgtttttttatacccgttttcccttcatccttttatttcctgtaaagaaaatagtctatctactctatcagccgcatatgtatgaggtaaattcataaagtcatggagggggataacatttgacgattacaagacaggatgcatggacacaggatgaagatatattgctggctgaggtcgtattaaggcacattcgggaaggcgggacacagctttcagcctttgaagaagtgggcaaggctttaagcagaaccgcggccgcctgcggattccgctggaattcatttgtcagaaagcaataccaatcaggcattgaactggcaaagaagcagcgcaaagagctgcgcaaaaaaatcggcatccattccgcaaaccttcctggatctgtcaaaacggtttctgagagcaaggcggaaaacctgacgctcgatgatgtcatagagtacttggaaaagctgaaagaagccccggttcaaaaggactttatcgacgagaagaaaaagcttgctgaagaaatcaatgagctgaaacaagaagttgaaaagctgcgaagcgaaaatcaatcgctgaaaaaaaagcttgaattgacagaagaggattataaagcgctgattgaaatcatggagagagccagaaaaatggtcgttcttcagggagacgaacgaaacaaaaaggcgatgctccagccggagccgaatgaaaatctgggggaagcttgaaaatagaaaaccggccatccgctatcggccggcttttttcgtttatgctgattcagaactttgactaggttcgctcgcaggatgccaaacgagcggattttcccctttatcccgggccatatcgtatttaaccggtgtaaagcccatcttgttccaaaaatcggatgatttgacgcgcggacttgtgcgaatcgggagtccgaaagatttggcgaactccacaagcatcgttccgtagccgtttcgctgataccccggcaaaacttcaagcttccagagctcgaggtaatcttggccttcttcaaaatattggtttgatttaccatccactttatacaggctcattcttgcgacgagccgatttccgtaatagatgccgtaaaacggtgagttgctgtcgttttcaatcatgttgctttcaaggtcctccagcatggaaagctcttgaatcccgtactccctgaactttttaaattcttcaagcgttttgtagttgatcagcaaacgttcgactttgaccattatgttacccccttgtttgtggtctacttctattgtaaacgcttttttcaaaaaatccaaatgataaaaattttctaatataatgaagcgaaacggttctgaatatttgaaacaactgacaagtcaacggcgaaaatttctgctatgatatacagtatatgaaaaaatcagggtgtgagaatgtgaaaatcggagtcatcggaggaggctcggtcggcctcctttttgcatactatttttcgttcggccacgaagtgactgtgattgcgcggagaaaggaacaggcggaagcgattgaagaaaagggaatccgccttcttgaagacgggaaagagatgaccgtgaacgccaggggcgtgactgaacttgatccggactgcgaccttctttttgttgccgtaaaggagcatcagctcggagccgttctgtctgagctggagcaggcggctcctcttgacatcatgttcctgcaaaatggaatggcgcatattcccgtgcttgaaaaatggcagacgggccaccgcatctatacgggatctgtggaacacggagctgtcagggtggatgaccgcacattccggcacacgggaaaaggggccgtaaaatggagcgcgttccgaagccaatccgccgcccggctgaaaaaagagctcgcttcggtgcatgaagcgttcccttttatttggtccgaagactggtataagcccctcgccgaaaaattgattgtcaatgcgtgcatcaatccgctgacggctcttttgcgggtgaaaaacggcgcgctgcttgaggagccgatgtatggggcctatatgaagttcgtctttgaagaagcgagccggattttggaacttgaagatcgccaggcagcgtgggaccatgttctttccgtctgccgccggacgaaaagcaacacgtcctcaatgcttgccgatgtgctggcagaaagaaaaacggaagcggatgcgatcatcggctatctgctgaagcgggcaaaagagtcaggagagcccgccccgcaccttacctttttatatcgcagcatcaaggcgcttgaaaacgaatgaagctaaatcttttgaccgaatcgcgtaacgtgctatactcgtttcggatagctaactatttactggagaaaggaagttctagagatgcagcttactgaactttccatacaaagtcaaaacccttttgtacgagactatataaatggaaaaaaggagatagagccgttttttgattacggcctgagcaatgaaagttggagtgtccgtttggatgacctttcctcccggacgtatgaccgcgatgcgttagcagactatttgctcgactatcaccgcaaatttcaatcggcaaccatgaatgaaacaatcgaacgccttcgcgatccgaaaagcgtcgtcgttgtcggagggcagcaggccggccttttaacgggtcctctttacactatacataaaatcgtatcgatccttttattagcaaagcaaaaagaacaagagctgaacgttccggtcattccggtattctgggttgcgggggaagaccatgatctggaagaaatcaatcacgtctacatttctgacggcggcaaggtgaaaaagcacaagctcccgcagtcccactggaaaaaaagccaggcggcaaaaacggcgctcgatgccgagaaagctgaaaagtggctggacgggatttttgcttcatttgaagaaacggagtatacgaatgatcttctcggccatttgcgccgatgtttaaggcagtctctttcttttaccgattttttcgaatttcttgttgccgacatgtttgaacaagacggcttgatccttttgaattccggagacccgggcatcagaaaccttgaagcgcgctttttccggcagctgctggacaaaaacgatgagctgaccgactctgtcaaacggcagcaggaattgatgaaacaactgggttacacaccgattatcgaaggggccgcacaacatgcgaacattttttatgagcgcgacggcgagcggtttttaattgaaaaagaaaacggcgcgttttttataaaagagcttcatcttcagtggtctgaagcagagctttgcgatttgatctgccagaacccggaagcgttcagcaataatgtcgtaacccggccgctcatgcaggaatatcttcttccgacattggcgttcatcgccggtcccggagagatcaattattggggcgagctgaaaggcgcttttcaggtcatgggctataaaatgccgcctgtcgtaccgaggcttcaggttacattccttgaacggcacatcgaaaaaaagctggacgaacggggaatcgaactccgcgaatcgattgaaaagggagcgcgggccaaaaaagagcagtattttcaagataaggttccgagcggatttaccgattcggtcaaacaggcgaaagaaaaaatcgaaaacattcattccgcagtgcgcgccgaagccctcgaaatcgacggcagcctcggcccccttttagaaaaaaacgcgggcttcattcaagatcagctccaatttttggagaaaacagtcatcagaaggattgaagaaaaagaaaactatattttgcgtgattttgacaaaattcaaacaagcatcaaacctttagacgctccccaggagagaatttggaacatcgtgtattatttgaacaaatacggtccggatttcttggaaaaatacaaggatttgccatattcatttcaaaacatgcatcaagttgtcaaactttgaaataattttttaaaaaaccctgagtagttcagggtttttttttgttctaaaacagtgtaaaataaatttgtggagagaagtggtggatagtggtgagttggggaacgaaagtgggggccgagatcatgtttatgggtgaataccagcatacgattgattcaaaaggccgcatgatcgttccggcgaaattcagagaaggcctcggcgagcagttcgttctgacgcgcgggcttgatcagtgcctgtttggctacccgatgtccgaatggaaactcatcgaagaaaaactgaaggcccttcctcttacgaagaaagatgcacgcgcttttacccgcttttttttctccggagccaccgaatgcgaattggacaagcagggccggatcaacattgcatcgccgctgttaaattatgcaaagcttgagaaggaatgcgtggtcatcggagtttcaaatcgaattgaattgtggagcaaagagatttgggaacaatacgtagaagagcaggaagattcatttgccgaaatagctgaaaacatgatcggatttgatatataatgaatctttgcgcatgcggcgcttctgcaatcagttcatttgaaaaaggtgggactagtaaagaaatgtttgagcatacaacagtattattaaaagaaacagttgatggtttaaatgtaaaagaagacggtacatatgtagactgcacattaggcggtgccggtcacagcgagtatttgctttcacagctgtctgaaaaaggcaaattggtcgcttttgaccaggatgaaaccgcactccgccatgcgaaggaaaaactggcggattatgaaggacaagtcgttttcataaaaagcaattttcggtatttaaaagaccgtctaaacgaaatcggcatcacgaaagtggacggtgttttatttgatttaggcgtctcatctcctcagctggatacacccgaaaggggcttcagctatcatcatgatgcacctcttgatatgcgaatggaccagtcggcgggcctttcggcaaaggaagtcgtcaatgaatggccttatgaggatctcgtgaaaatcttctttaaatacggagaagagaagttcagcaagcaaattgccaggaaaatcgaaaaagcaagagaacaatcgcctattgaaacaacaggccagcttgtcgatatcatcaaagaggcgattcccgcaccggcaagaagaagcggcgggcatccggctaaacggatcttccaggcgattcgaattgcggtaaacgatgagttgagggtatttgaagaagcgcttttgcaggcgattgaggtgctgaagccgggcggaagagtatcggtcatcacattccactcgctggaagaccggatctgcaaatcgacatttaaagacatgtcgtcgcctcctgaactgcctcacggactgcccgtgatccccaaggagtttgaaccgaaattaaaattagtcaacagaaagccgatcacagcttccgaagaggagcttgaacacaataaccgtgcgcgctcagcgaagctgcgcatcgcggaaaaagcacgagagtgagctgtacgaattaaaaggaggtcatcagtctatgagcaatttggcttataaagtagaaaaacagcaaagacagacagacagtgcagaacaatccgttatcatccggagaagagcatcgattacgctgggggaaaaggtattgattgtgcttttcgccctggctgtgctcagcgcttcactttttatgatttcaaaggcttttgccgcgtatcagaccaatattgaaattcaaaagctcgaaaagaaggttgaaacggaaagcagcagagttgatgacctcgaaaaagaagccgatatgctgaaagagccggaccgtatcatggacatcgcccggaaaaaaggccttaaattgggtgataaaaaagtgaaagacatacaggaatgatgcaaaatgccgaaaaaaaataaattcatgaacagaggagcggcaatactcagcatttgttttgccctctttttctttgtcatcgtaggacggtttgcgtttattcaagcgacgggaaaagtgaacggcgaagtgcttgcgcagaaggcgaacgaacagtatgagaaaaagcggacgatcgaagcccaccgaggatcgatccttgaccggaacggaaaagtgcttgccgaagatgctacgacatataagcttgtcgcgattatgagcgaaaagatgaagcctcaatacgttaaggacaagcagctgacagctgagaagctcgcgccgatcctcggcatggatgaggggaaagtgctcgatattctaaataaaaaaggagcgtttcaggtcgaattcggatcggcgggacgggatttgacatacgcccaaaaagagaaaatcgaaaagctgaagctgccgggcatcgtgttcacccgcgatacgaagcgctactatccaaacggaatcttcgcctccaacctcatcggctattcgcagatcaacgaaaaaacgggtgaaatgcaaggcatgatgggccttgaaaaaacgctgaacgattatttgaaagaaacggacggatacatgacgtacgataccgacagaacgggctggcgcctgccgaacagcaatgaaaagattaaagcgccaaacaacggagacaacgtgtatttgacgatcgatcaaaaaatccaggcgtttttggaagacagcatgacgaccgttcaaaaagagtacaagccgaaaaagattatggcggcggttgttgatccgaaaacgggcaaagtgcttgcgatggggcaaaggccgagcttcaacccgaacgtgcgcgatgtcacgaactattacaacgaccttgtctcctacagctttgagccgggctcgacgatgaagattttcacattggcggcggccatccaagaaggcgtatataatggaggagaacaatacaagtctggatcatattcggtttctaaaaaagataagccgatcaaagaccataacggtggaaacggctggggcccgatcacttttaatgaaggtgttgaacgctcctcaaacgtcgcgtttgcgatccttgccaacgataaactcggcacggaccggttcaatcaatatttgcggaaattccatttttacgacaaaacggggattgacctgcctggggaagcgaacagcaaaatcaactttgaatatttgcgggataaagtgtcgacggcttttggacagagctctgctgtcacgccgatccagcagcttcaggccgcgacggcgatcgccaataacggaaaaatgatgaagccttatgtgatcgatcatgtcgttgattctgacaaaaacaaaacgatttatcaaaataaaccggaacaagtcggccagccgatctctgccaaaacggcaaaagaagtgcgcgagctgttgggaaaagtcgtcacatctgaaaaaggaacggggcagccgtacaagatcgaaggatttgatgtcgccggaaaaaccggtacggcgcaaattgccggagaagacggcagatatttgaccggccgcgaaaactacgtgttctccttcatgggcatggccccgaaggacgatccgcagcttctcgtttatgtggccgtgcagcagccgcaattaaaagctacggaaacaggctctgctccggtgtcaaaaattttcaatccggtgatgaaaaacagtcttcactacttaaatatcacaccgaaagagactgaaaaagaagaaaagcaggaagaaaaacagctgaaaatgcctgatttctccggcaaacgagccgaatccgccgcaaaagaggcgcaaggcagcagccttgttcccgttacgatcggcgatggcttggctgtgaaagaacagtacccgaaagcgggcgaagccgtcctgccgaaccaacgggtcttcctgaaaaccgacgggaaaatcacactcccagatatgacaggctggtcaaaacgggacgccctccgcttcggcgccatggcaggcattcatatcgaaacgagcggccagggctatgtgaagagtcaaaatgtaaaagcaggcaaagaattaaaagcaaattcagtcgtgaaagtcagattgaaaaacgaatagatcccgtcaaaggctatcggctcaaagtcgatagccttccgtttggacgcggccgccttgaatagatgaaaaatcgggccgttctatcaaaacgctccgaggcataaaatgaaacaagcctaaataaggagtgaacggtctcttgcgcgtttccaatgtaacggtcagaaaacgtttaatattcgttctgctttttggtgtgatcatctttttgattattgatacaaggctcggatacgttcagttcgttctcggggataaactgacgactttagcaaaagattcttggagccggaaccttccttttgagccggaaaggggcgaaatattggacaggaacggcgtcaagctggcaacaaaccaaagcgcgccatcggttttggttgttccgaagcaagttgaaaatccgatcaaaacgagcagactgctggccagcgttttgaatatgtcggaagaaaaagcgtataaacatgtcacgaaaaaaacgtcgattgaaaggatcaatcccgagggccggaagatttcccacgagaaagcaaaagaagtcagagatctcaatttgaaaggcgtatacatcgcagaagactcgatccgccattatccgttcggcagctatctgtcccatgtgctcggatttgcgggcattgacaaccagggtctgctcggccttgaagccttttatgacaaagagctgaagggcgaaaagggctatgtgaaattttattccgatgcaaaaggcaagagaatgcctggggaggcggatgactataccccgccgaaagacgggcttgatatgaagctgacgatcgattcaaaggtgcagacgatcatggagcgggaatttgatatcgcagaagcgaagtataatccggacggtatggtcggtgttgcgatgaatccgaaaaacggggagatattggcgatggtcagccggccggactttgatcccgcaaactaccaatcaatcgatcccaaagtctataaccggaacctgcctgtatggagcacatatgagccgggttctacttttaaaatcatcacgcttgccgcagctttggaggaaaacaaagtcaacctccaaaaagatcaattctatgataaaggttccgttgaagtggacggcgcgaggctgaagtgctggaagcgcggcggacacggcgcacaatcgtttcttgaagtcgtccaaaattcgtgcaacccgggatttgttgagcttggtcagcggctcggcaaagaaaaactgttcacctacattaaaagtttcggcttcggacaaaaaaccgggatcgatctgcaaggcgaaggaacaggcatcctattccctcttgaccgcgtcggccccgtagagcaggcgacaacagctttcgggcagggggtatcggtgacgccgatccagcaggtcacggccgtttctgcggctgttaacggcggaacgctgtatacgccgtatattgccaaagagtggattgatcccgtgacaaaacaaacagtgaaaaaacagacgccgatcgccaaaagaaaagtgatttctgaagagacatccaaacagatccgctacgcgctggagagcgttgtcgcccaggggacggggcggaacgcttttgtcgacggctaccgggtcggcggcaaaaccggtacggcgcaaaaagtaaaagacgggaaatatttgaaaaacaaccacatcgtctcatttatcggaacggctccttcagatgatccgagcattgtcgtctacgtcgccgtcgacaacccgaaaggaacgattcaattcgggggtacggttgcagcgccgatcgtcggaaacatcatgagagacagtcttccgcagctcggcgttaagaagcggaaagatcagatcgaacgcgaatatcaatggctggacaaaaagctgatcgaggtcccgaaccttatagggctttccgtgacagagcttgaaccattgctgatcaacctcaggctgaaggcttccggagaaggcgatgtcgtcgttcagcagtcccctaagccgggcgaaaaagtaaaagaaggatcgacgattcgcatttatcttgacagcgatgacggagcctctgattaattcgtttcaatataggagcggctgcctgctgatgtccggggccgttcctcctaaaaaatatatcgattttaaaggattagctggatgtatcctcttttttacgctaaaatatgaactgtatgtctgcacgaagctcgtgcggcgaatcaatatgacaacgaatgaagaatgatgagacttgagaggtttgatacgatgaaattgacaaagcttcttacatatttaaaaaatgtaccttcctatgccggccaagaagaccctgatataacttcaattgagatggactccagggaagtcaagacagggagtctttttgtttgtataaaaggctatacagtcgacgggcatgactacgcccgccaagccgctgaaaaaggggccgccgccattgtggcggaaagggaagtggacgccgatgtgccggtgattatcatccgtcatacgaagagagcgcttgccgtgctgtcggacgctttttacggccagccgacaaagcagctgaggctgatcggaattacaggcacgaacggcaagacatcgacttctcacatggtggaggagatctttagaaaagccgggagccgtacaggactgatcggcacgatgtacacgaaaatccacgacgaaacgttcgaggcgaaaaatacgacgccggaaagcgtcacacttcaaaaaacgtttagaaaaatggttgatcagggtgtggatacagccgtcatggaagtatcttcacacgctctccacatgggccgggtgcacgggtgtgattacgatatcgccgcatttacaaacctgacccaggaccacctcgactaccacgagacaatggaagaatataaacatgcgaaaagtctgcttttctcgcagctcggcggatcctttaaccacgaaacaccgaagtgggccgtgctgaatgcggatgaccctgcttcagcctatttcgcccaagtgacgtcagcacatcttttgacatacggaattcaaaacgatgccgatgtcatggctgaaaatatcaaaatggctccgaaagggacaacctttgacctggtgacgccaaaaggttctgcacaagtgacgattccgcttgtcggcctgtttaacgtctacaatgttttaacggctgccgcgatcgcgattgcagcggatatcccgtttgccacgattacagaaggaattgaagggctgaaaggggtcagaggaagatttgagcttgtggacgcaggccaggacttcccggtgatcgtcgattatgcccatacccctgacagcctcgaaaatgtcttgaatacgtgcagaggcttaacggaaggaaagctgtttgtcgtcgtcggctgcggtggagaccgcgataagacgaagcgtccgaaaatggcgaagatcgccgttgaccttgctgatgaacccgtctttacagccgataacccgagaagcgaaaacccgctcgccattttaaacgatatggaggaaggcgtaaaaggagcttactatcacagcatcgtcaaccgcgagcaagcgatcttttttgcaattgcaaacgccaaaaaaggcgatgtcgtcctgattgcaggcaaaggccatgaaacttaccagcagatcggcggtcaaacctttgattttgatgacgctgaggtggccaaaagagccattcttgagctgaaataatcgaaaaagaactacaggaaagagttgttgaaatgatggatgaaataaatcaacatatgaaaaaaaacagtgaatatgataaatgcgtatgctgcttcttatatcatgcggaaaggagagaagaacgatgctcgaacaagtaattttatttaccattatcatgggctttttaatcagcgttcttttatctccgattttcattccgtttttaagaaggctgaaattcgggcagagcatccgtgaggaaggtccgaaatcccatcagaaaaaatcgggaacgccgacgatgggcggcgtcatgatcatattgtcgattatcgcgacgaccattgttatgacgatgaaattttccgaagtcagcatgaacatgatcctcctcttgtttgttacggttggatacggtctgctcggctttctggatgattatattaaagtcgtgatgaagcgcaaccttggactcacatccaaacaaaaactgatcggtcagatcgtgattgctctcgtattctatgccgtctaccacttccaaggaatgccgactgacatccgcattccgggaacagagctgtcgtttgacttcggctggatttatccagtgctcgtcatctttatgcttgtcggcggttcaaatgccgtcaacctgactgacgggcttgacggtctgttgtcgggtacagctgccatcgcgttcggtgcgtttgcgattttggcgtggaaccagtcgcaatacgatgtcgcaattttcgcggttgccgttgtcggagcggtgttaggatttcttgtgtttaacgcgcaccccgcgaaagtctttatgggagatacagggtcgcttgccctcggcggcgcgattgtgacgatcgcgattttaacgaaactggaaatcctgcttgttatcatcggcggtgtattcgtcattgaaacgctgtccgtcattttgcaggtcatttcatttaaaacgaccggcaaacgaattttcaaaatgagccctcttcaccatcactacgagcttgtcggatggtctgagtggagagttgtcgtcactttttggacagcggggcttctgcttgccgtcttaggaatttacatcgaggtgtggttataagtggatactcaagatttattgcaaaatcaaaatgtgctcgtactggggctggcgaaaagcggatatgctgccgcttcgatccttcatgagaaaggcgtaaaggttgtcgtgaatgaccagctgccttttgaggaaaatgaacctgcgcggattctcgcggaaaaaggggtggaagtcgtctgcggctctcatccgacggaactgtttgatcttcattcgatcgacattctgattaaaaatccgggcatccgctatgaaaacgtgatggtcgaagaagcgctgaagcggggtatcccggtctggacggaggttgaactcgcctatcatctgacagatgctccgttcatcggcattaccggttcaaacggaaagacgacaacgacaacgcttgtttatgaaatgctgaaggccgattcgaaaaaagcgctcgttgctgggaatatcggtacggcggcaagcgaagtggccaatcaggccagcggagacgaatggatcgtgacagagctgtcgagttttcagctcatggggacttatcaattcagaccgaagattggattattattaaacgtatttgatgcccatctcgattatcaccattcgcgcaaaaattatgagcttgccaaacagcaggtctatcgaaatcaatcggaaacagacgttgccgttgtcaatttggacgatgagacagtcgtccggctcgcggagtgttcaaaagcggagaaggtgtatttttcggtccgccggacacttgagcgcggagcgtgcgtgaaagacggcgcaatcatgtttaacggcgaaccggtcatgccgctggaagacgtcgttttgccgggagagcacaatttggagaacattttggccgccctttgcatcgttaaaacagcaggcgtttccgacgcggccgtccgtaaggtgctgacgagctttacaggtgttaagcacaggatgcaatacgtcgcgacgatcaaaaacagactgttttacaatgacagcaaagcgacaaacattcttgcgacgaaaaaagcgctgtccgcctttcaaaagccggtcattttgctggcaggggggcttgaccgcggaaatgaatttgatgaactaaagccgcatatgtcttttgtaaaagcggtgatcactttcggcgagaccgcgccgaagtttgagaagctggccgaagaaatgggaatacaacaggttaaacgtgtcgataatgttgaacaagcagcaactgcggcgttcagcctgtcagacgaaggagatgtcattcttctgtccccggcctgcgcaagctgggatcagtacaaaacatttgaagaacgtggtgacatgtttgtaaacgccgtgcatatgcttaaataagggcttgtctcgtaaagatagccctaagaattagagcttggggtgttcggctttgcaaacaaaaaaaacgtcaccggattttttgctggttatcattacgctattgcttttaacaatcggactgattatggtatacagcgccagtgcagtatgggcgacttacaaatacgacgactcctttttctttgcgaaacggcagcttttgtttgccggcatcggggtcatcgccatgtttttcatcatgaacgtcgactactggacgtggaggacttatgcgaaaatactgatcattgtatgtttctttctgctcatcatcgtcctggttcccgggatcggcatggaacggaacgggtcgaggagctggatcggagtcggcgctttcagcattcagccgtccgagtttatgaaactcgcgatgatcgcatttttggccaagtttttatctgaaaagcaaaagaatattacgtcgtttagaaaaggctttgtgccggcgctgggcattgtcttttcagcttttctgatcatcatgatgcagcctgacctcggaacaggaaccgtgatggtcggcacatgcatcattatgatctttgtcgcgggggcgagaatttcgcacttcgtttttctcggcctgatcggactgagcggttttgtcggccttgtgctgtcggcgccgtaccggatcaaaaggatcacttcatacttgaacccttgggaggaccctttaggaagcggctttcaaatcattcagtctctttatgcggtggggcccggcgggctgttcggcctcggcctcggccagagcaggcaaaagtttttctatctgcctgagccgcagacagattttatttttgcgattttatcagaggagctcggctttatcggcggatcgctgattcttttgctcttcagcgttctattatggagaggcatcagaatcgcgctcggtgcgcccgatttatacggcagttttgtcgccgtcggcgtcatttcgatgatagcgattcaggttatgatcaatatcggagtcgtgactggtttgattcctgttacaggcattacgcttccgtttttaagctatggcggttcatcactgaccttgatgctcatggcggtcggcgtgctgctgaatgtcagcaggtattctagatactagattttggcgataaccctgttgcgagatagcagggttatcggcgtgtacataaggattaagggggagaacagatgcggattgttgttagcggaggcggaacgggcggccatatttaccccgcccttgcgtttattaaagaagtgaaacggcatcacgaagatgttgagtttttatatatcggaaccgaaaaaggcctggagaaaaatatcgtcgagcgggaagggatccctttcaaagcgattgaaattacgggttttaaaagaaaactttcatttgaaaacgtcaaaaccgtcatgcgctttttaaagggtgtaaaagaatgcaaagaagaattaaaacggttcaagccggatgccgtgatcggcacgggcggctacgtgtgcggccccgtcgtatacgccgcttcaaaactggggattccgacgattatccacgaacaaaacagccttcccggactcaccaataagtttttatccaaatatgttgataaggtagcgatttgttttgatgaagcgaaaacacattttcctgcagaaaaagttgtttttacaggaaacccgagggcgtctgaagtcgtctctataaaagggggccgttccctgaccgctttgggtcttgcagagggcaaaaaaacggtccttattttcggaggcagccgcggtgccgctccgatcaatgaagcggtcattgcgatgcaaaacgaattaaaaaagcgggattaccaggttctttatgtcacaggggaagttcactatgataaagtcacagctgcgcttgaaaaagaaggcgccgctccgaatatggtcgtccagccgtttctccatcaaatgcccgagtacttaaaagcgttcgatgtcgtcgtgggccgcgcaggggcaacgacaatagcggaaatcaccgcgctcggcattccaagcgttctgattccgagtccgtatgttacggccaaccaccaggaagtaaacgcacgctcactcggggagcagaacgccgctgtcgttttaaaagaatcagagcttaatggagaccgcttaattcaggcgatcgatcatattttacaagacgaaaagacgttggaagagatgaagatccgcgcgaaatcgcttggcgtgccggacgctgcggaacgcttgtacaatgtgctgaaagaattgaaacatcatgcaaaatgataagacagaaggattgtggaggttttcgatggataaggtgatacaagaattaaaagaacttgaagtcggcaaagttctggaaaacgagccgctcagcaaccatacaacgattaaaatcggaggaccggctgacgtgctggtgattccgaaagacattcaagctgtcaaagatacgatgaaggttgtcaagaagcacggcgtcaagtggacggccatcggcagaggctcgaatcttctcgttctcgatgaagggataagaggcgtcgtcatcaagctcggccagggactcgaccatatggaaatcgacggcgagcaagtgacggtcggcggcggctactctgtcgtaaggcttgcgacaggcatcagcaaaaaagggctttccggccttgaatttgccgcaggcattcctggttcggtcggcggagcggtttacatgaatgccggcgcccacggctcagatatcagcaaagtattggtgaaagcattgatcctttttgaagacggaacgatcgaatggctgacgaatgaagagatggcgttcagctaccgcacatccatccttcaaaacaagcggccgggcatttgtcttgaagccgttctccaattggagcaaaaagaacgcgatcagatcgtcgcgcagatgcagaaaaacaaagactaccgaaaagaaacgcagcctgtgtccaacccttgcgcaggcagcatcttcagaaacccgctgcctgaacatgcgggccggctagttgaagaggctggtttgaaaggccatcagatcggcggggcaaaggtttcggagatgcacggcaatttcattgtcaacgcaggcggcgcaacagcgaaagacgtccttgatttgattgcattcattcagaaaacgattaaggaaaaatacgatatcgacatgcacactgaggtcgaaattatcggagaaaaacggtaaacggcctctctacttcagatcgccttatgatataatgtatgaaacaaacaagcaaacggcatcctagtatgtcgtttgtttcgctaaacggaagctttttagcttgcccccgtgctttcatatgtcgaaaagcgcgtcttttttcgaacaaaaataagcaaataaaagtctttttgtctgctttattaacctgaggtgagcctacgtgaaacccggtattgataaagaaaaagtagtgaatatagaagaacgtattcccaaaattaaagaacagcgaaagcaaaaggcaaaccgccggctgatcacctttattctgctctttttcacgatgatgctgatcatcatttacctgcagacgccgatcagcaaagtctcgaaggtagagatcaaaggaaacaaaaacgtttcaaaggaacagatcatttccctttcttcaatccataaaggacagacggaattttggagtctgagcaagcaaaaagccgcagaaaagatcgagcagaataaactgatcaaaaaagccgaaatttctaaacaactgcccaacaaaatcgccatctccatcgaagagtataaaagcattgcgtttttgcaaaaacataatgtgtactactccgtgcttgaaaacggcacggtgcttcctgaagaggtgacgccgactgacatcggaccaacccttaataactgggaggaagacgaaaagctcgttcaaatggcaaaacagctgaacaagctttccgattccgtgaaaaaatcgatttccgagatcaactatacgcctcaaaaatcaaacccttggctgatcaaactgtatatgaacgacggctatatcgtgacagcttcgctgaaaacgttcggacagaaaatgaacagctatccggcgatcgtaaaagagctgccgaaaggggaaaaaggcattatccatatggaagtcgcgacttattttgaacctctgaaaaaaacggatgaaagcaaaaagggagacggaaattgaagaggcacacagtcaatctttcactcgccatgcttgtcctcggcttcctgctgtctttctcctatcaattcgccagggaaaacaaagaccatgaagaaactgctgaaaattggaaagaggaatattccctgcgcgaccggctgatttcccaagaaaagcaaaataagaagctggaacaggagctttacaaaaaacagcaggaagtacagaaaacagagacggctttgaaaaaggaaaaaaaagagtactacaatattgtggaagatgttgagaggtacagaatgttcgtcggggaaatcggcgttcagggcgaagggatcaaagtgacgctgaaagacgcttcgtacatcccagagggtgagaatgtcaacaactatatcgtccatgaaagccacattttccgcctgctcaatgagctgtggatttccggggcggccgcggtgtcgatcaacggacagcgcgtgacacatcattcctacatatcgtgcaacggccctgtcatcacggttgacggcaaccagtatccggcgccgtttgttatttcggccatcggggatgcggatgtgctgatgccggcgctgaacattgcaggagggcttgtggaccagctgagccgcgatcatatttcagtcagcatcgaaaaacaagataatatcgagatggagccccttttgaagcaaggggaatgaacgttgaaaagttggtgggcggacattgaagaaaaataatcgtttcatcagtttgagcatcttgatgctcattttcggcattatgctgtccgtgcagttcaattcgctgaaggcgccgaaggtccgcgatacgcgggacatttgggacctcagggaggacttgaaggaagaacagaaaaaacagcttgatctgatcagcgaaattgacaagtatgaaaaaatgctgaacacatacagtcatcaagaagaaacctcgcggacaaaagcgttgaatgaaacgcttcaaaacttaaaaaaacaggccggcttcacagatgtcacagggaacggaatcatcatcaccatttctcagctcttctcggaagaattgacaggggaatcgattcaaaatccccctcccgaccttctgaaaaagctgattaatgaactgaatatgtatgaagcggaagaaatatccatcaacgacagaagggttgtcaacacgacggtgatccgcgatatcaacggaacaaccaaaatagacggttatcctttggacaactatccgataacggtaaaagtcatcggcaaaaacgccgataaactatatagccgaatgaatgcttcatccctgcaggatctgttcgcgggagaaaatctggatttgcaaatcaaaaggcctgaaaaacaatcaaaatcaaagcttacgaaggttcaatgcaagttgcgccattgaaaccgctcgaaaaatcaaaaggagagaattcctaatgtggcttccggttttaggggcttttgctccgaaattacaatcgggttcagcacgaatttcaccattccggatgagtactcaaattatttgtccctggcgattctggcatcgctcgatacgttgatcgggggaataagggcccatttggaaagtgtatacgatgaactagtttttgtgacaggctttttcttcaatattattcttgccataagtttggcttttctgggcgttcatcttggtgtagacttgtatttagtcggtatgtttgcatttggcgtgaggctttttcaaaacatcgcggtcatcagaagaatactgctcgccaaatggacggcatcgaggagaaaaaattaaaaaaaatcggatttaaaagaggatatacataggatatcacgaatattcacagtaatcctaaaactgaaaacgaagcgtattggtttgtattgattgttacacacttgtaaaaccagattcattgtattgttgttcggcaaataatagaatagaattgactgaaatgtgaggaggtgccatagaatgaacaacaatgaactttacgtcagtctagacatcggtacgtccaatattaaagtgatcgtcggtgaaatgtcagacgattctcttaacattatcggagtcggaaatgttccctcagaggggctgaaaaaaggatcaatcgttgatatagatgaaacggttcattctataaaaaaagcgtttgaacaagcagaaagaatgataggttttccgctgacccacgcgatcgtcggggttaatgggaactacatccatattcaagatacgaacggtgttgtggctgtctcaagcgagaataaagaaatccacgttgaagacgtgcgccgggtgatggaggccgctcaagtcgtttccatcccgcctgaacagctgatcgtcgatgtgattccgagacagtttatcgttgacggaagaggcgatattacagatccgaaaaagatgctcggcgtccgccttgaagtggaaggatcgctgatcacgggctctaaaacgattttacataacctgctccgctgtgtggaaagagcgggaattgaaataacggatatttgccttcagccgctggctgccggatctgtcgctttatcaaaggacgaaaaaaacctcggagtggctttaatcgacatcgggggaggatcaacaacggttgccgtatttgaggacggccaccttcttgcgacccgtgtcataccactgggaggagaaaacatcaccaaggatatttcaatcggattgcgcacctccacggacgaagctgagcgggtgaaaaagcagtttggacatgctttctacgaagaagcgtcggaagaggaaacatttgaagtcgccgtgatcgggacggaccaaaagcagacctttactcagcgggaagtggcagacattatagaagccaggcttgaagaaatctttttattcgtggcagaggaactgcggaacatgggaataaaagaattgccgggaggctttgtgcttacagggggacaggctggaatgccgggggtcctcagcctcgcacaggatgttcttcaaaataacgtcagagtggctagcccgaattatatcggtgtaagagaacctcaatacatgacaggagtcggcctcatccaattcgcttaccgcaacgcaaaaatccaaggcagaaaagtagggtttaagatgccggaacaagcggttcaggaagtcgcggcaactcatcaaaaagaagtgcagcagcgaccgaagccaaaatccaagcagcaggctcaagctgagaaaaagccgagcaaaatgaagaaaatatttaacatcttttgggaatagagattagtcattcgacggattaggaggatttagcatgttagagtttgaaacaaatatagacggcttagcatcgattaaagtaataggagtaggtggcggcggtaacaatgccgtcaatcggatgatcgaaaatgacgttcagggagtcgagtttatcgcagtcaacacggatgctcaggctctcaacctgtcaaaagcggaaacgaaaatgcagatcggtgcgaagctgacgcgcgggctcggcgccggagccaatccggaagtgggcaaaaaagccgcagaggaaagcaaagaacaaattgaagaagcgctgaaaggtgcagatatggtgttcgtcacagccggaatgggcggcggaacaggaacgggcgcggcacctgtcatcgcacaaatcgcaaaagatctgggcgcattgactgtcggcgttgtcacaaggccgtttacctttgaaggaagaaaaagacagcttcaggctgcaggcggtatttcagcaatgaaggaagccgtcgacaccctgatcgtcattccgaatgaccgtcttcttgaaatcgtcgataaaaacacaccgatgcttgaagcgttccgtgaagcggacaacgttctccgccaaggtgttcagggcatttcagacctgatcgcaacgcctggactgatcaaccttgactttgccgatgtcaaaacgatcatgtccaacaaaggttctgcactgatgggtatcggtgtagcgacaggcgaaaaccgcgctgcggaagccgctaaaaaagctgtttccagcccgctgcttgaaacggcgattgacggcgcccaaggcgtgctgatgaacattacaggcggcaccaacttaagcctatacgaagttcaggaagcggcggacatcgttgcagctgcatctgaccaggacgtcaacatgatctttggatctgtcatcaatgaaaacttaaaagacgagatcgtcgttacggtgatcgcgactggatttatcgaacaggatcaagattcatcaaagccgcagagacctttaaaccaaggcttaaaacagcatcatcagcctgctccgaaacgggagccgaagcgcgaggagccaagcatgccgcatcgcagcccatcacagcctgccgaggatacgcttgacatcccgactttcttaagaaaccgcaataaacgctaaacgtctacaatacattggaaagctgccgacaagaagtcggcggctttttttgcgcgctggaacagcagccgatgttccttcccctccaaaagcatcaattgtcttcttgatggaagcggctccctcaaaagccttgcatctaatctctctcttttctcccgaatgtacagattttccttttttcttgtcatcaggccgaactatgaacggtgaacaagtcatatgtaaaaagaacgaatttgcaaactgacaaaggaaaaatgacagaatacgacaatatctataaaccttttctattaccattattaatagattctgtttctagacatagaaacgcaagaaacgactatatttgctattgcttaaaggaggatgtcatgtgaagaaaaagccattattccgcacgttcatgtgcgctgcactcatcggttcacttctcgctccggttgctgtgcaggctgatacaggcacggcagcgaagacaaaggaacaaagcaaaatatctagcgctctttataaacgttttgagaaagaaggtaaagtgacctttttaattaaaatgaaaagccaggcgaaccttcagcaagcggcaaccgcggctgaaaaacgggcgaaagcaagcgttatgaccgtgaaaaaagcaaaagagatcaaacgctcggcagtgctgacttccctgcgtacaaaagctgaaagaacacaaaaagatttgaaatcgtttttggaaaaagaagagaaaaaaggaacagctaagaaagtggaatctttctatattgtaaacggcatcgccgtgacggcgacaaaagatgttatggaaaaagcggcttcatttcctgaggttgaaaaggtgctgcccaatcaaaaaatcaagctgggcaataccgaaaaacctacagtagaatcgaaaacaaccgcggatcgcacccctgcttccaacattgagcaggttcatgcgccggatgtctggaaaaagcgctataaaggcaaaggagccgtcgtcgcttcaattgacaccggcgtagagtgggatcatccggcgttgaaaacaaagtacagaggctacaacccttctaaaccgaacagtccagacaatgagttcaactggtttgatgcggtaagcaataagaaaacgccatatgatgagttgggccacggcacacatgtgacaggcacgatggtcggctcagaagccggcggcaaaaaccagatcggtgtcgcgccgacggcgaaatggatagctgtcaaggccttttcagaggacggcggagatgaaaaatcccttttggctgcaggagaatggattttggccccgaaagatgcgaaaggaaaagcgcaccctgaaaaggctcccgatgtcgtcaacaactcttgggcaggggaacgcggactcgatgaatggtatttggatattgtcaaagcttggcgggcagctgatatcttccctgcatttgcagcgggcaatgtcagcgaattcgaaccgggcggaccgggttcagttgaaaacccgtccaactatccgcaatctttcgcgattggcgcagttgacagctcaaacgcgttagccgacttttcattgcaagggccttcgccatatgacgaaatcaagcccgatatttctgcacctggcgtcagcatccgctctgcttatccgggacataagtatgctgcaatgaacgggacatcgatggcgaccccgcatgtatccggcatcgtcgccttaatgagggaagccaatccggacctcacagtcgatgaaatcgagcgcatcctgctgaaaacggcgacgcctctgactgacaaaacgtttaaaaaatccccgaacaacggctacggatacggcttggtcaacgctttaaaagcttttgacgcagctaaaaaaactaaatgataaaaaaggacaaaacctttaagcggttttgtcctttttttatctaattttaaacaaggccttgacaaataccgacaaaataattaaccagtttttactatatttaagttacatcaaagtcagacaaggcgtccacaaggagggggggacaggaaaattcagctaatttcataaaaaagggggatgttcatttgaaaagaaagctgagaaaaaaggcgttttccaccattttaagcggtttgttaatcggctcgctgttcatgcccgccgtttcagatgccgcggcaaagcccgcacttacttccatgaaagaacaagcagccgcagggaaggggaaaatttcaaaaactcttgtcaaacagttcaaaaaagaagatcaagtcacatttttgattaaactgaaagatcaagtcgatacaccaaaagtggccaaacaggcggaaaagaacgcgaagaaaaagtcgctgagcgctgctaaaacagaatatcaaaaacgctcggctgttgtttccgctttaagagtcaaagcggatgagtcgcaaagcgatctgaaacgttatttaaaaaagcaggaaaaacagggggacgtaaaaaaaatcagatcctattatattgtcaacggcatggccgtccatgcgacgaaagaggtcatggaacaagtagcggcttttccggaagtagaaaaagtgcttccgaacgaaaaaaggcagctgatcaaaccgactaaacagtctgtgaaaaaatcagcagccaaggatgaaaaagaaatcgaatggaatatcaatcgagtcgacgcaccaaaagcctggaaattgggatatgacggatcgggcacggttgtcgcgtcgattgatacgggcgtgcagtgggatcatccggccttgaaagaaaaataccgcggatatgacccgcagcatcccgatcagcctaaccacgaattcagttggtatgatgcggtttcaggcgcttctgaaccatttgacgatctggagcacggcacgcatgtaaccgggacgatggtcggctcagagcctgacggccaaaaccaaatcggcgtggcgccgggtgcgaagtggattgctgtgaaagctttttcagatgacggcggtacggacgaagaccttattgcagcaggtgaatggattttggcgccaaaagataaagacggcaacccgcaccctgaaatggcgccggatgtcgtcaataactcatggtcagggggagccgggattgatgagttttacagggatatcgtaaaagcgtggcgagctgccggcatctttcctgagttctctgcggggaacgtcgatttcgccaatccgggaggacctgcttcgattgccaatccggcaaactaccctgaagcgttcgcaaccggagcgacagacatcgataatcgcttagccgatttttcacttcaaggtccttccccgtatgatgagactaagcctgaaatatcggcgcctggtgtcaacattcgctcatctgtgcctggaagcggctatcaagacggctgggacggcacttcaatggctggcccgcatgtcgcagccgccgccgctcttatcaagcaagccgattcgtcgatcactgttgatgagaccgaaaagattttgatggaaactgcaacaccgctcacagacagcaaatttaccgaatcgccgaacaacggatacggccacggactcgtgaacgtgtttgacgcagtgtccgctgtgacagacgggttgggcagagcggaaggacaagtcggaaaagaaggcgaagacaaaagtccgccggccttaaaccatcaagagatcaccgaaatttactcaggctcggaaacgcctcttaaagctgatgtagaagacgatgtcagcatcatatcggtcaaattgagctataaaacagatgacgccgattgggagacgatcgctgccaaacaaacttccggcgactataaaaaaggaacgtacgaggcggctgtaactgtttctgaagggaaaaccctttcctacaagtggattgtcaccgatttcggaggcaacaaaacggaatccaaagtgtacgaagtcccgatttccccggctgtgacaacagggtataaacaagatttcgagaattccgccagcggctggctcacatcaggcgtgaagaattcatgggagcgcggaattcctcagtcaggcccgaacgccgcagcatcgggaaaaaacgtattcgcaacaaatctgacagggccgtatgaaagttcggctaatatgaatcttctcatgcctcctgtcagcgttccaaaaaatcaaaagctttatctcacatacaaatattggcgcgatattgaagaggactttgattacggcttcgtttacgtacagcctgaaggaaaaggtgaatggatcccggctgccgagtacagcggcaagacatcagaatggaaagacggacagatcgatttgtcggaatacgggggacagacgattaaggtcatgttcaaccttcaatctgacgacagcattgaaggtgacgggctgtacatcgatgatgtagcgcttgtcaaggaagtgaagagcgccggtacgaaaaaacgattgggcgttgaaaaacagccggccaaaatgaaggataagaaaacaaagaaacgaatgattgatccgaaaaaagcaaaaccggcagaagcccttcaggaaaaaaccgaaacgaaaaaagcagctcctgcggttcttccggtgcgcgctcaggtcagcgtgctggaaacgggcaaatcgacatattccaaccaggcaacaggcgcatacagcttggctcatgcacctggaacctatacgctgaaagcggaagcgtacggatatgaatcaaccgcccaaaccgtaaaaatcgagtccgacaagacaacaacggcagactttgttttaaaagaactaaaaaaagggacgctcaccggaacgataaaaaataaaaaaacgggcgaacccgtccggcatgcaaagttgtatatcgttgaagatgcagctgtaaaaccagtccagacggatgatgacggaagctattcattaacggcctatgaaggctcgtatacggtaaaggtctctgcaaacggatattacagcagcgagttttccgttgatttaaaaggcgatgtctcgaaagatatcgatctcgatcctttcatcggctatccgggggaaataggctatgatgacggaaccggggaaaacgcctgggctttctatgaatccggcaacgggctggcggttaaaatgacgcttgaaaacgggcaggaaaaagccatgctgaaaggcggtttgtttaaattctgggatacagaattccctgatccgggcggcactgattttgcagtagaggtctatgatgcttcgggtgaaaaaggctctccgggcaaaaaaatcgccggcccgttcaaggctgaagcgctccgcacaggcgaatggacgaccgttgatttaggtgacgaaggcatcatcgtcggaaaagacttttacctcgtatacgtccagaaagaggatctggccaactcacctggacttgctacagacgaagacggagaatattccggccgcaactggcagtatacggacggctcatggtcaaaagcgccatcagaccaaggcaactttatgatccgcgctttggtcgactatgaattgtcggtgcctgtgattacgtctcctaaagacggattcatcaccaaccaaaagaacgctgtcattgaagggacatcctcgccgaatacgaccgttcatctctttaacggggatgaagaagccggaacagcggaaacggcggcagacggcactttctcaaaagaaataccgttgaataaaggggaaaatgtcatcaccgcgaaatcgtcatcggcttccggaacgactgatgcttcagaaccggtccggatcgtccttgaccagaaaaagccgaagcttacaatcgacacgccggaaagcggctcaaaactcaataaagagaccgtcaccgtgaaaggaacagtatcagacgatcacttagaatctgttcatgtaaacggcaaaaaagcagctgttgacaatggcgaatattctgcaaggattatgcttgacaacggcaaaaatgaaatcaaagtaacggcatcggatgcggcaggcaacaaaacgaccaaaaaggtcacggtagatgtcaactttgaagcgccgcaaatcaccggcttgaaaccggccgaagatctcgagctcaaaacgggagaaaccgtgaaaatcgagtttgaaagcgccgctgatttggatgctgtctttgtgatcagaatgccgctgaccaatttcaaaaccgctgcccaaaacgtaacggagctgccgatcagagaagtctcaaaaggaaaatatgaaggatattggaccgctacttcaactgcaaaagcaaaaggagcggaaatcgaggtcatcgtcagagatgattacggcaatgaaacgagacaaacggcaaaaggcaagctgtatatcaatgaaaagctgaaataaaggtgaaaagacgctgtctttaatggcagcgtttttttcgttttacgatcgacaaattcagtacgaaaacttcaaaaaatgtacgatttacgcaacattaattgacagactttacctttgggcttgatttatacttaggaaaacaaacactaaggtcaccgagccgcagaaaggggaaggatgtggaaatctatttagatgcgatatggctgttaaacttttgttttgacttgctgcttttaatgatgaccgcatttattttaaagcgaagggttaaaaagcggaggctgatcctaggggcatttgtcgcgtcaagcatcgttctgtttatgtttacacctttttcaccgtacgtccttcatcctgccggcaaactgtcgttttcggttgtgatcgttcttgtggcatttggttttaagcggttccggttttttttgcagaatttgttttctttttattttgccacttttttaatgggaggagggattatcggagcgcattctttgcttgaaacggattcgatcatggaaaacggcgtctttatgacgaattggtccggttttggagaccccgtcagctggctgtttgtctgtgtgggttttgcggctgtatggctgttttcaaaaaagcgttttgaagatgctgaagcgaagaaaattcaatacgaagaacgcgtccgcctagaggcctgcattggtgaacatacgcttcatttcaccggattgattgactccggaaaccagctctacgatccaatcacaaaaacgcccgtcatgatcgtcaatattgaaaaattgaaagttgtattgggagaagaggcaagtgtgaccatcaaggaaatgagcccgcttgatgccgtcgggaaactggatgaagcactgccgtatatcgggcggatccgcctgattccgtaccgcggggtcggccatcagcatcagtttctgctctgcttaaagccggatcatgtgctcgtttgtacggaaagagaagtgattgaagcgccgaaatgcctgattggcatcagcacatcaccgctttccgctgacggcgaatttgacgccatcgtccatccgaaaatgctggccggaaacccggtcaaacacgtttcttaaacttgaagtctgttacattatcatactcctgaagacgtttatttagaagggggaggaagatgaaaaaactaaaattaaggttaacctatctatggtacaaacttttaatgaaactggggctgaaaagcgacgaaatttattatatcggcggaagcgaggcgcttcccccgccattgtcaaaagatgaagagcaggtgcttctccataagctgcctgacggtgatcaggcggcacgagcgattttgattgaacgaaatctcagactggtcgtgtacatcgcgagaaaatttgaaaatacaggaatcaatatcgaggatttaatctccatcggcacgatcgggctcatcaaagcggtgaatacgtttaatcccgagaaaaaaatcaaactggctacatatgcttccagatgcattgaaaatgaaattttgatgtatttaagaagaaacaataaaatccgttcagaggtatcattcgacgaaccgctgaacatcgattgggacggaaatgagctgcttctctcagatgtgctcggaacagaaaacgacattattacaaaagacatcgaagcaaacgttgacaagaagctgctgaaaaaagcgcttgaacagctcaatgacagagaaaaacagatcatggagctccgtttcgggcttgtcggaggggaagaaaaaacacaaaaagacgttgccgatatgctcgggatctcccagtcatatatttcccgacttgaaaaaagaattattaaaaggctccgaaaagaattcaacaagatggtttaatttttttatgaaatttgaagcattgacagtcaagggttttcggctcgatcttcttatttttggaaattaacgatgcatatttttcccacccgaggagatactgaactttgtacagcagctcctgtagggagggaaaaaagtgtcgaggaataaagttgaaatctgcggggttgatacatcaaaactgcccgtactgaagaacgaagagatgagaaagttattcaagcaaatgcaggatgaaggagacacaacagcgagagaaaagcttgttaacggcaatttgcgccttgtcttaagcgtcattcaaaggtttaacaacagaggagaatatgttgatgacttattccaagtcggctgcatcggactaatgaaatcaattgataattttgacctgagccacaatgttaagttttcaacatatgctgtaccaatgatcatcggagaaatccgcagatatttgcgcgataacaacccgatccgcgtctcacggtcactcagggatatcgcgtacaaggcgctgcaagtgagagaacggctgatcagtgagacaagcagggagccgactgctcaggagatcgctaaagagcttgaagtgtcccatgaagaaatcgtttttgcgcttgacgccattcaagatcctgtatctttgtttgagccgatttacaatgacggaggagatccgatttatgtcatggatcaaatcagcgatgagcgcaacaaggattcgcaatggatcgaagagctcgccttaaaagaaggcatgagacggctgaatgaacgggaaaaaatgatcctcagaaaacgcttcttccaaggcaagacgcaaatggaagtcgctgatgagatcggaatctcccaagcccaggtctcaaggctggaaaaagccgccattaaacaaatgaataagaacattcactaagccgcagtcaatctgcggcttttcacatgctaaaaatggaaaatctctcattcactttattaaatatataagctataataaaagaattatattttaatttatcagaatatttacataaaaaaagggggattttaagtggttctgcagcttgagcatgcttcactaaaacgaaacggagagtggatattaaaggatattgattggacggtggaaaagggggagcactgggcgttatacggattgaacggagccggcaaaaccgcactgctcaatatgctgtgcgcttattattttccgacaataggaaaagtcaccgtgttagggcgcgaattcggaaaaacggagcttggcgagaagcttcggcgaaaaatcggccttgtttcagccgccctgcagcagaagctttatcctgaagacagtgcatttgaaattgttttaagcggcgccttcgcttcgatcggcctttatgaatcgccttcacagtctgtcagagagaaagcggtcgccctcttggaggaattcggctccatccgctatgcggacaggagatatgaaacgctctcccagggagaaaagcaaaaggtgctgatcgcaagggccttgatggccgatcctgagctgctgattctcgacgaacctgtcaccggtctagattttatcgcgagggagcaggtgctggatacggttgaacaaattgccaagaaagacagtgcgccgtccatgctttacgttactcaccatgcagaagaaattctccccgctttcagccaaaccctgctgttaaaaaaaggggaagtgtttgcgttgggaaagacaagagagatgatgtccggcgaggttctgtccgaatttttcgatatgcccgtccaggcggtatggacggaagatcggccgtacttgtccaagaaaaaaactgcaaacctcaatgtttaaagcttcggatgtgtttgggagcctccttctattatggaggctctttttcagctttcatcatcttaaagaagctggtaagataataaagaacgtcatgttttaggggagttcatcattatgatcattcaattcattcgctacagataatgaaaggtatagacaaacgcttagcccatccacacctatggctttaaaaatgccgaaggagcgggtttatttgtctatgcctttttcattgatctaaatacgaatgaatgaggtgtaacaatgatgaataaaaaattaaaaagagcagcgcttatgaaggagcatgaaacgatgtttcagtgcccgctatgcgccgcgaacatggcgatcagcgagttaaaaagccttatatgttcaaacagacatacgtttgatatcgcaaaaggagggtatgtcaatgtcgcgacgcattctccttccgttaagatttatttgaagccagaagaatgttagcagccgccggcttttttgaaccgatgagaggcgcgttgacagaccgtcttaaacaagccggcctgccgttttgcaattttgtcaggatcctcgatgccggctgcggggaaggttcgcatttgacgcgaatcgctgaaacgctagaagcgcgtttcggaacgcctgtccttggagtcgggctggatttggcgaaagccgggattgtatcggcggctaagcaagaaagagaggcgatctggtgtgtcgccgatctggctgccgcaccgtttcggaatcgttcattcgacgcgatcctcaatatattgtcgccttctaattacgcggaattcgagcggctgttatcggatgacggcatcgttttgaaagtgattccgagaagcggccatctgaaagaactgaggagatttttgtacgacggctcggacaaacaagcctatacgagcgaggatacggctgagcgcttcgcgtctcattttgatctgatcgacagaacggagatcgcctacagcaaacgtttagaccgaatccagctcccgccgctcatcaagatgacgcctttatcatggcgcgcgcaaaaggagcggatcaatgcctttctaaagaaggaatccgctgttatgaccgtccatctcgatattttagccggcaggaaaaaaacgaaataaaccactgaaaaggcagtctaaataaaggactgcctttcatataatcttaaaaggacatttgatcagaggaggcgtgcggtggacatgatgaatatttctgatttccagataaaagatgtcgttaacgtatcaaacggaaaaaagctcggcagcatcggcgatatcgatataaatgtaacgacaggcaaaatacaggcgatcgtcatcggaggaacggggaaagttttcggatttttcggaaaagaagaggaaatcgtcattccgtggcgaaatattgttaaaattggagaagatgtgattcttgtgcgtttaagctgatctagcacaatcagatgctgcctgatcaatcggcggacctttatccgcctgcttttttcaaaatgttgtgaacgatgagaacgtctgcaaaagcagggataaatgttgcaaacaatacatttcgtttagttttttgaaacgaaactaaacgaatgcatcaagatgtgttaaaataggagcgatatgatgaaagactacgatgtttgtcgaaaggctgatcaccatgaatacatataacccctttcgtcttgatgctccgtcaatgcttttgattgaggaatggaatcagacggcggaaaccggcggagccgtcacagccggatttacgacaaaaaacggcggagaaagcgaaccgccttttcactcattgaatacagggctgcacgttcaggatcatgaacagcatgtcatcaataacagaaaaaaggttgccgacatcctaaaaacagatctgcacgactgggtatttgctgatcagacgcatgaagaccggattcataaagtgacggatggcgatcgcgccagcggcgctttccgatacgatacggcgctgaaggctacggacggactttatacagacaggccaaacctgtttttggcgctttgctttgccgactgcgttcccgtttatttttacgatccggtccgctcgctggtcggcatcgctcacgcgggctggaaaggcaccgcacttgggatcgccgccagcatggttgacatgtggatcaggcgggaagggtcgaatcccgcagacatccgtgccgtgatcgggcctgcgatcggttcgtgctgctacactgtcgacgatcatgtaatagacaaaatcagaaatcttcctcttcagcaagaagacaaagcctttttgacgataaaagaaggggagtaccgtctcgaattaaaagaagtgaacaggcagctgcttgtacacgccggaattccaaacggccagatcgaagtgagttccctttgtacgagctgcgagcgttcactgtttttctcccatcggagagaccggggaaaaaccggacggatgatgtccttcatcggattaaaggaggtatagcttacaggtggatgtaaaaagcaatttacgacatataaatgacaggatcaacgaagcgtgtatcaaagcgggcagaacgcccgacgaaatatccgtcatcgctgtcacgaaatatgtttccccggaacggcgcagcagcgctggatgcaggaatcaggcatttgggtgaaaaccgtgataccgggctgcttcacaagctcgacgttctgaaagacagcgaaccggtatggcattttatcggaaccctgcagacgagaaaggtaaaagcaatcatcgatcatgtctcatatatccattctttagacaggctttcactggccgatgaaattcaaaagagggcaaaaaaaccgattgactgttttgtccaggtcaacacatcccttgaaccttcaaaacacggcatggcaaaagaagaagttcttccttttgtaaaaaaactgtctggatacgaaaacattcggatcgcgggattaatgacgatggctccttttacggatgatgagaaggcaatcagaagctgttttcgcttgctgagagagctgcgcgacgaggtgcggggccttgatcaatggaacgctccgtgcagcgagctttcgatgggtatgtctaacgactatgcgatcgcagtcgaggaaggcgcgacattcgtcagaatcggatcttccttagtcggaaatgaaactggaggtggacaatcatgagtttgaaaaacaaatttaaaaactttttttccttggatgatgaggaatacgaatacgagtatattgaaacagacagggaggaaatccctgaagagcatgaatcaaaagacagaaccgcctaccagtctaaagcggctgggaagcagaatgtcgtaagtttgcaaagcgttcagaaatcttctaaagtagtgttaagtgagcctcgggtgtacgcggaagcccaggaaatcgcagaccatatcaaaaaccgacgcgccgtcgtcgtgaacctgcagcgcatccagcacgatcaggcgaaaagaatcgttgatttcttgagcggaactgtatatgctctcggcggcgatattcagcggatcggagcggacatctttttatgcacgcctgagaacgtcgatgtttccggcacgatttccgagctcatagaagaagaacatcagaggtggtaaatcgcagatgatcctactttatcaaattttaagcacgcttttaaccgtctattcttttgcgctcattatttacatttttatgtcttgggtgcctaatgcaagggaatcttcattcggccgggtgcttgcttcactttgcgagccttatctcgaaccgttcagaaggatcattcctccgctcgggatgattgatatttctccgattgtggcgattttcgtcctgaaattcgcagatgcagggcttcttgcggttttcagaatgctcggcgctttttaattgagatcatgccgatttcccgtaaggacttgccggcggcagcggcgccgcttttcatgagtgtgccttcaatctttgcgggccgagtatcgggcttggctgtagccaggcctctttacatagaaaggaaagacaatgagcgatatttaccagcatttcagaaaagacgaagagccgtttatcgaccaggctcttgagtggaaaagaatcgtagcggaacagtaccggatgaagctgaccgattttttggatccgcgggaacaggtgatcctgcagtctgtcatcggtcagtcggacgaagtgaggcttgaatttttcggggggttccctgaggctgaacgaaagcgggctgtgctgttccccgaatatgccgagccgtctgccgaagattttcagcttcaagcctgggaagtcatctacccgcaaaaatttgcctccatcgagcatcgcgagcttctcggctcattgatgggcatcggattgaagcgccaaaagttcggcgatctgatcttttcggacggaacatggcagtttatctgttcggaagaagtcgctgattttgttttcacccagctgacacaaatcggcaaggtgaaagtttcccttgaaaaaattccgctttcaaagcttaaagtaccggagcaggatgtcgaaataagggatgatacggtttcatctttgaggcttgatgcgatttgctcggcaatgagcaggcaatcccggcagaaagcacaggttcttgtgaaaaacggcctcgtgaaagtgaactggaaagtcatcgaagacccttcatatgcactggctgaaggggatatggtttcgatccggggatttggccgcttcagaatgaaaaacattgacggcaaaacgaagaagggcaaatggagattgacgtttgaaaaacaaaaatgacgcgttttaacagttttttctccgcccggtcgaattttgctttataatgttgactaggacaagtgtacataaagaaaaaaatggaggtgggcagcatgcctttgacgccaaatgacattcataataaaacatttacgaaagcgttccgcggctatgatgaagatgaagtgaacgaattcctggcccaggtgaggaaggattatgagatcattctgcgcaaaaaaaatgagcttgaaacaaaggtgaacgagcttgacgagcgtctcggccatttttcgaccatcgaagagacgttgaataaatcgatccttgtcgcacaggaagcggcagaagacgtaaagcgcaattccgagaaagaagcgaagctcatcatccgtgaagctgagaaaaacgctgatcggatcattaatgagtctctttcaaaatcgagaaagatcgcgatggaaatcgaagagctgaaaaagcagtcaaaagtgttcagaacccgtttccaaatgctgatcgaagcgcagcttgacctgttgaaaaacgatgactgggatcatttgcttgaatacgaagtagacgcagtaatggatgaaaaggaatagattttcgtttgcaatcttgacataccgtcatctgttcgcatataatacgttcataaattgagtgaaaaacgtttgagagggacagacattgattcctgaaaacaatgaaagcgacccgggggcggtgtaagcccgggattgttggaatcgttgtgtatcagccctcaagtttcctttctgaaccgtccagtaggaaaggacgtcccatcacgttacgatgtttgagcggataagccgaatcggcttgtctaaaagggtggtaccgcgagatcaaagccttctcgtcccttatgggatgaaaaggctttttttgttttagaaaagatgttttggaggaatggtaatggattataaagacacgctcttaatgccgaaaacagattttccgatgagaggaaacctgccgaaccgcgaacctgaaatccaggggaaatgggaggatatggacatttacagcctcgttcagaaacgtaccgaaggccggccgatgttcgtgcttcatgacggaccgccgtatgcgaacggcgatattcatatggggcatgcgcttaacaaagtactgaaggatttcatcgtccgttcgagatcgatgagcggctatcatgcgccgtacgttccgggctgggacacacacggcctgccgattgaaacagcgctcacgaagaacaaaaaagtgaagcgcaaagaaatgacagttgccgaattccgcaaactttgcgaagaatatgcatggcagcaaatcgaaggccaaaaagcgcaatttaagcggctcggtgtcagaggagattgggaaaatccatacgtgacgcttaagcctgagtttgaagcgcagcaaattaaagtattcggcgaaatggcgaaaaaaggctatatttacaaagggaagaagccggtttactggtctccttcaagtgagtctgctctggctgaagcggaaatcgagtaccatgataaacgctctccgtctatctatgttgcatttgatgtaaaggatggaaaaggcgtattaacaaacggcgaaaagattgtcatctggacgacaacgccgtggacaatcccggccaacctcggcatcgccgtacatcctgaactggagtacagcgtcgttgctgccggcggcgcgcgctacgtgatggcaagcgcattgattgaaagcgtggcaaaagcgatcggctttgaagatcatgaagtcgttcagactgttaaaggtaaagatttggaacatatcgtcgcagttcatcctctatacggcagagattcgcttgtgatgctcggcgaacacgtaacaacagatgccggtacaggctgcgttcataccgctccaggacacggggaagacgactttatcatcggtcaaaaatacgggcttgacgtgctttgtccggttgatgaaaaaggacatatgacgagcgaagcccctggttttgaaggactgttttacgatcaggccaacaagccgattacagaacagctcgaagaaaaaggcgctttgctgaagcttgatttcatcactcactcctatccgcacgactggagaacgaaaaaaccgactattttccgtgcaaccgcccaatggttcgcttccatcaaagactttagagacgagcttcttgaagcggttaaaaaaactaaatgggtgcctgaatggggcgagacacgcctctacaatatgatccgcgaccgcggcgactggtgtatttcaagacagcgcgcatggggcgtgccgattccggtattttatgcggaaaacggggagccgatcatcacggacgaaacgatcaaccacgtttctgaactattcagggagcacggttcgaacatttggtttgaaaaagaagcgaatgaactgcttccggaaggctttactcaccctggaagcccgaacggcaagtttacaaaagagcaggacatcatggacgtctggtttgattcaggttcgtctcatcaggccgtactggaagagcgcgaagatcttgtaagacctgccgacttgtatctggaaggatctgaccaataccgcggctggtttaactcatcgatttcgacagcggttgccgtaacaggcaaagcaccttataaaggcgtgctttcgcacggttttgctcttgacggagaaggccgcaaaatgagtaaatcactcggcaatgtcgttgttcctgcaaaaatcatgaaccagttcggggcagatattttaaggctgtgggttgcgtctgtcgactatcaggcagatgtccgcgtgtctgacgcgatcttaaagcaagtcgcagaagtgtaccggaagatccgcaacacgttccgcttccttcacggaaacattgctgattttgacccggcgaaagatgcaatcgctgtggaagatctgagagaagtcgatcagtacattttgatcaaactgaacagcctcattgaaaaagtcaaaaaagcgtatgaagaatacgattttgcggtcatttaccatgctgtccacaacttctgtgcgatcgagctcagctcattctatatggactttgctaaagacgtcgtttatattgaacacgccgatcataaagaccgccgcagcatgcagaccgttttttacgaaacgctgcttgcgcttgtcaagctgatcgcgccgattctgccgcatactgcggacgaaatgtggagccacttcacattcgtatcggaaaaaagcgtgcagcttacagatatgccggaaacaagagacattccgaatgcaaaagagacggaagagaagttcgacagcttcatgaagctgcgcgacgatgttcttaaagcgcttgaaacagcacggaatgaaaagatcatcggaaaatcttcggttgccagcttgacgctgtatccgaatgaagaagctaaagcgctgctttcttcaatcaaggaagacgtcaaacagctgttcatcgtgtcggagcttgccatcggcggaacggaagccgatgcgcctgaggatgcgcagtcgtttgaaacaggaaaaatcgtcgttgctcaggcagaaggcgagacttgcgagcggtgccgcatggtttccaaagaaatcggcgaggatcccgatcatccggaactctgccctcgctgtgctggaattgtgaagacgtattatcaaaattaaccatgaagcggttcggagtttttccgaaccgcttttagcatgccgccaaaccttatcatttgctgtcatgcctgctaagtaaataaaaaggatcggcagctaacctgcttgaacgccgccgccacatcctgtgaaagtccgcagtaaggatgccattgctgacatcgttttgtacgtcaggaaaaatcttttgggcttggataccggcattgtcggtaacactaaggtcacaaacgataagagcaggagttgatgtaggcgtgaacgagcagctggcggcaattcataccgaacttcttcaaatgaaggaagagttggaagcaaggctttttgaatactccttttttcagcaggattctcagggcatcagttcgtatcagcaggcaacacttatgtatcatgtaaaagaagagcttcaggacgtgcttttggccctttcaaaaatcgaaaacggaacatacggcatttgcgaagaaacaaatcaggctattccgctggcaaagatgactattctgccgacggcgcgcactgcgaacgattttttatatcatgcccaatttgaaaaaaagacgcttcctatttgggctgagacggatgaaacgttcaaccgggcgctctactcataacattctgcaagaggggagggcatttgccctcttgcaggatgtcaatgaatattcctttactccttttctttttcttgttaaaatgcttaaatgaagagaaacagaaactggaggaacggtttgtgccttattacataattgcgctgctcattatcggtatcgatcaatttacaaaatggctggtcgtcagcaaaatggagtacggtgaaagcatccccgtcatcgatggcttctttcagattacgtcgcacaggaatacaggtgcggcatggggcattttggccgggcagatgtggtttttttacatcattacgacggtggtgatcatcggcattgtatactacattcaaaaacatgcaaaaggacaaatcctgctcggaatcgctctcggtttgatgcttggcggtgctgtcggcaatttcatcgaccgcgtgttcagacaagaagttgtcgattttatccacgtgacgatcgtcaattatcactatccgattttcaacattgccgattcatctttatgtatcggagtcctgctcttatttatacaaatgctgttagacggaaagaagaagaaggagctgtaacatggagcattatgatatgaccgttcatgaagaacataaaggtgaacggattgacaagtacttgaccgcagttgaagcggattggtcgcggactcaagtacagcagtggattaaagaagaccgtgtgctggttaacggaaatgcggtgaaagccaattataaagttcaggaaggggatgcggtgtcagtccaggttcccgaaccggaaccgctggatgtcacggctgaaccgatggatcttgatatttattatgaggaccaggacgtactggtcgtcaacaagccgcggggaatggtcgttcatccggctcccggccatttgacagggacgctagtcaatggtttgatggcgcattgtgacgacctgtcaggcatcaacggcgtgatgagaccggggatcgtccaccggattgataaggacacttcaggcctgttgatggttgccaaaaacgacatggcgcatgagtcgctcgtgaaccagcttgtcaacaaaacagtaacgagaaaatacaccgcgctcgtccacggcgtcatcccgcatgaccacgggacgatcgacgcgccgatcggcagggataaaaaagacaggcagagtatgacggttacaagggaaaacggaaagcatgccgtcactcattttgaagtaatcgaacggttcgacgattttactgtcgttgaatgccagcttgaaacggggagaacccatcaaattcgcgtgcatatgaaatatatcggctttcctctcgcgggagatccgaaatacggaccgaaaaagacggtcgatttcaacggccaggtgctgcatgcgggcgtattggggtttgaccatccgcgtacgggagaatatgttgaatttgaggcgcctctgcctgacgacatgaaaaacctcctcgacaaaattcgaaataaacgttgacagacgttttcttttttgaaataataaatgcagttaaatcagattctttaacacagtccagagaggctgagaaggataccggacaagcgaatcaatgaattcgtttaaagacccctctctgcctttatgcagaaggggtttttgttttatcctttaaaagatgcgaggtgtttggccatgcaagagcaggaaaaggctgttgtgcttgacgaacaggcgatcagaagggcgctgacaagaatcgcccacgaaatgattgaacgaaacaaaggaatgaacaactgtatccttgtcggaatcaaaacgagaggcatctatctggccaaacggcttgccgaacggattgagcaaatcgaaggaaacaaagtcaccgtaggagagctggacatcaccctttaccgggatgatctctccaaaaaaacgtccaataaagagccgcttgtcaaaggagcggacattccggcggacatcaccgatcaaaaggtgatcctcgtcgatgacgtgctttacacgggacggacggtcagagcggccatggatgcgctcgtcgatgtcgggcggccttcatccatccagcttgcggtgcttgtcgaccgcggccacagagagctgccgatcagagccgactttatcgggaaaaacatcccgacgtcgaaaaccgaaaaggtcatggttcaattggaggaagttgacggacgcgaccttgcggcgatttataaaaagtgaatgataatcctataatccttttttaaatgcattccagtgagtttgcaaagagggatggaacgaaagaaagccgccttaccgtgcggcggtctttgtctgcctctttgcgcaatttaagcaaagaggcttttttaatgggcataattcatttcaggatatgaagacatcatagacagtgagtcgatcatcaggaggaaaaaatatgagtcagaaaaaagtgaaccttggtgtcagagaagtaccaaaacctttgaattggatatctttcagcctgcagcatctgtttgccatgttcggagcgacgatccttgtgccgaagcttgtaggcttaagcccgggcgtggccctcattacaagcgggcttggaacgcttgcgtatctcttgattacaaaaggacagatcccggcttacttaggttcatcctttgcatttattgccccgattatcgcggcaaaagccgccggaggccctggcgcggccatgatcggcgcatttatggcaggcatcgcctacgggctgatcgcccttctcatccagcagcttggaacggactggctgatgaggcttctgccgcctgttgtcgtcggtccggtcattatcgtcatcggactcgggctggcaagcacggctgtcaatatggccatgtatgaagattcgggagcaaaagtgctcgtctacagcgccaagcattttggcgtcgcaggattcacactcgcgctcaccataatctgcgcgattttcttgagaggatttttcagcctgattcctgtcttgatcggaattatcggcggatacttgttcgccctgacccagggaatcgtcgacttccagatggttcttgacgccaaatggtttgctgttccggacttcgtgcttccgtttgtcgactatacgccgagcgcggcggctgtcggaatcggaatcgccatggtgcccgtcgctttcgtgacaatgtcagaacatatcggacaccaaatggtattaagcaaggtcgtcggccaggattttattaagaagcccgggcttcaccgctcgattttcggcgacagcgtcgcaacgatgcttgcatcatgcatcggcggacccccgacaacgacttacggagaaaacatcggcgtactcgccatcacaagagtattcagcgtatttgtcatcggcggagcggctgtcattgcactgtgcttcggatttatcggcaaaatttcggccctgatcagctctgtcccttccgcagtcatgggaggcgtttccttcctgctgttcggtatcatcgcatccagcggactgcgcatgctgatcgataataaaattgacttggaaaacaagcgaaacctgatcatctcatccgtcattctcgtcatcggagtgggcggcgcatttatcaagatctcagggtttgagctgtcaagcatggcgcttgcggcgatcgtcggagtggttttaaaccttgtcctgcctgaatcaaagggagatcaggacggaattgaaatagaagagcatatttaaaaaccttttaaatgaagtccagagaggcttgaaagggttgcggagagagaagtgcaaaaaagcgcattctctgattcactgtaccccaagccgttatggcctggggtttttttacgggaaattaagcctgagggggagaaaaaatgaaacacttgaccgcaatgaatgagcttagtcttgaggatattcacgagctgattgaagaggcgagagagctgaaaaaaggcaagtccgattccgttctctccggaaagttcgctgccaacctgttttttgaaccgagcacaagaacgcgcttcagcttcgaagtggctgaaaagaaactcggcatgaatgtgttgaacctggacggtgtttcaacgagcgtacaaaaaggagaatcgttgtacgataccgtcaagaccctcgaatccatcggcgctgatgtatgtgtgatcagacactctcatgatcattattacgatgaactcatcggacatgtcggcattccggtgatcaatgccggagacggctgcggtcagcatcccactcagtctttgctcgatttgatgacgattcacgaggaatggggcagatttgccggactgacggtatccatacacggagatatcaagcacagcagagtggcaaggtccaatgccgaagtgctgacaagactcggagcaaaggttcttttctcaggtccagacgaatggcgggatgaagacaatccatacgggacatatgtgtcgcctgacgaagcggttgcacattcggatgtcgtgatgcttctccggattcagcacgaacggcatgagaaaaaggcggcagaacgcgattatctcgaaacattcggattgtcgctcaagcgggcggagctcttgaaaaaagacgcggtcatcatgcaccccgcacctgtcaaccgaggcgtcgagattgacagtgcactggtcgaatccggccggtcgaggatttttaaacaaatggaaaacggagtatatatcagaatggcggttttaaaaagagcgcttctaaacggcgaaaacaaaaaaaggggagatcaggcttatgtcttatttaattaaaaacggcttcatgctcgacgaaaaaggcgaaaaagtacagcgcgatatcagggttgaaggcgatgcaatcagcgagatcggaagccttgaggccgcttcgggggaaacggtcatcgatgcggatggacttttcgtctcgccagggcttgttgaccttcacgttcacttcagagagccgggcggcgagaagaaagaaacgatcgaaacaggtgcaaaagccgcagcgagaggcgggtttacaactgtcgccgcaatgccgaatacccggcctgtccccgatacgaaagagcagatggagtggcttgtcaaccgcattgacgaaacggcatcagtgagagtgctgccgtatgcttcaatcaccatcaggcaaacaggtcgggaaatgaccgatttcgaagggctgaaagacgccggcgcgttcgcgtttaccgatgacggcgtcggcgttcaaacggcggggatgatgtatgaagcgatgaaaaaagcggcttcgattaataaagcgatcgtcgctcactgtgaagacaattcactgatctacggcggcagtgtacacgatggggaatttgccaaagccaacggtttaaacgggattccttcggtgtgcgaagcggttcacatcgcaagggatgtgcttcttgccgaagcggcaggctgccattaccacgtctgtcatatcagcacgaaggaatcggtcagggtcgtccgcgacgccaaaaaagcgggaatccgcgtgacggcggaagtgacgccgcaccatctgctcctttcagacagcgacattcccggccttgatacgaattataaaatgaatccgccgcttagaagtccggaagacagggaagcgctccttgaggggcttagagacggaacaattgattttatcgcaacggatcatgccccgcatacagaagaagaaaaacaacagacaatgagccttgcgccttttggaattgtcggcttggagacggcttttccgctcctttacacgcactttgtcaaaacaggcaaatggacgctgaaacagctgcacgattatatgacggtcaaaccttgcgaggcgttcgggctgccgtacgggaagcttgaagccggacggtccgcggatattacgctcattgatcttgaacgcgaagaaaaaattgataaaagcacctttctttctaaagggaaaaacacgccgtttgacggcatcagctgcttcggctggccggctatgacaatggcaaagggaaaactcgtttaccaagaggggagacttgtaaaatgaaaagacgtcttatattagaaaacggaacgatttttgaaggggaagcattcggcagcctggaaaacaccatgggagaagtcgtcttcaacacggggatgacaggctatcaggaaatcctctcagacccgtcatactgcggacaaattgtcaccctgacctaccctttgatcgggaactacgggatcaacagagacgactttgaatccatcaccccttatgtaaaagggtttatcgtaaaggaattatgtcaacttccatcaaactggcgctctgcttatacacttgatgaatatttaaaaatgaaaaacatcccgggactctcagggatagacacgagaaagctgacaagaatgatcagaacggcaggtacgctgaaaggggtatttgccggccctgaagaagatgctggggctttggttcaaaagctgaaagaaacgaaccttccgaccgatcaggtcagccaagtatcaacaaaaacggcatatccgagccctgggagagggaagcgaatcgtgctcgtcgatttcggaatgaaacacggcatcttaagggagctgaacaagcgcaaatgcgatgtgatcgtcgttccccacaatataacggcagaagaagtgatgcagctgaagcctgacggcgtaatgctgtcaaacggacccggagatccaacggacgtaccggaagcgattgcgatgatccaaaacattctcggcaaggttccgctgttcggcatctgtctcggccatcagctgtttgccctcgcctgtggagcaaagacggagaaaatgaagttcggacaccgcggttccaaccatccggttaaagagcttgaaaccggcagagtatcaattacggctcaaaaccacggctataccgtatcgtctgttgaaaacacgccgcttgaagtgacccatgtggcgataaacgacgacacaatcgaagggcttaaacataaacacgaaccggcttttacggttcaataccatcctgaagcttcaccggggccggaagacgcaaaccatttatttgatcaatttttagacatgattgaaaccacagagaaagaaggggaagcggtatgcctaaacgcgtagatatcaaaaagattttggtgatcggatcggggccgattattatcgggcaggcggcggaatttgattatgcaggcacacaggcctgcctcgctttaaaagaagaaggctatgaagttattctcgtcaactcgaatccggcgacgatcatgacggatacggaaatggccgaccgcgtgtatatcgaaccgctgacgcttgaattcttaacacggatcatccgcaaagagcggccggacgccatattgccgacattgggcgggcagacgggcctcaacttggcggtcgaactgtcagagcacggcatcttggctgagtgcggcgtcgaagtgctcggcacgaaattgtcggcgatccaaaaagcggaggaccgcgatttgttcagaagcttgatgaatgagttgaatgagcctgttccggaaagcgagatcatccactcgctcggcgaagcgcgcgagtttgtcgagcgcatcggtttccccgtcatcgtcaggccggcatacacgcttggcggaacaggcggaggcatctgctcaaacgaagacgagctgaaggaaatcgttgaaaacggcttaaaaatgagcccggttcatcaatgcctgcttgaaaagagcatcgccggctacaaagaaatcgagtatgaagtcatgagagactcgagcgaccatgcgatcgtcgtctgcaatatggaaaacatcgatccggtcgggattcataccggggacagcatcgttgtagcaccgagccaaacgctgagcgaccgcgaataccaaatgcttcgcaatgtctcgctgaaaatcatccgcgcgcttgaaatcgaaggcggctgtaatgttcagctggcgcttgacccggacagctttcagtactacatcatcgaggttaacccgcgggtcagccgttcttctgcgcttgcctcaaaagcgacgggctatccaatcgcaaagcttgccgcaaaaatcgctgtcggtttgtctcttgacgaaatgatgaatcctgttacaggaaaaacgtacgcgtctttcgaacctgcactcgactatgttgtgtcaaaaataccgcgctggccgtttgacaaatttgaatcagcaaaccgcaggctcggcacgcagatgaaagcgacaggcgaagtgatggcgatcggaagaacgtgggaggaatctctcctgaaagcggtccgttctcttgaagcggatgtctaccatctggaactgaaagatgccggtgagatctcgaatgaagtgcttgaaaaacggattaaaaaagcgggagacgaacggctcttttacctggccgaagcgttcagaagaggatacacagtcagcgacctccacgaattttcggcaattgacctgttcttcctccacaagcttgagggaatcatccgctttgaagagaagctgaaagccggacgcggcgacctcggccttttaaaagaagcgaaagagctcggcttttcagaccgctttatcagccttctctgggagatgcctgaacgaaagctttatgatcttagaaaagaagcaggcatcacgcctgtttataaaatggttgatacatgcgcggccgaatttgaatcggagacgccgtatttctacagcacgtatgaagaagaaaacgaatcggtcagaacggacaaaaacagcgtcatcgttcttggctccggtccgatccggatcggccagggggtcgaattcgactatgcgaccgtgcattcggtctgggcgattaaagaagccggctatgaagccattattatcaacaacaatcctgagacggtttcaacagacttcagcatatccgacaagctctactttgagccgcttactgttgaagatgtcatgcatatcatcgatttggagcagccgaaaggcgtcgtcgttcagtttggcggacagactgcgatcaaccttgccgacgagctcgcagaaaggggcgtcgccattctcggaacatcccttgaagatttggaccgcgccgaggaccgcgacaagttcgaacagacgcttgaaatgctgcaggtaccccagccgcttggaaaaacggcgacatctgtggaaggcgccgttgaaatcgcagccaatatcggctatccggtgcttgtccgcccatcgtatgtactcggcggacgtgcgatggagatcgtctaccatgaagcagagcttctccattatatggaaaatgcagtaaaaatcaatccgcagcaccctgtcctgatcgataaatatttgaccggaaaagaaatagaagtggatgccatttctgacggtgaaacggtcgtcattccggggattatggagcacatcgaacgggcgggcgtccactcgggggattcgattgccgtttacccgccgcaatccctttcagaggacatcaagaaaaagcttgaagcatacacgattaagctagcaaagggcttaaacatcgtcggcctgctcaacattcagtttgtcctttcaaaagatgaggtttacgtccttgaagtcaacccgagatcgagccgaacggtgccgtttctcagcaaaatcaccggcattccgatggccaatctcgcaacaaaggtgattctcggagggaagcttgccgatatgggctatacagaaggcctccaaaaagagcaggaaggcgtatatgtgaaagtgccggtcttctcgtttgcgaagcttagaagagtggatatcacgctcggaccggaaatgaaatcgaccggggaagtcatgggcaaagacagcacattggaaaaagcgctatataaaggactgatcgcttcaggcattcaaattccgaactacggctctgttctcctgacagttgctgataaagataaagaggaagggctgttgatcgccaagcggttccatgcgatcggctataaaatcttggctacggaaggaacggcaggctatttaagagatgcatccgtacctgttaaaaccgtcgggaaaatcggcgaagaaggtacaaatctccttgatgtcattcgaaacggggaggcgcagttcgtcgtcaatacgctgacaaaagggaagcagccggcaagggacggcttcagaatcagacgcgaatccgttgaaaacggcgttgcctgcctgacatcccttgatacggcggaagcgattttgcgggtgcttgaaagcatgagcttccgcgccgatcatatgccggcgattaaaatcgcccaaaaggcggccgtcagatgagaaaagggtatatgacagtccgttcaaacaagtgcatcgcggatcatatttatcaaatggtgcttgaaggggagattgccgaagtttgcggcgctcccggccagttccttcacatcaaggtctcagactccctcacgccgcttttgaggcggccgatcagcatcgctgatatcaacaaagccgcccggcaggtgaccatcatctttcgcaaagatggggaaggaacgagactcctttctttaaaacaggaaggagatcagctcgatgttctcggtccgctcggcaacggttttccggctgaatcgcttgaacaggggaaaacggctcttctcgtcggaggagggatcggtgttccgccgctttacgagctgagcaaacagctgacaaacagaggggtgcacgcgatccatgtgttaggatttgcttctgcaaaagatgtcttttacgaacaggaattcagccgtttcggccgggtgtatgtggcaaccgcagacggcacccgcggttcaaagggatttgttacagatgtcattgaaaacgaggggcttcagtttgactgcataatggcctgcggaccgacgccgatgctgaaagctttaaaacagcgctatccggataaagaggtatatctgtcaatggaggagcgcatgggatgcgggatcggcgcttgctttgcctgtgtctgccatacggaagaaagcgaaacgtcttatgtgaaggtatgccttgacggtcctgttttcaaagcccaggaggtgctgttatgatgcttgaaatcaatttgccgggccttcaattgaaaaatccgatcatgccggcctcaggctgcttcggattcgggagagaatttgcgaacttttacgatctttcgcgtctcggtgcgatcatgattaaagcgacgacgagcgagccgcgcttcgggaatccgacgccgcgcgtcgccgagacgcaagccggcatgcttaatgccatcggcctgcaaaatccgggtttaaaggctgtcatggaacgcgaattgccgtggctcgaacagttcgatacaccgattatcgccaatgtcgccggctcgcagatcgaggattatgttgaggtggctgaagaaatcagcaaagcgccaaacgttcatgcgctcgagctgaatatttcctgtcccaatgtgaaaaccggaggcatcgccttcggcacgcagccggaaatggccggcgagctgacgaaagcggtgaaagaggttgcgagcgtccccgtctatgtgaagctgtcgccgaacgtcgcgaacattaccgacatcgctcttgccatagaagaagcgggagcggacggtttgacgatgatcaacacgctgatcgggatgcggctcgacttaaaaacgggaaagccgattttggcgaacaaaaccggcggattatcaggacctgccgttaaaccggtggccatcagaatggtgcatgaagtcagccaaaaggtcagcattccgatcatcggcatgggcggcgtccagtcagccgaagatgtgcttgagtttttgctggcgggtgcgagcgcagtcgccgtcggcacggcaaacttcgttaatccgtttgcttgtcccgacatcatcgacgatttgccgcgcgttttagaaaaatacggataccgttcgttgaacgagtgtatcggaaggagctggaaggatgaacaatacgccgcccatcatcgcgcttgattttgcatcagcacaggaaacatatgcgtttttggaccggtttcaaggagaagagctgttcgttaaggtgggcatggagcttttttatcaggaaggacctgccatccttgaaaatctgcaggagcgcggctgccgcattttcctcgatctaaagtgccacgacattccaacgaccgtatacaaggcgatgaaaaggctggcgggatttggcgtcagtcttgtcaatgtgcacgcagcaggcggaaagcaaatgatggagtcggcgcttgaaggccttgaagcggggactccggcaggccaaaaacgcccttcattaattgccgtgactcagctgacaagcacgtcctcagaaatgcttcagcgtgagctcctgattgaaacgccgcttctcgatacagttgtccactacagccggctggctgaagaaagcggtcttgacggcgtcgtctgctccgttcatgaagccgaacacatttaccgggctgtgtctgtagattttctgaccgtgacacccggaattcgcatggcagatgacaaaaacaacgaccaggtccgggtggcgacgcctggctacgcaagggaaaaaggcgtgtcggcgatcgttgtcggccgttcgattacccaggcggaagatcctgtgtcagcctacagaagaataggacatgagtgggagggaaccaaggcatgaaaacagacattgcaaaccatttattaaaaatcaaagcggttttcctgcgcccgaacgaaccgtttacatgggcgagcggcattctgtcgcccatctactgcgacaaccgtttgacgctttcatatccggaagtaagagatgatatcgcttcagggcttgccggactgattcaagacaaatttcccggagccgagatgatcgccggtacagcgaccgcgggaatccctcatgccgcgcttgccgctgacaggctgagcctgccgatgtgctacgtcagaagcaaaccgaaggcgcacggcaaaggaaaccaaattgaaggggccgttgtaaaaggacagaaagtcgttgtgatcgaagatttaatttcaacgggaggaagcgttcttgaagccgccgccgccctcacagaggcgggatgtgaagtgctcggcgtcgccgccattttcacttacgggcttccaaaagccgccgccgccttcagcgaagcaggcgttgaataccacacgctgactgattacgatacgctgaccgaggctgcgcttgccggtggatatattactgaacaggatgccgccaaactgaaagaatggaaagcggatcctgaaagcaagtcttggatgaactgatgatcaaagccgtattctccaaatgggagaacggcttttttgcgcctttttgccgtttttaaaatagtaaaatcggattatttttattttttattaatcctataaaaaaagtcgggttgacttttattcgaattgtgctaaaattttaaaataacaaaagcaaacttatcaagagcggtggagggactggtccgatgaaacccggcaacctgcgtgtgaagcgtaaggtgctacttccagcaaaatgccctcattttgagagataaggaatagcggagttcctcgtctttctttcaaaattggaagaaagattttaattttttaggggcagaggaggagctagaagtgaagacagatgaacagcttgaaaaggtgatcatcaaaatgaaagacatgctgaaagacatgaattacggatcgatcacattcgttgttcaggacggcaaagtcattcaaatcgaaaaaaatgaaaaaataagattgaaatagctgactagacaaactagaggcggttttcacagtttttttttctgctggaagccgtttttttgttggcgaaaaaagggggaaccgaaaatttttacttacagcacatgggaggaaccaaacatctcttttcaggaagatgactcttataaaggagcgctgtccgtcctgaaatgggcgtacggacattacggggatcagctcgtatacgcgtgcagcttcggaattgaggggatcgtcctgatcgatttgatttataaggtgaaaaaagatgcagttatcgtttttcttgatacagggcttcattttaaagaaacgtatgaaacgatcgacgccgtcaaagaacgatatccaggccttcagattatcatgaaaaaaccggagcttaccgtcgaagagcaggcgaaagaatatggggacgaactatggaagaccgctccgaattcctgctgcgaaatgaggaaggtcatccctctccgcgagacgctttcaggctacccggcgtggctgtctggtctgcgccgcgagcaatcgcccggacggagcaaaacgaattttttgaacaaagatgaaaaattcaagtctatcaaagtttgtccgctcattcattggacgtggaaggatatttggagatatgtgacaaagcacgatctcccatacaatccgcttcatgatcaaggctatccgagcatcggctgcgctccgtgcacctctccggcctttacaatggatgatcttcgatccggccgctggaacggatcggctaaaacagaatgcggattacacgagtaaggagatgagtcatggaacttgccgccattttatttagcatgttttttgcgatgaatatcggagcgagcggtgcagctgcttcaatggggatcgcctatggatctgaagctgtcaaaaagaagtttcacgccctcctgatctgtgcagcgggcgttctctcgggcgctgtcatcggcggaggaaacgtcgtgaaaacgatcagttcaggcatcattcccgaacgggtgatttcgcttgaaatcgtctgcattattatcggatcagcggcgctgtcgctctttatcgcaaatgtactcggcattccgctttcgacaagtgaagtgacagtcggatctgttgtcggagtaggtgtcgcataccaggttttgtatgtcaaatctttgcttgtcatcgtctcattttgggtcattgtaccaatcgtcgcttttgcatttacatttgcgatggcaaaaatcatgaaaaaaacgatcaaacgtccagcctcgggaaaaaaagcaaaggttttggcggtcattctattgatcacagggttttttgaagccttctcagcgggcatgaacaatgtcgcaaacgctgtcggacctctggtggcggcgcatgttttgacagtcggggaaggaacgctctacggcgggctgtttgtcgcgctgggcgcccttttactgggcaggcgcgttcttgaaacaaacggcaaaaagattacgaggttttcaaaaggagagggaatcatcctttccggaacgggggccgggcttgtcattaccagttcaattttcggtttaccggttccgcttgcgcaagtcacatcatcttctattatagggatgggaatggcaaaaaacggcggcaacgtctttcataaacaagtggtcaaaacgatgctgaaagtatgggtcgtctcgccgttcctttcattaagcctatcttatatgctggtcagccttttattaaaaggagactactacgctcttattgttgtcacaagcgttctgctggcatctgtcggaacgatcagcctgatgagagcggtcaaaaaagagcacagctccgtccatgaacaaggcggaggaatttaaacacaaagtagggggaaacaagtttatgagtttagcaccacacggcggtgtattggttaaccgcgtcaatgaagcatacgattttcaacatatcgcacatgaaattgagcttgatgtaatggctttttcagatttggagctgatcggaatcggtgcgtacagcccgctccaaggctttatgacagagaaagactatctgtccgttttcgaaaatatgagactatcaagcggcgaagtatggacgcttccgatcactctgcctgttgacgagcaaaaagctttaagcttaaaagcgggtgacaccgtccgccttacctataatggggaaacctacggcgtcattgagatcgaagatatctatacgccggacaagaaaacggaagccgtcaatatctataaaaccgacgaactcgaacatccgggcgtcaaaaaattgtttgaccgcggcagcgtttatgtgggcgggccgatcacgctcattaagcggagtgtaaaacaattcccggcgcacacattcgaacctcttgaaacaagaaaaaaattcgcggaactcggctggaaaacgatcgtcggattccagacgagaaatccggttcacagagcgcacgaatacattcaaaaaacggcgctcgagacggtagacggccttttcctcaatccgctcgtcggggaaacaaaatcagacgatattccggctgatgtccgcatggaaagctatcaggtgctgcttgacggctactatccgaaagaccgcgtcttcctcggcgtttttccggcggcgatgcgctatgcggggccgaaggaagcgatcttccatgcccttgtgagaaagaactacggatgcacgcactttatcgtcggaagagaccatgccggagtcggcgattactacggcacatatgaagcgcaggagctgttcgatcagttcgcgccggaagaaatcggcattacgccgctgaaattcgaacacagcttctactgcaatgtctgcggttcaatggctacggcgaaaacgtgccctcacggcaaagaacatcatgtcattttatccggcacaaaggtgagggcgatgctgagaagcggcgagttcccgccgagcacattcagccgtcccgaagttattcaaacattaatcaaaggcttagcggccggggtttcttaagggggagcatctcttggtaaataaagatattgtctggcatgaagcgtccattacaaaacgggaatatcatgagaaaaatcaacataaaagctcaatcatttggctgacgggcttaagcggttcaggaaaatcaacgattgccaacgccgctgcgcgtgagttgtttgcacaaggctaccaggtcacggtgcttgacggcgacaacgtcaggcacgggctgaacaaggacctcgggttttccgatgaagaccggaaggaaaacatccgccggatcggcgaggttgcgaagctctttgtcgaacaggggacgatcgtcattacggcgttcatttctccttttaaagaagatcgcgggcttgtcagacagcttgtcgaggaagatgagtttcacgaagtctatgtgaaatgcgatttggcgacgtgtgaagagcgcgacccgaaaggcttgtacaaaaaagcgagaaacggagaaattccatttttcacagggatcgattcgccttatgaagagcctgaaacgcctgagcttgttcttgatacaggcgcacataaccgggaagagtgcaaaaaccagctcgtccaatacgtgaaagatcaaacgaaataaaatgcgggtgaataggaaagtgcggcgcatgcactttcctatttcataaagaaaacgtttggtttttgtgatattttcaggcaccaaacgctttctttatgatttataatgaattgaagaagacgttgatcagatcggggggagatctaagatggggaaagtatatatcgttggggcaggtcctggagaccccgatttactgacgatcaaagctttaaaagccatccagacagccgatgtcattttgtatgacaggcttgtgaataaacagattttacagcacgccaaggagggagcggatctcatctactgcggaaagcttccggactaccacatgatgaagcaggaaacgatcaatcattttctcgtcaagtatgcgaaaaaagggaaaaccgttgtcagactgaaaggcggcgatcctttcgtattcggcagaggcggcgaggaagcgcaaaccctcgctgagcacggggttgcttttgaaatcgtgccgggaatcacctcgggaatagctgccgctgcttatgcgggcattccggtgacacaccgggaagcgagttcaaacgttgctttcgtgacaggccattatcaaaaagaagaaaactttgaagagaagtggaaagcgttagccacagggatcgatacgcttgtcatttatatggggattaaaaacgtgaagcaaattgaaaggcttctgatcgaaaacggcagagacccgtcaacgccagccgctttcatccattggggaacgacagacaaacaaaaaacggtgctttgcacggttgaaacgcttgccggtacagtcgaaagcgaaaagattgaaaacccgagcctgattgtcatcggggatgtcgttcaattcagctcgcagttaagctggtttgaacctgagctgaaagatccggcattaagcgaggcgctttaatatgaaacaagcgattttatatatcggccatggaagccgtctgaaaagagcccaaacagaagcagccgcttttttggagagctgcaaagaaaacatgtccgcccccattcaggaaatatcttttttggaattggcggcaccggatatcgaaaccggctttaaagcgtgtgtggaaaagggggcgacgcatatcgcggccgtgccgcttctcctcttgacagccgcacatgccaaaagggacatccctgaagagcttgcccgtgcttcctcacagtacccttccgtcagcgtcgcttacggaaagccgatcggcgtcgatcaggaagtcgtcaaagcggtttttacaaggatcgaagaaacggggacgccatatgaacatgcaagagtcgtgttgatcggaaggggaagctctgatccggatgtcaaacgggatgtttatgatatttgcgaacggctgagagacctcacaccagtggatgaggtcattccctgctttatgacagcctgtgagccgcactacctggatgtgtttaaacagcttaaagaacgggacggaaaaacgacattcatcgttccgtatctgctgttcaccggtatgctgatgaacgagattgaaagggaaaccgcaaagctgaaagaaacgaatccgaatgtcgtgctgacggattacctcggcttccacccccatgtaaaaaacgcctttttgcaccgcgtagaggaagcggttatcaacaaagccggccgctttgattttacaggagcatcagatgctgccgctgcacattaacatgaaaggcaaagccgcagtcattgcgggcggggggaagattgcggcgcggcggctgaaaacggtgctggcagaaggtgcatccgcgaccgtcatcagccctgaagcatcagaagagatgctcggattgattaacgaacacggcatcgaatggaagaagaaaaaggcggaacccggtgatttcaagaatgcatttctgatcattcttgcgaccgatgaccatgaggcaaacaagcgtctcgccgcatcggcagctcctgagcagctcgtcaatgttgcgagtgaagcggagctgggaaatgtatatgttccaaaaataatcaacagaggaaacataaccatatccgtctcaacaaacggagccagcccgcgccacacgatcaggctggccggacagatcgatgatttgatcgatgatgagctcgtccaagagatcgacgagcttttccgaaaaagaagaggcctgaacccttgaggttcaggcttttggcattattattttttcagcttgatgatcaagtcttcatcaggtgttacaaaaacggtttgctggctgtcgtaggtgacaaaccccggttttgcgccattcggttttttgacgtggcgtatttttgtatagtcgacgggaaccgaagcggagtttttcgctttgctgtaatatgcagcgatctgcgccgcttccagaatggtttgctcgtccggatcggtcgattgaatgacgacgtgcgaccccggaatatcttttgtgtgaagccagatgtggtcgcgggcggcaagcttcatcgttaaatattcgttctgcttgttgtttttgccgacgagaatcgtttctcctgagctggactcatatgcttcgagcgtcggcgcctgttttttctgtttcttctggcccccttgctgcttggcccgcaagtattttccttcggcgagctcttcgcgaatttcggttatatctttcggtgaggcagatgaaagctgctgaatcagctggtcgaaataagcgatttcctcttctgccaatttgatctgctccttcacgacttctaccgaatttttcgctttttgatattttgtaaaatagctttgtgcattttcagaaggcgttttattaggattgagcggaatcgtgatttctccgccgttttcatcatagtagttgatgaccttcgcctctttgtccccttttttcagctggtacaggttcgctgtcaacagctctccgtacagctgatagtcttgcgcgtgttcggactgctcaagcgtttttttcagctttttgattttattttcgttctttttcttttcgtttgccgcgaaacgctctaaatcgtgagcctgctgtttgacgcggtcacgctccgcttttccgaaatagtagcggtcaagaagttcgctcagcgtatgaaagggcctgttgtctccttttatatgggtcagctcaagaaggtaaaaatattcttttccgtcttctgtggtgacaagctggggctgaaaacgccggcttttgatttcgctgaacatctccgtcaagacgtttggcagtgtcgccctgttggctagacccgcgcgaaagacggcttccttcgcaaacagaggcgagacgccggagaaggtatcgacgatctgcctgtcaagtttgccttcctggaaattcagatggcggagaatatcttcagtctccgcttcaagcggagacaatttgttctgcgcgggagggagaatgtaatcgtatcccgggagcacggtgcggtagctgttcatcgcaggtgacagatgcttcaaactgtcgatgatgacgtctttttctccgtctgttaacacgatgttgctgtgcctgcccatgatttcgaccatcagctttcttgtcagcgtgtcgccgatttcgttccggctcctgatatgaaagaccatcattctgtccatgccgatttgctcgacttggtcgataaagccgccttccagatgtttgcggaggagcatgcagaacatcggaggggtgctcgggttgtcgtaggtttcgtttgtcaggtgtacccgcgcataactcggatgggcggagagcagcaatttgcggttcttcccgtttgccctgatatgaaacactagctcgtgcttaaacggctggtggatttttgcgatccgtccgcctcgaatcgcctcatttaattcctcgatcattccgtatgtaaaaatgccgtcaaaagacatatgaaaaactcccttttctcgttaatcctcttcgtaaaacgtccattcaataattatagcatgatttgggacgagtctgaataaattgacttatagagatggatacaccaaaagcaacctttagggcaggaggagtggacgattcaatgaaatggcacgagatgggacaaaccgaattgttaaatataacaaaaacgtccatcgacaaaggtctaacagaaaaagaggccggaaagcggctggaaagacacggaacaaacgaacttcaggaaggggaaaaaacatcggcggtcgcattgtttttttctcaattcaaagatttcatggttcttgttttgcttgcggccacgttgatttcgggtttcctcggcgaatacattgacgccatcgcgatcatcgcgatcatctttgttaacggcattctcggattctttcaggagaggcgggcggaaaggtcgctcgaggctttgaaagaactgtcagctcctcaagtggctgtgctccgggaggggaattgggtgaaaattccttccaaagagcttgtcccgggagatgttgtccgttttgcaagcggagacagaatcggcgccgatctcagacttgtcgagacaaagagccttgaaatagaagaatcggcccttacaggtgaatcgctccccgtgtccaaacaggcagatgcttttcaggcgtcagatgtatcgctgggcgatctgaagaatatggctttcatgggaacgcttgtcacaagggggagcggaatcggcgtcgtcatcggtacgggtatgaactctgcgatggggaaaatcgccgatatgcttgaatctgccgggaatacggcgaccccgctgcaaagaaggcttgaagagctcggcaaaattttgattgtcgccgctttgttcctgacactgcttgtcgttgctgccggcgtcattcaggggcatgatttatacagcatgtttttagcgggagtttcccttgccgtcgctgccatacctgaagggctgcctgccattgtcacggtcgctctgtctctcggcgtgcagcggatgatcaggcaaaagtcgatcgtcaggaagctgcccgcggttgagacgctcggctgcgcgtccattatttgctccgataaaaccgggacgatgacgcagaacaaaatgacggtcacccatgtctggtcaggcgggaagatatggaacgtgtcagggatcggctatgagcctgaaggctctttcagcatgaacgggcgcgatgtgcaagcaaagcatcataaaccgctccagcaggtactattgttcggcgcattatgcaattcatcttcgattatcgaaaaagacggggagtttcgtcttgatggcgatcccaccgaaggggctttgctgacggcggctcgaaaagcaggctttacggacaaatatgttgatgaacattttaaaatcatcgaggagtttccgtttgattcaacgcggaaaatgatgtctgtcattgtggaagacaagagcggcaagcgctttgtcattacaaagggcgcgccggatgtattgatgaagcgttcgtcgcatacgctgacagaagaaaagcgagaaatcttcacaaaggaaaggctcgctgaaacaagcgcggcgctggaaactcttgcgtcacaggcgctgagaacgattgccgtcgcgtataaaccgatcaaagatacagaaaatcccccgctcgaaaaagcggagtcaggcttaactttcatcgggctgttagggatgatcgatccgccgcggcccgaagtgaaaacagcgattaaagaatgccgggaagcggggatcaaaacggtcatgatcaccggggaccatgtgataacggcgacggcgattgcaaaagatctcggattgctgcctccgcgcggaaaggtcatggacggccagatgctgaacgaactctcgcaggaagaattggcggaaattgttgacgatgtttacgtatttgcaagggtgtcgcccgaacataagctgaagatcgtgaccgcctaccaggaaaacggccacatcgtcgccatgacgggagacggagtcaatgatgcccctgcgattaaacaggcggatatcggcatatcgatggggattacgggaacggatgtcgccaaggaggcgtcctcactcatccttgtcgatgataattttgcaacgattaaatcggccatcaaggaaggacgcaatatctatgaaaatattagaaagttcatcagatacttgctcgcatccaatgtcggcgaaattttggtcatgctgtttgcaatgctgctcgctctgccgctgccgcttgtcccgatacagattctgtgggtcaaccttgtaacggacggcctgcctgccatggcgctcggcatggatcagcctgaggacgatgtgatgcagagaaagccgcggagtccgaaagaaggcgtgtttgcaagggggctcggctggaaggtcgtatcgcgcggattcttaatcggaatcgcgacactcggggcgtttatgttcatttataaccgcaatccagaagcgcttgagtatgcacagacggttgcatttgcaacgctcgtccttgcgcagctgatccacgtgttcgactgccgaagcgagcggtccatctttgaccgcaatccgtttgaaaacatttatttgctcggtgcagtgctgtcttcgattcttttgatgcttgtcgttatttattatccgccgctgcagccgatttttcatacggttccgattttaatggcagactggctcctgattgtcggaatgtcggcgattccaacttttttactggccgggtcacttttgacaagaaaaaaataggcttgtatgatataatcttaaaggtaatagaggtttctattgccttttcatcttgcgtaaatttaaatcaaagaaagtctttttcacttatacggaattgggtgtgttttatgatacggagtatgaccggtttcggcagcgcgagcaaaacgaaggatgggctgacagcagctgttgagctgaaatctgtcaactatcggtttaaagaagtaaacgcccgcatgccaagacctttgctctatttagaagacaaaataaagcaaacgatttttaaacatatacaaagggggcggctggagctgtttgtttccgttgacgacgaggctctggtcacccggaaaatccaggttgactggccgctgcttgaagagtaccagaaagccgcgcgcgaaatgaaagaccgctgcgggctttctggagacatcacgcttcaagacgcctttcagtttgagcatgtcatccaagttgaagaagagccaatccaaaatgacaagcttgaagaggttcttctggaagcggtcgaggctgccgttctagaattgtgcagcatgcgcgaagcggaagggctgaggctgaaggacgactgccttcagcatattgaaaggcttgaaaagctgacagacgacatcgcagagcttgctcccaaggtcgtcgaccactatcgggaacgccttgaggcgcggcttgaagaatggtcaacagacggtctcgatgaaagccgcctgctgacggaagtcgcactgtttgcagaccgttcggatatcacggaagaagtgacgaggctgaaaagccatttccgccagttccgcgatatttgcaaagcgggaggagccgcggggagaaagctcgatttcctcgtccaggagctcaaccgtgaagcgaacacgatcggttcaaaagcgaatgatcaccagatcacaaaacatgtggtcgaaatgaaaagctctattgaaaaaataaaagaacaagtgcaaaatatagaatagcgattgtgcgtattgtttacggatgttctctgcaggttaaactagagacgtccaagtacagggggaacgtataggatgacgattaaactgatcaatatcggctttggaaatatcatatccgcgaatcggctgatctcgattgtgagtcctgagtccgcgcctattaagcggatgatccaggatgccagagaccgcggcatgcttatagatgctacatatggaagaagaacccgtgcggttgtcattatggacagtgaccatatcatcttatctgccgtccagcctgagacagtagcacaaaggctttccgttaaagaagaaattatggatgaagggcagggataagagctttatgaaagaaagaggtttgttaatcgttctctccggcccttccggcgtcggaaaaggaacagtcaggcaggcgctgtttgctcaggaggacacaaaatttgaatattcgatttcggtgacgacaagaaaaccgcgtcaaggcgaaagagacggcgtcgactacttttttaagacgcgcgaagagttcgaagagatgatcgagaacaacaagctgctcgaatgggccgaatatgtcggcaactattacggaacacccgttgactacgtcgaacagacgcttgaaagcggaagggacgtttttcttgaaatcgaagtccagggtgcgctgcaagtcagaaaggcatttcctgaaggcttgtttatctttttggcgcctccgagcctcgccgaattgaaaaaccggattgtcacaagagggacagaaacagaagccacgatcgaaaaccggatgaaagcggcgaaggaagaaatcgaactgatggacgcctatgactatgttgtcgaaaatgacagcattgagcttgcgtgcgaaagaatcaaagcaatcgttctcgccgaacatttacggcgcgaccgagttgctccaagatataagaaaatgctggaggttgaataaatatgctagatccgtcaattgactctttaatgaacaaactggattcaaaatacacgctcgttaccgtatccgcacggcgcgcccgcgaaatgcagatgaacaaagacgcgcagatcgaaaatccgaagtcgcataaatttgtaggcaaagcattggaagaaattgatgccggactgcttacattcgaaaaggaaaatcgctaatagccttaaaaatagcaacctatacactaggttgttatttttttcagggctggcgaacagaacataagggggagaaatacgatgctgaaaaatcgcaacatcctgctgggagtaagcggaggaatcgcggtatacaaagcggccgccttaacgagcaagctcgtgcaggcaggagccaatgtgaaagtcatcatgacaaaatccgcctgtgaatttgtgtctccgctcacctttcaggcgctttcgcgcaatgaagtatataccaatacgttcgaagaaccgaatccccgtgtcatcgcccatatcgatgccgcagattgggcggatctcgtgatcgttgctccggctacggccaatgtgatcggaaaactcgcctcaggcatcgctgacgacatgctgacgacgacgcttttggcgacgacagcgccggtgtggatcgctccggcgatgaacgttcatatgtacgaccacccggccgttcagcggaacatcagcgttctttacaaagacggctaccggtttatcgaaccgagtgaaggctaccttgcgtgcggctatatcggcaaaggcagactggaagagcctgagcggatcgtccagttggcagagtcgtatttttcaagcgaaaaaagcggtttgcttgaaggaaagcgcgtcgtaattacagcggggccgacaagagaacaagtcgatcccgtccgctttttctccaaccgttcgacagggaaaatgggctatgctttcgctgaggaagcggcacgaatgggagcgcacgtgacgctgattgcaggcccgacatcgcttgatgatcccgcaggggtcgacgtgattcatgttcagtccgcagaagatatgtatcaagcggctctgtctgttttcgatgagagcgacatcgtcattaaaacagcagctgtcgctgattacaggccaaaacatgtccacgatcaaaaaatgaagaaaaaggacggcggcctcgtcattgagcttgaacggacgaaggatattttaaaagcgctgggagagcggaaaacaaagcaaatcttggtcggctttgcagccgaaacgcagcacgtcgaagactatgccaaacaaaagctggagacgaaaaatctcgatatgattgtcgctaacaatatcacggctgaaggcgccggttttggaacggaaaccaacatcgtgacggtgtttcatcgagactgcaaaaagacggcgcatcctctaatgtcaaagcgggaggttgccgccgcagtcttgaaggaagccgctgagcttgccggacggagcgggacgtcttcatgaacttcgctgaagtgatcgtcgatgttacaacgaaaaatatcgacagaccgtttgattaccgcatccccgacaaattcaaaggtatgattaaaaaagggatgcgcgtgatcgttccgttcggcgcccgcaaaatccagggatttgtcaccagcgtgaaagaatcgtcggagcttgccggccgttcggttaaggatatcgaggatatccttgatctggcgcccgttttgacggaggagctgcttgagctgtcagactggctgacagaaaaaacactttcttttaaaattacggctttgcaggcgatgctccccgcggctatgaaagcaaaatacggcaaagaaatcaaggtgatcggcgataaaccgcttcccgaaccgctaaaaaccttgttctcgcaaaaagagacgctttcttattccgatataaatgaccacggaacattaaagctgattcagcgccaggttcaagaaggcaatcttgaagtggcgtataaagtaaagcagaaaacaaacaaaaaaatgcggagaatgatcgcccccctttgcgcgaaagaacatttaaaagaagcgcttgccggcctctctccgcaagctgtcaaacaaaaagcgatccttcagtttttcatcgaccgcaaagagggcggcgctgttccggcaaaggatctgatcgacaaaacggggggctcttccgcgtccttgaaagcgctcatcgacaaggggctgttaaaggaaagcgaagaggaggtttacagggatccttatcaggacagaatgttcaaaaaaaccgaaccgcttccgctgactgaagagcaggcgcaggcctacgaggcgatagcggatgcaatcgaagaaaagcggcacgatgtgtttcttcttcacggagtgaccggaagcggaaaaacggaagtctatctgcaatcgatcgaaaaggtgctggaagccggcaaagaagcgatcgttctcgttccggaaatttccctgacgccgcagatggtcaaccgctttaaagggcgctttggctcgcaggtagccgtactgcacagcgggctttcaacaggagaaaaatatgatgaatggcggaaaatccaccgcaaagaagtccggcttgtcgtcggggcgcgctcggcgattttcgcgccgtttgaaaatctcggcatgattataattgatgaagagcacgaaacatcgtacaagcaggaggagatgccgagataccatgcgaaagaagcggcgattcaaagggccaaataccaccggtgtccggtcgtgctcggcagtgcgacgccgacgctcgaatcgttcgcgagggcgaaaaaaggcgtgtacaagcttctttctctcaagcaccgcgtcaatcaccaagtcatgcccgacgtgtctctcgtcgatatgagagaggaactgcgcagcggaaaccgctcgatgttttccaaagacttaatggccgggcttgaggaaactcttgaaaaaggagagcaggccgttctgtttttaaacaaaagaggctattcctcatttgtcatgtgcagggactgcggatatgtcatccagtgtcctcattgtgaaatttcattgacgtaccacaggtatggacagcgtctgaagtgccattactgcggctatgaaaccggcatgccgtcaagctgccccgaatgcggaagcgagcatatccgctactttggtacaggcacacagcgggtcgaagaagaattgacgaaggttctgccggctgcaagggtgatccgcatggatgtcgatacaacctcaagaaagggagcgcatgaaaagctgctcacatcctttggcagaggcgaagccgatatcctgcttggaacgcagatgatcgccaaagggctcgatttcgaaaacgtcacgctcgtcggtgtcttgagcgcggatacgatgcttcacatccccgatttcagagccgctgaaaaaacgttccagctgatgacgcaggtgagcggaagagcggggcgccacgaaaagccgggcaaggtgatcattcagacgtacacaccgtcccattacagcattcagctcacaaaaacgcatgattatgaaacattcttccggcaggagatgctgcacagaagggaacaggcctatcctccatattattatttggcgctggtcagcgtatcgcacgaggaagtgacgaaggcggcactcgtgactgaaaaaatcgccacctatttaaaaaagaacatttcaagcgaggcgaagattctcggccctgtcgcatctccgatcgccaggatcaaagatagatatcgctatcaatgcgtgataaaatacaaacaggaaaaccagcttacatcgttgcttaaaaacattatggatcattacaaacgagacattgaacaaaagcaattggcgatttcgatcgacatgaatccatatatgatgatgtaaaaataacagtgtgatggagggcttttagattggcagtaaaaccgatcgtaacgtatccggcggaggttcttgagacccctgccgaacccgttgcgtcttttgataaatcattaaagaaactactcgacaatatgtatgatacgatgcttgagctggacggagtcggactggccgctccgcaaatcggcgtttcaaaaagagcggcagtcgtcgatatcggcgatgacacgggaagaattgaactggtcaacccggaggtcatcgaagagagcggtgaacaaacgggtcctgaaggctgtttgagctttcctgatctatacggtgaagtgaagcgttccgattatgtaaaggtcaaggcgttcgaccgccgcgggaaaccgtttacgattgaagctgagggctttttggcgcgtgcgctgctgcacgaaatcgaccatttggacggtattttattcacatcaaaagtaacgcgctattatgatgcggaagaacttgaggaaatggaaggatgattggatgacaaggatcgtttttatgggaacgccggatttttccgtcccggtgctcggcacattgattgatgacggctatgaggtagtgggtgtcgtcacccagcctgaccgcccgaaaggcagaaaaaaggtgatgactccgccgcctgtcaaggaggaagcgctgcgccgcggcattcccgtgctccagcctgagaaagtgagggaagaagcggaaacggacaagattttggcgcttgaacccgatttaatcgtaacggcggcattcggacagatcctgccgaaaaagctcctcgattatccgaaatacggctgtatcaatgtccatgcctctcttctgccggagctgcgcggaggagccccgatccattacgccattctggaaggcaaagagaaaacaggcgtgacgatcatgtacatggtcgaaaaattggatgcaggcgatatgctcgccaaggttgaagttgacatcgaagaaacagataatgtcggcacgctccacgataagctgagcaaggccggagctgcgcttctttccgaaacggttccgagaatcattgacggttcggtaaccccggaaaaacaggatgaacagaaagcgacatacgcgccgaacattaaacgcgagcaggaactgatcgactggtctaagcccggcgaagtcctgtacaaccaagtcagaggcttgaatccttggcctgtcgcatacacggtcttaaacggccagacgctgaaagtatgggccgcgaaaaaatgccaagccttaaaacaggcagagccgggggagatcgtcaccgttgaaaaagacggcattgtcgtcgcaaccggaaatgacaccgcgttaaaattaacggaagtgcagcctgccggcaaaaaaagaatgaaggctgaagattttgtcaggggagcgggtcttcaagccggaatgaaattgggtcatgacgatgaaaaataatgtgagagaagtcgcgcttgatgcactgattaagcttgaccagaatcaggcatacagcaatcttttgcttcagtctgccatgaaagcgaacgatttaagcgacaaagacagaggccttttgacagaactcgtttacggcacccttcagaataagctggcgcttgattatatgctgaagccgtttattaaaaagccggaaaaggtgaaagactgggtcatccatctgttgagaatgtcgctgtatcagatggaatacctggagaaaatccctgaccgggccgctctttttgaagccgttgaaatcgctaaaagacgcgggcataaaggaatatcttcatttgttaacggtgttctgcgctccgttcagagggaaggagtgccttcctttgcggatattgccgatccgattgaacgccttgcggttgagacaagccatccggagtggcttgtcagagaatggacggatgcctacgggttcgaagcggcagaacaaatctgccggattcatatgatcccgccgaagcagacgatccgcgtcaacaggctgaaaaacgaccgggatacgcttctttcccgtctgaatgaagcggggattgaggcggaagaaggcgacttgtccaaagacgctgtcaaactgctgaaaggaacgattgcgtccactccttttttcaaagaaggcgaagtcaccatacaagatgaaagctcaatgctagtagcgagagcccttggacctgagcggggagaaacagtgctggatgcatgcgcagctccgggaggaaaatccactcatatcggcgaactgctcgaagatacgggaaaggtcgtctccctggaccttcatcagcataaagtaaagctgatcaaagaagcggcaggccggattggactttccaacattgaagcaagagcgctggatgccagaaaagccggagaagtcttcgaaccggaacagttcgaccggatcctcgtcgatgccccgtgttcgggattcggcgtcatccgcagaaaaccggatctcaaatacagcaaaacgcccgaagacagcgcgcgtctcgccgggattcagcttgcgattttaaacgaaatcgcacctttattgaaaacaggcgggacattggtttacagcacatgcacaatggacccgaccgaaaatgaacaagtcatgcatgcttttttggaagaacacgacgaatttgaagcggaccccaccctcgccgagcggctgcccgaaaaagcggcgccgtatgtcaaggatggaagcattcaaatccttccccactactttggaacggacggcttctttatttgcagcatgagaaagaagggatcacaataatggaatcgaaacaaaaagtaagaaaagaattgcggacagaaagaccgtccatctattcttttgaaatagaagaactgaaaagctggctatcggaaaacggcgagaagccattccgcgccgcgcaaatattcgaatggctatacgaaaagagagtcacgtcatttgaaaagatgacaaacctttcaaaagagctgcggacaaagctgaatgagcatttcgtattaacgacgctgaaaacggccgtcaaacagacttcccaagatggaacaatgaagtttttattcgagcttcatgacggctacacgatcgagaccgtattaatgcggcacgaatatggcaattctgtttgtgtaacgacacaggtgggctgccggatcggctgtacgttctgcgcatcgaccctcggcggcttaaagcggaacctggaagccggagagatcgtcgcacaggttgtcaaagtgcagcaggcgcttgatgaaacagatgaacgcgtcagctcaatcgtcattatgggaatcggcgagccgttcgataattttcaggaaatgcttgcgttcttgaaaatcgtcaaccatgataaaggactgaatatcggagcgcgccatatcaccgtatcaacgagcgggatcattccgaaaatctacgagtttgcagacgaaaagctgcagatcaactttgcgatttctctgcacgcgccgaacactgagatcagaagccggctgatgccgatcaacagagcctacaagctgcccgatctgatgaaagcggtcgattactacattaagaaaaccggcagaagggttacgtttgaatacgggcttttcggcggtgtcaacgatcaggttgaacacgcggaagagctggctgaattgctaaaaggaatcaaatgccacgtcaacttgattccggtcaactatgtacctgaacgagactatgtcagaacaccgaaagaacagattttcgcctttgaaaaaacattaaagtctcatggagtaaatgtcacgatcagaagagagcaaggccatgatattgacgctgcctgcggacagcttcgtgcaaaggagcgccaggaagagacgaggtgaatcaaggttgaaaacagccttaaaaacggacaggggaaaaatacgccagcacaatgaagacgatgccggcattttcacagaaaaaaacggactggtattagctgttgtctgcgatggaatgggaggtcatctggccggcgatgtcgccagcaggatggccgtctcagcccttcgtgatatttgggaggaaaccgaagaagtcccggcttcgccggctgaaagcgaagcgtggctgaaagagcagatttcagccgtcaaccaaaaacttttcgaccattcgagggcccacgaagagtgccagggaatggggacaacggtcgtctgcgctttatacacgggaaaaacgctgacggtcgcccatatcggagacagccgctgctatctcctgcaaggcggaagtttcatacagctgacggaagatcactcgcttgtcaatgaactcgtgcggactggggggatttcgaaggaggatgctgaacaccatccgcggaaaaacgtgctcacaaaagcgctcggcacagatcccgaagtgaaggtagaagcccacacatttgaaatcgaaccgggtgatcaagtgctattatgttctgacgggctgacgaataaagtggatgatgagacactgaaggatatgctcacgactctttcttctgcggaggagaaagcggatcagctcgttcagctggccaatgacaacggcggcgaagacaatatcaccgtcgcgctattggaacttccttctcaaattgaagaaggtgaagacaagtgttaatcggcagacggatcagcggacgttacgaaatcctgcgcgccatcggcggcggggggatggcgaacgtttatttagcgctggacatcatcctcgaccgtgaagtcgcgattaaagtgctgcggtttgacttcgttcacgatgccgattttatcaggcggttcagacgggaagcgcagtccgctgcaagcctcgaccacccgaatatcgtcagcatttatgatgtcggagaagaagatgacatctattatatcgtgatggagtatgtcgaggggatgaccctgaaagaatacataaatcgaacaggcccacttcatccgaaagaagcggtccaaatcatggagcagatcgtatccgccatcgcacatgcccatgataaccagattgtccaccgggatattaagccccacaacattttgatcgaccatatgggccacattaaagtgactgatttcggcatcgccatggcgctcagctcgacgaccatcacgcacaccaactcggttttgggctctgtccattatttgtcgcccgaacaggcgagaggcggattatcgacgaaaaaatccgatatctactcgctcggcatcgtgcttttcgagctgctgacggcgcgtatgccgtttgaaggagaatcggcggtcagcatcgcgctgaaacatctccaatcagaaacgccgtcggtgaaaagatggaacccggccgtgccgcaaagcatagaaaacgtcgtcctgaaagcgatggcaaaagatccattccatcgctatgaagcggccgaagagatggaaaacgatttgaaaacggctttcgacccggaccggctcaacgaaaagcgcttcacgattccatccgatgatgagatgacgaaagcagttccgatcatcaagaatctgccggaaaacgggagcagctcgcaatccggcggcggagaagaggaagcggctccattatcaaaaaaagaaaagaagaagcaggcaaaagcaaacaagaagaaaaaaagaaagaaatggccgcttatattgctgacggtgtttttcgttctggctgcgtcagccgtcttggctttaacggtgtttccgtcgctctttattccgaaagatgtggccgttcccgatgttgccggccttgaatatgaagaagccgtcatcaagcttgaagacgaaggatttgaagttgatccgaatgctgaagacattgccgacgataaaattgaagaagggctgatcgtgaagacggaccctgcagccggcgatatcgtgaaggaaggttcaactgtcaagctatataaaagctcaggcaaagagaaaactgaagtcgatgatgtggtcggccagaaagtcgatgccgccaagaagcttcttgagcaaaaaggctttaaaaacatcaagacagaagaagtgcacgatgaagaagaagcgggaaccatcatcgaacaggaccctgcagccggaaccgaaatcgttgccgccgacgacgaggtcaaattaacggtcagcctcggtccggaagccattactttaagggatttaaaaacatacagcaaacaggcggcttcgggctatttggacgaccatcagcttgtccttgtcgaaaaggaggcgcattctgaagacgtgccggaaggtcaggtcattaaacaaaagccggaggcgggggcatcagtcaagccgggagacaaagtcgaggtcacgttttcgctcggacctaaacaaaagcccgtcaaaacggtgaccgagaaaattgatattccttatgaaccgggagcggcgggcgaagaacaaaacgtccaaatttcgatcgatgatgaagaacacagcatttctgacgtctacgaaaatttcaaaatcacagcgccggcagagcggacgatcaaattcaggattgcgcccggccaaaaagggtattatcaagtaacgatcaacgataaagtagtcaggtcaaaaacgattgaatatcctgaggatgaataagggaggtgcgatatgcctgagggcaaaatcattaaagcattaagtggattttactatgtattggatggcgatcaggtcattcagtgcagaggaagaggggttttcagaaaaaataaagtaacccctctcgtcggcgacgatgttgtctaccaagccgataacgataaggaaggctacattctcgagattaaagacagattcaatgaattggtcagacctccgatcagcaacgtggatcaggcggttctcgtgttttcggcaaaggagccgacattcagcacgtcgcttttggatcgttttttagtgctggttgaggcgggtgatattaggccgatcatatgcatcacgaaaatggaccttgtggatgatgacgcgctgaaagagcagattcatcaatatgccgaagactaccggaacatcgggtacagcgtctatttgacatcaatgaaaagcggaagaggcatcgaagacatcatcccccattttcaggataaaatcaccgtattcgccggccagtccggcgtgggcaagtcttcgcttttaaatgcgatcagccctgaccttgaactgaaaaccgccgggatttccgcccacttgggaaggggaaaacatacgacgcgccatgtggagctgatcgatataaacggcgggctcgtcgcggacaccccgggcttcagctcgcttgagtttgccggtattgaagctgaagatttagggcagacatttttggaaatcggcgaaaagagcgccgaatgcaagttccgcggatgcctgcatataaaagaaccgaactgcgccgtcaaacgcgccgtggaaaacggtgaaatcgcccagtatcgctacaaccattatgttgaatttttaacagagatcaaagatagaaagccgaggtattaagatatggtatatgttgctccttctattctttcagccgattttgcccgtctaggggaggaaattcgagatgttgaacaaggcggcgccgatttcatccacatcgatgtgatggacggccatttcgttcccaacctgaccatcgggccgcttgtagtggaagccgtccgcccgatcactgagcttccgctcgacgttcatttaatgatcgaagcgcctgaccgctatatacctgcttttgcaaaagcgggcgccgatattttgtccgtccatgttgaagcatgcccgcaccttcacaggacgatccagctcatcaaagagcaaggggtcaaagcgggagtcgtcttgaatccgcatacccctgtgcagcagatcgagcatgtgcttgaagaccttgatctcgtattattgatgacggtgaatccgggcttcggcggacagtcgtttatttcctcggtcctgccgaaaatcaggcaggtcaaggagatggctgagcaaaaaggacttgccgatctgctgattgaagtggacggtggcgtcaacaaaaatacggcaagacagtgtattgaagcgggagcgaacctgcttgtcgcaggatctgccgtttataacgaaaaagaccgcaaaaaagccatttccgatataaaaggtgcgcttgggtaaggtttcctgatgaaagagagccggctttctgcagctgcgctctttttttagggcgttcacagaaaggataatgcgatgaaaacgatcaatattgtagcgggaggccccgatcatcttattcccgacttgctgcagtatcaggccggggatgcgctttgggtcggggttgacagaggcgctgtcacccttttggatgcggggatcgtgcctgatgaagcattcggggattttgacagcatcacagacgagcaaaaaaaagcgattgaaaaggccgctccccgcctccatatttatcaggcggaaaaagatcagacggatttggaccttgcgttgagctgggctgtcggacagcgtccttcatttattagaatgttcggcatttcgggaggcagagcagaccattttctcgggaatctgcaccttctttataccgcgatgaagcaaaacgtcaagaccgtcatgatcgaccgccaaaatacgatcagcatgcatcccccaggctcctataccgtcatgcatgatcaaacaaaaccgtatatttcattcctgccgtttgcggagacggtaaaaaacctttctctcgaaggatttaagtattctttaaataagtgtcatattgctctcggttcgacactatgtattagtaacgaactcatccattcacaaggtgctttttcgttttcagaaggcatattaataatgataagaagcactgattaaatatcctggcgcttccgctcgctttgtgtttgggatccgatgttgaaggtggatgcggttgcggactctttgaggagggaagggaatgaaattttacaccatcaaattaccgaagtttttagggggaatcgtccgggcgatgcttggctcgtttcgcaaagactaagaagcgccgggtgcgctttttttgcggagcgggtcaaagggctgtccccggatggcaaaagaacgaaaaaacgcctgcctaaagcgtacagtcgctcttggcaggcgtttattttttcttatacacgctcaacttttccagatttcaaagctcgagcagatacatatacttttttaggcttgccgttcacaaggatgcgcactttttgaacgttagcgccccatgtgcgtttagaagcgttcatcgcgtgagaacgagagttgccagaacgtgattttctgcctgtaataacgcatttacgtgccatttgtttccctcctaactatcaaagagaacatcatcattctttatcagttgatcacctgtgatgcttcagatactttaataatttaccacagctgaaaaccgtttgcaactattgattgctctgctttcaagaaaaattccttgacatcttgaaaaaatgaacgcgctgtagtataagtagggttaggtttggagagaagcctgcctgttcttttaaaaagaaggtccttatagtagaatgatttataaccagaggtcaaaagcgagactcgaaaaggaggaaccaacgtgtccattgaattccgaacaaaatacggacagattgatatatcaaacgaagtggtcgccatggttgcaggaggcgcagcgatcgactgctacgggatcgtaggtatggcatccaagaaccaaattaaagacggactgactgaaatcctcagaaaagaaaactttgcaagaggcgtcatcgtccgccaggaagaggatcgtattcatattgacatgtacatcattgtcagctacggaacaaaaatttcagaagtggcacataatgttcaaacaaaagtcaaatatacgctcgaccatacagtgggtcttgcagtggattccgtaaatatttacgttcaaggagtacgagtgacgaacccgtagttaggaggaaaacaagagtgtctatacgaaatctggatggaaaagcttttgcagatatgattctgtacggcgcacaccatctgtctcaaaacgcaaatgtagttgatgcgttaaacgtatttccggttccggacggagatacgggaacgaacatgaatctgtcgatgacatccggtgcgaaagaagtggagcaaatcgacaccgccaatatcggcaaagtggcacaaagcctgtcaagggggcttctgatgggggcgcggggaaactcgggcgtcattttatcccagctgttcagaggctttggcaaatcgattgaacagaaatcggaaattaacgcgaaagaatttgccgccgcgttccaggccggagtggacaccgcctacaaggccgtcatgaaaccggtcgaaggcacgatcttgacggttgccaaagatgccgcaaaaaaagcagtgctcgccgctcaaactgaaaccaatatcatcaaggtgatggaagctgtcgtaaatgaagcggaggcttctttggagcggacgcctgagctgcttccggttttaaaggaagtcggtgtcgtcgacagcggcggaaaagggcttctttacgtgtatgaagggtttctcgcttctttaaagggagaaaagctttctgataaagcggcagctcttccgtcattggatgaccttgtcagcgccgagcaccataaaaacgctcaaagccacatgaatactgaagacatcgaattcggctactgcacggagtttatggtaaagctcgacagcggtaaaagaaactttaatgaagttgcgttccgccaggatttaagccgcttcggtgattcgcttctcgtcgtctcagacgaaaatatcgccaaggtgcacatccatgccgaatatccaggggaagtcatgacttacgcgcaaaaatacggcagcttaatcaacatgaaaatcgaaaatatgagagaacagcacagcgcgattctcagccagaacaaacaggagacagcaccggcagaaaaagcgccggcagataaacagccgtacggcatcgtcacagtggccatgggtgaagggattgccgagcttttcgaaagcatcggcgccacaaaggtcatagaaggcggccagacgatgaatccgagcacggaagacatcgttcaggcgataaaagacgccaatgcggacacggtcgtgattctgccgaataattcaaacattgtcatggcggcgaaccaggccgcggatgttgccggacaacatgtaattgtcatcccgacgaagaccgttcctcaaggaatggccgcactgctcgcattcaacccggccctttcagcggacgagaatgaagccgctatgctcggtgcgatcggcgaggtgaaaagcggacagatcacctatgcggtcagagacacaaacattgacggcatcgatattaaaaaaggcgattttatgggcatattaaacgggaaaatcgttgagacggcgtcagaccagttaacagcagcgaaaaagctgatcgcaggcatgatcgatgaagacagcgaaatcgtcaccgtgatcaaaggggaagacgccccggaagaagaggccgaagaactcgcagcctacatcagcgagacgtacgaagacgtcgaagtagaagtgcacgacggaaaacagccgctgtattcctacattctggctgtcgaataacgaatcaaaggcagaagggcatgttgataaaagcccttctcttcttttggctttttttaaagcctcagcccgcaacggacgttgtctgcttgccaattgggaaatgatcgattagtctaaaaaaaaacggctttttttcctccgtacagcgggggaatctgtttgtaaaagggggataaggatgaagtacagaagtgtgtttgatattatcgggcccgtcatgatcggaccgtcaagttctcatacggccggcgcggccagaatcggcagagtcgccagaagcgtgtttgggagggagccgaaacaaattattgtatcgctctacggttcttttgccgaaacgtataaaggacatggaacagatgttgcgatcatcggcggccttttggattttgatacatttgatgaaagaatcaaagattcgatccgtctagccgaagaaaagggaatcgccatcgagttccgggaagaagaagcggtaccgaagcatcccaatacagcccgcatcctcatctctgatgatgaaggctcccttgaactcgcaggcatctcaatcggcggagggaaaatcgagatcattgagctgaacggcttcgaactcagattatcgggtaatcaccccgctattttagtcgtccataacgaccgctacggaacgattgcaggcgtagccaatgtgcttgcgaagttcgcaatcaacatcggccatatggaagttgcccgcaaagacgtcggccaggaagcgctcatgacgattgaggtcgatcaaacgattgatccggctgtttttgatgaattgagagcgctgccgaacatcattgaggtgacccagatcgctgactaaaaaggagggtgagacgatatgtttcgaaatgtgaaagaattaattcaactgacaaaggaaaagaacgtgtccatctctgaaatcatgatcacacaggagatcgaggtgacaggccggacgcgggaagatatattcaagcagatggaagccaacttggctgtcatggaagacgctgttcaaaaaggcattgagggcgtcgtatcgcactccggattgacgggcggagacgccgttaagcttcaggcctaccttaaatcgggcaaagggctgtcaggggatgtcatccttgacgctgtcagcaaagcggtagcgacaaatgaagtcaacgctgcgatgggaacgatttgcgcaacgccgacagccggatcggccggcgttgtcccggggacgctctttgcggtaaaagagaaacttcacccgacgaaagagcagatggtccgctttttatttacatcgggagcgttcggattcgtcgttgccaacaatgcgagcatttcgggagccgccggaggctgtcaggctgaagtcggatcggcctcgggcatggcggctgccgccatcgtcgaaatggcgggcggaacccctgaacagtgcgccgaagcgatggccatcgctttaaaaaacgtactcggtctagtctgcgatcctgtcgcagggctcgttgaggtgccgtgtgtgaagcggaacgcgatgggcgcagccaatgcgatggtcgcggctgatatggcgcttgccggcattacaagccgcattccatgcgatgaagtgatcgatgcgatgtacaaaatcggacagacgatgccgacggcactgagggaaacaggccggggcggtcttgccgcaacaccgacgggcaaagaattggagaaaaaaatattcggaggagcgtcagctgcacgtggaacacaatctgcaacttagtatatctgttataaaaggcgtcgggacggaaacggaaaaaacgttgaacgagctcggaatctatacggttctcgatcttttaaactacttcccgtaccgatatgacgattatgaattgcgcgatttggaagatgtggcacacgatgaacgagtgacggtggaagggaaggttcacagcgagccttctcttgcctattacgggaaaaagcggagccgtctcacgttccggcttttggtcgggaactatttgatcacagcggtttgctttaacaggccttatttgaaaaaaaagcttgcgatcggctcgattgttaccgtaaccggaaaatgggacaagcacagacaatccgtgatggtgcaagagctgaaaaacgggccgcaccagggtgatcagtcgattgaacccgtatactccgtcaaagaaaacatcaccgtaaagacgatgaggaaattgattcaggaagctgtccgcagccatttgccgtttgccgaagatcctcttccggaaaagcttcggaccgcctacaaacttctgtcttaccaggaggcggtaaaggcgatgcacaagcccgagtcgagggaagctttaaagcatgcgcggcgccgttttgtatatgaggaatttttgctgtttcagctgaaaatgcaggctttgcgaaagttcgagcgggaagcgtccgacggaatcagccacacctttcggctcgaagacgtcaattcgtttgtcaaaagccttccgtttcctttgacaaacgcgcaggcgaaagcgctcgacgacatattaagggacatggcttcagggtataaaatgaatcggcttttgcaaggagacgtcggttcaggcaaaacagccgtcgccgcgattgcgctatacgcctcgctgctttccggattccagggggcgatgatggtgccgaccgaaatactggcggaacagcacgccgattcgcttgtatccctctttgagcagcacgacgtcaatgtggcgcttttaacaagctctgtgaaagggaaaaggagaagagagcttttagaaagattaaaagaaggagaaattgatattttggtggggacgcacgcccttattcaggacgatgtccactttaaacagctcgggctcgtgatcaccgatgaacagcaccgcttcggcgtcgagcaaagaaaaaaactgagaagcaaagggaaagatcccgatgtcttgtttatgacggcgacgccgattccgagaacactggcgatcacggttttcggggaaatggatgtgtccgtcatcgatgaaatgccggctgggcgaaagcggatcgagacgtattgggtaaagcacgacatgctcgaacggattctcgcgtttatcgataaagaactgaaaaaaggcagacaggcgtatgtgatctgtcccttgattgaagagtcggacaagctcgacgttcaaaatgcaattgatgtgcacagcatgctgactcatgccttcaggggaagatggcagatcggtctcatgcacggaaagctgtcaaatgacgagaaagaacaggtaatgaggcagttcagcaaaaacgaatgccagattctcgtttccacaaccgtcgttgaagtcggggtaaacgttccgaatgcgacggtcatgctgatctatgatgccgaccggttcggtctttcccagctgcatcagcttcgcggccgggtcggacggggcgatcaccagtcgtattgcatcctgatggcagacccgaaatctgagacgggaaaagagcgcatgagcatcatgtctgagacgacggacggctttgagctttctgaaaaagatcttgaactcagagggcccggggactttttcggcaagaaacagagcgggatgccggagtttaaagtcgccgacatggttcacgactaccgcgcgctggaaacggcaagaagagacgctgcagaacttgtctcttcaaaagcgttctggacggatgccgaatataaaagcctgcgggaacacttgcaaaacagcggggttatggacggagagaagctgagctgatctgaagtccagctaaaatttatcgtcggcgggtaaagaaagattgcattccaatctatgaaattatatactactattagtacctagtcataattgcgcggatggtgtttaataacatgagaaaaagtaagagagaacgccaagaattgctgcagcagacgattcgtacgaccccgtttattacggacgaggagttagcggagaaatttaacgtcagcattcagacgattcgcttggaccgtttggaactttccatacctgaactgagagaaagaatcaaaagtgttgccgagaagtctcttgaagatgaagtcaagtcattgccgcttgacgaggtcatcggcgagatcattgatttggagctggatgagcacgcgatttcaattcttgagatcagaagggagcatgttttcagccgaaatcaaatcgccagggggcaccatttgtttgcccaggccaactcgctcgccgtcgccctcatcgacgatgagctcgcattgacggccaaagcggacatccgctttacaaggcaggtcaagcaaggcgaacgggtcgttgcaaaagcgaaagtcgtgaagcttgataaagataaaggcagaacggttgttgaagtgaacagctatgttgccgaagagcctgtgttttcaggcgaatttgtcatgtatcgttcaaaacaatcatagaaggtggcgcgtaagtcatgaaaattgctgtagatgccatgggaggagacaatgctcccaaagcggttattgaaggcgtgatgaaagcggtcgaagattttgaagacctcgagatcacgctgatcggcgaccgggaaaaaatagccgcccatttaacagaacacgggcggatcaccgtcaaacacgcggaagaagtcatcgaagcgacagacgagccagtcagagccgtcagaagaaagaagaattcatcgatggttctgatggccggagaagtcgccgaaggcagggctgatgcctgcatttccgccggaaacaccggagcgcttatgacggccgggctctttatcgtcggccggattgaagggattgaaaggcctgcgttggcaccgacattgccgaccgtctccggagacggctttctccttcttgatgtcggagcgaatgtggacgccaagcccgaacatctcgttcaatacgccattatgggatctgtttacggagaacaggtgctgggcgtcaaaaatccgcgcatcggacttttgaacgtcggaaccgaagataaaaaaggaaatgagcttgccaagcagacctttcaaaaattgaaggaaaccgatttgaatttcatcggcaatgtggaagcccgcgatatgctggacggagtcgctgatgtcatcgtcacagacggctttaccggtaacgttgccttgaaaacggtcgagggcgcggcgctgtccatttttaaaatgctgagaacgacgctgacttcgagcttcacggcgaagctcgccgcttctgcactgaagccgaagctgaaagaaatgaaaacgaaaatggattactctgaatacggcggagccggattgttcggcttaaaggcgcccgtcatcaaagcgcacggatcatctgacggacgcgccgtttatcacgcgatccgccaggccagagagatggtcagccaaaatgtcgcggcatttatcgaagaaaaaattcaacaaaaagcagatgaatagtctggaggttttaacacatgggcaagattgcttttctattcccgggccaaggttcgcagcatatcggcatgggacacgaattgtatgaaaaagaaccgaatgcgaagaagatttttgaagaagcggatcaaacgcttgaaacaaaactgagcaccctcatgtttgaaggggatgcaaaggaactgacgcttacatacaacgcgcagccaagccttttaacggcgagcatcgcagcgcttgaaaaactgaaggaatacggcattaaagccgactatgcggcaggtcacagcctcggcgaatacagcgcattggtcgctgccggcgccttgtcgtttaaagatgcggtttatgccgtcagaaagcgcggcgaattcatgaatgaagccgtgccggcgggagaaggcgcgatggcggccattctcggcatggacagccaggcgctgaaagaagtgacggacaaaatttccgaagaaggaaaccttgttcagctcgccaatttgaactgccctgggcaaatcgtcatctcgggaacagctaaaggcgtggagctcgcttcagagcttgcgaaagaaaagggcgcaaaacgcgcgattcctctcgaagtcagcgggccgttccattctgagctgatgaagccggcagctgataagcttcgtgaagttcttgatgcgtgcacgatcaacgacgcagccattccggtcgtctccaacgtaacggccgactttgtaacggataaagacgacattaagaataaactgattgaacagctgtattcccctgtacgctttgaagaaacaatcagccgcctgattgacgaaggcgtcacgaccttcattgaaatcggtcccggaaaggttttgtcagggcttgtgaagaaagtgaaccgcagagtcaaaacgattgctgtatcagacccgaacacaattgaacttgccgttcaaacgttgaaggaggaaaacgaaaatgctggaaaataaaacagccgttgtgacaggagcctcaagaggaatcggccgcgcgatcgccctggacctggcgaaaaacggagcaaatgtcgtcgtcaactacgcgggaaatgaagcgaaagcgaacgaagtcgtagacgaaatcaaagcgctcggccgcgatgcgtttgcttttaaagcggacgtttccaatgcggatgaggttcaggcgatgatgaaggaagcggtcggacgcttcggcacgcttgacatccttgtcaacaatgcgggcattactaaagacaatctgttcatgagaatgaaagaagatgaatgggacgacgtcattaacataaacttaaaaggtgtgttcaattgttcaaaagctgtgacaagacagatgatgaaacaaagaagcggccggatcatcaatatcacctcggttgtaggcgtcgtcggtaacgccgggcaggccaactatgtcgcggctaaatcaggcgtgatcggcttgacgaaaacgctggcaaaagaactggcgtcaagaaacatcactgtgaatgcgatcgctccgggattcatttcgacggaaatgacggacaagctgacaaaagacattcaagacgaaatgctgaagcagattccgcttgcgcggttcggcgagccgtctgacatcagcagcgccgttgttttcctcgcatctgaccatgcgagctacatgaccggccagacgctgaacatcaacggcggaatggctatggtttaaacgaaatcaaaaattgaattatctctggttttttaaaaacgaatcaactataatacttgaggggaggtgaatagctatggcagacgcattagagcgtgtaacaaaaatcatcgtagaccgcctcggcgtggatgaagctgacgtcactcttgaagcttcttttaaagaggatttaggcgctgattccctggatgtagttgagcttgtcatggaacttgaagacgagtttgatatggagatttctgacgaagatgctgaaaagattgcaacagtcggtgacgctgtgaactacataaatagtaagcagtaagctcatttaaagtcccgtttaaagacggggctttatccctttataaatgcggctttaattttaatgttttgcccaatgataaacgaacctgccttttcataggaggtgaggtgaacttgatgtgcccatatggaggttgctatgtcaaaacattcacatttcagagacaaaaaaatgtttcaaaaaaaagcggagcagtttaaaaagtttcaggaacggatttcggttcaatttcaaaacgagaagcttttatatcaagcgtttacacattcatcttatgtgaatgagcatcgaaagaagccatatgaagataagagaggcttgaatttttaggagacgccgttttggaactgacgatttctcaatttttatacgccaaatacccggcgatgagcgagggtgatttgacgaaattgagagcggcgatcgtatgcgagccttctttggtttccctggcccatgagctttctttcggagagcttgttctattgggaaaaggagaggaaatgactggaggaagaaagcgtccggcgcttttagccgatgtgtttgaagcttttatcggtgcgctctatctggatcaggggctcgaagccgtcgtgacttttctgaaagcgtacgttttccctaaaatcgacgatggtgctttttctcatgtgatggattttaaaagccagctgcaggaatttgtacagcgcgacgggcgaggcatactggagtataaaatccttcaggaaaaaggaccggcgcacaaccgcgaatttgaagcaaatgtatcgctaaaaggagaagtacttggggtgggaagcggccgttccaaaaaagaagctgaacagcatgccgctcaagaagcgctcgcgaagctgcaaaaacaccatatgaaacaataaatcccccttgcaaaaaccagggggatttcaatgtattttgagccttttccatagggttatgatagaattgtaatactttaatacataaggaggatcaccatgttcctcaaacgtttagacgtgataggatttaaatcgtttgcagaacgaatttctgtagattttgtaaaaggcgtgacagccgtcgtcggcccgaacggcagcggaaaaagcaacatcaccgacgcgatccgctgggtgctcggtgaacagtccgccaaatcgctcaggggcggcaagatggaagatatcatttttgccggcagcgactcgcggaaaaagctgaaccttgccgaagtgacgctgacgcttgacaacgatgaccgctttttgccgatcgattttcacgaagtcagtgtgacgagaagagtctacagatcgggggaaagcgaatttctcatcaacaaccagccgtgccgcctgaaagatatcatcgatctttttatggattcagggcttggaaaagaagcgttttccatcatcagccaaggcaaagtcgaagagattttaagcagcaaggctgaagagcggagaagcatcttcgaagaagcggccggcgtattaaaatacaaaacgagaaagaaaaaagccgaaaacaagctgtttgagacacaggacaatttgaaccgggtcgaagacatcctccacgagctcgagggacaggtggagccgctgaaagtgcaggcatcgatcgccaaagactaccttgaaaagaaggatgagcttgaaaaaatcgaaatcgcgttaacggcgtatgacatcgaagagcttcacggaaaatgggaagcccttcagcaaaaagtcgaaaaggcgaaagacgaagaaatgtcctcttctgcggccatccaggcaaaagaagccaaaatcgaagaggcaagagacaaaattcaagcgctcgacgaatcggtcgatgagcttcagcaagtgctgcttttgacaagcgaggaactggagaagcttgaaggccggaaagaagtgctgaaggaacgcaaaaaaaacgccacgcaaaacagagctcagcttgaagaagcgatcgtccagcgcagtgaaaaagagcgaaccctgaaagagaaaatcgccgcgcagaagcttgtgtttgaaaagctcgagactgaagcaaaagagcttgcccgacaggtgaaagaaaaaaatcaggctttatccggatacagcgaaaatgtagaggaagaaatcgaacagctgaaaagcgattatttcgagctgttgaacgaacaggcttccgtccgcaacgagcttcaatttcttgaagaccaaatgacccaatctgcggcacagcagaaacggctcgcacaaaacaatgaaaaatatttaagcgagcggaaggaaatcgccgaccaaaagatgaaaaccgaacacgaattcagcctcgtggacgagcgtcttcacagccagattcaagcattcagggacgcgcaaaaaagctatgaacagaaaaaaagccagtacgaaaaaaaggaatccgccctttaccaggcttatcaatacgttcagcaggcgcgctctaaaaaggaaatgcttgaagcgatgcaggaggacttttcggggttttatcaaggcgtcaaagaagtattaaaggccaagagcgagcttccgggaattcgcggcgcgattgcagagctgttaaagacggacgagcggtatgaaacagcgatcgaaatcgcgctcggcgcaacagcacagcatgttgtcacagaagatgaagacgccgccagacgggcgattcaatatttgaaaaagcattcgttcggaagggcgaccttcctcccgctttccgtcatcaaagagcgccgcatccagccgagagacatcgagacggcgaaagaaaacccgtcgttcatcggcatcgccagcgagcttgtttcatttgatccggcctaccggagcgtcgtgcaaaatctgctcggcaccgtgctgatcaccgagcatttaaagggcgccaacgaccttgccaagcggctcggccacagataccggatcgtcacccttgaaggggatgtcgtcaatccgggcggttccatgacgggaggagctgtcaagaaaaaaagcagctcgcttctgggacgaaacagggaactggaagcccagacaaaacgcctcgccgagatggaagaaaaaaccgaattgctcgaaaaagaagtgaaagccctgaagcagaccattcaggagcttgatgccaagctacagtcacttcgggaggacggagaacgcctaagatccgagcagcaggaaatcaaaggccgtctgtacgaactcgaaatcgccgagaaaaacgtcaacagccatttggagctctatgaccaggaaaaatcggctctgcttgaaggggacgaagacaagaagtggcgtaaagaagagcttgaagaaaagctcgcatcgatcgccggcgagctgcagcgccttgattccgaaatcgaagccatgacggagcggaaacagacgcagacctcgacgaaagaagcgttgcaaagcgagctgaccgatttgaaagtggtgctggcgaaaaccgaacagtcgtgtgcaaacgaacgggaaaagctcgcaaggcttgaagaagagtatgccgagaatgcggaagcgctcaaggtggccgaagaggatctttctttcttaacgacagagatgtcctccaattcttccggtgaggaaaaacttgaagaagctgcgaaaaagaagctgaacgataaaaataaaaccgcagagctcatcgcctcaagaagagaacagcggatgaagctgcaaaaaggccttgaaaccgaagagctcgaactgaaagaaatgaagcgccagtataagcagatggccggtctcttaaaagatgaagaagtcaagctcggccgcatggaagtcgagctcgacaacctgctctctttcctgcgggaagagtacggcctttcatttgaaggggcaagggaaaaatatcctttggagctttcccctgaagaagcgaggaagcgcgtcaagctgatcaagcttgcgatcgaagagctgggaacggtgaaccttggcagcattgaggaattcgaaagggtcaatgaacgctacctcttcctttcagagcagaaagacgacctgctcgaagcgaaaaatacgctctttaaggtcatcgaggaaatggatgaggaaatgacgaagcgttttgcggaaacatttgcgcagatcagctcccattttgaagacgtcttccgggcgctgttcggcggcggaagagccgagctcaagctgacagatccgaatgacctgctccaatcgggcgtcgatattatcgcccagcctccgggcaaaaagctgcagaacctgagcctgctttccggcggggaacgggccttgacggcgatcgcgctcctgttttcgatcctcaaagtcagaccggttccgttctgcgtgctggatgaagtcgaggcggcccttgatgaagcgaacgtgttccgctttgcccaatacttgaaaaaatacagccatgaaacccagttcatcgtcatcacccaccggaaaggaacaatggaagaagccgatgttctttacggcgtgacgatgcaggaatcaggcgtttccaagctggtctcagtcaagcttgaagaaacaaaagaattagttcaataaagcgaggttacaggacatgagcttttttaaaaaactgaaagaaaaaatcacacagcagaccgattcggtctcaggcaaatttaaagaaggcctggcgaaaacgagaaatacgtttcaggagcgggtcaatgagcttgtctcccgctaccggaaagtggacgaggatttttttgaagagcttgaagaggttctgatcggcgctgatgtcggcgttgcgactgttatggagctgattgacgagctgaagagcgaggtcaagcgaagaaatattcaggacccgaaagaggtgcagtccgtcatttctgaaaagctcgttgaaatctatgaaggcggggagcaggaagcatcagagctccgcgtcgaagacggccgcctaaacatcattttattcgtcggcgtcaacggcgtcggcaaaacgacgacgatcggcaagcttgcccatcaattcattaaagaaggcaaaaatgtcgttcttgctgccggagatacattcagggccggcgcgatcgaccagcttgaagtgtggggagagcgcgtcggcgcgcatgtcgtcaaacaggcggaacgctcggatcctgcggctgttatctatgacgccgttcaagccgcgaaagcgcgcggcgccgatgtcctgctttgcgacacggcaggacgcctgcaaaataaagtgaacttaatgaaagagctagaaaaggtaaagcgcgtgattcagcgcgaagtgcctgatgcgcctcatgaagtgctgctcgtactggatgcgacgacagggcagaacgcaatgacacaggcgcgcgaattttccaaagcgactgatgtctcaggcatcgtgctgacgaagctcgacggaacggcaaaaggcggcatcgtcctcgccatccgccatgagctgcagattccggtcaagtttgtcgggctgggggaaaaaatggatgacctgcagccgtttgaagcagagtcatatgtatacggcctgttttccgatctgatcgagaaagaagagtaggcgcggaaaacccctttgcgggggttttcttttttgccgtccggtatgacaagataaaaacttgacagatcaaatatttcagcgtaaactagtgtatcgtaaagggatttgacttaacaaaggggagagtctcatgacgcttgaaaaaacaacgagaatgaattacttattcgatttctatcagacgttgttgacatcaaaacaaaaaagctacatgtcgctttactacttagacgatttctcccttggcgaaatagctgaagaatatcatgtctcaaggcaggcggtctatgacaatatcaaacggaccgaagccatgcttgagcaatatgaagaaaagctacttttgtttaaaaaatttcaagagcgcaaaaagattttgaagcgctgagaaagctgactgacggtcagctgaggcggagtccctgattgatgcgcttgagaaattagattaggaggcggcacttaatatggcattcgaaggattagccgaccgactgcagcaaacgatctcaaaaatccgcggaaaaggaaaggtaacggagcaagacgtcaaagagatgatgcgcgaagtccgtttagcgctccttgaagcggacgtcaattttaaagtcgtgaaagattttgtgaaaaaggtaagcgaacgagctgtcggacaagacgttatgaaaagcctgacgcccggacagcaggtcattaaagtggtaaaagaagagctgacggagctgatgggcggcgaggaaagcaagattgccgctgcaaagcgtccgccgaccgtcatcatgatggtcggtctgcaaggggccggtaaaacgacgtcgaccggaaagcttgccaacctgcttcgcaaaaaacataaccgcaatccgctgctcgtggcagcagacatctaccgcccggcggcgatcaaacagctggaaacgctcggcaagcagctcgatatgccggtattttcactgggtgacaaggtcagtccggtggagattgccaagcaggccatcgaaaaggcgaaagaagatcatcacgactacgttctcatcgatacggcgggacgccttcatattgatgaagagctgatggatgagcttgagcaggtaaaagaaaccgctcagccggaagagattttccttgtcgttgactccatgacgggtcaagacgcggtcaatgttgccaaaagctttaacgaacagctcggtgtgacaggtgtcatcttgacgaagcttgacggcgatactagaggcggagcggccttgtcaatccgcgccgtgacaaacacgccgatcaaattcgccggaatgggcgaaaagcttgatgcgctggagccgtttcatcctgaacggatggcttcgcggatactcggaatgggcgatgtgctcacccttatcgagaaagcccaggccaacgtagacgaagaaaaggcgaaggaactcgagcaaaaaatgaaaaatatgagctttacgctcgacgactttttggaacagctcggacaggtccgcaatatggggccgcttgaagacctgattcaaatgatgcccggcgcaggcaaaatgaaaggcttaaaaaacgtgaaggttgatgaaaaacagctcagccatatcgaagcgatcatcaagtcgatgaccgggaaggaaaaagagcagcctgagatcatcaatgcaagcaggcgcaaacggattgctaaaggaagcgggacatccgtccaggaagtcaaccgtcttttaaagcaatttgaagaaatgaaaaaaatgatgaaacagatgacaaacatgacaaaaggcaagaaaaaagggtttaaactgcccttcatgtaaacctgttttcagatgataaaaacgttgttaagaaaaaacactttacaaacacttttatcattgttaatatactatcttgttgaaatattttcggaggtgctagtaaaatggcagtaaaaattcgtttaaaacgtatgggagctaaaaaatctcctttctatcgtattgttgtagcagattctcgttcaccgcgtgacggccgcttcatcgaaacagtcggaacttacaacccgcttgcaaaaccagcggaagtcaaaatcgacgaagagcttgcgcttaaatggcttcaaacaggagctaaaccgtctgacacggttcgcaacctgttctcaaaagaaggcattatggaaaaattccacaacgctaaacaaagcaaataatgagtgatctgcacttggaagagctgattgtatcactggtcaaaccgcttgtggatcacccggatgatgttcaggttttcaaagaggaaaatccagagcggattatgttccgcctgtctgtcaacagagaggataccggcaagatcatcggcaaaaaagggcgcactgcaagagcgatacgctctgtcgtatttgcggcaggcgcacagtcttctaagaaagttcaacttgagatcgcagactaaggggagagggtgaaaacctcccccttttttaacatgtaagaaaaatagaaacagatgaacgattccgatcgtcagcttatgccaggctgccggatttcagggaaaggaaaaatcacgggacagtaggtgatgatgccatgcaaattatccaacgtgttaccgtcatgcaggttttgactgaaaacagcaaaaaaaagctgctggcttcttttgaagaaagaaaggaaatccttgagcgcgaatgcaaccagctctattttcagctcaggaaacacgaaaaggaacaccacaatccggcggcgactgaatcatttaaaaaagaaattgaaaaacgacaggacaagattaaaatgatcgtttttcaaatcaatcaaatccacacactgccgcttggcagcgaagtaaaggaaaaagaaatcgacgctttaatggacattgaagtcggggataattggcatgatatgacggcgggaaaaacaatcgtgattaaagacgggatcgtcattgaaattcgtccgaggtgaagaaatgctgaaacaatggtttaatgtagggaaaattgttaatactcatggggtaaaaggcgaagtccgcgtcatttcaagaaccgattttcctgaggagcggtacaagcccggaaacgcgctctacttgtttctggaaggaaaagacgagcctgtccaggtgaccgtcagcgcccacaggcttcacaaacagttccaccttttgcagtttaaagaggttgaaacgctcaccgaagccgaaaaattaaagaatgccttgattaaagttcccgaagaccaattaagccagttggcggaagacgaatactactttcacgaaatcatcggctgcgatgttttctcggaagacggggatttaatcggcaaggtgaaagaaattttaacgccgggcgccgacgatgtctgggtcgtggccagaccgggaaagaaagacgcgctcatcccttatattgacgccgttgtcaaagagattaacgtagcggataaaacgatcaagattcatatcatggaaggattacttgacgaatgaaaatcgattttttaacgctttttccggaaatgtttgaaaggcgtgctcggctcgtcgatcctgcaaaaagctcaggacaaggacgctgtccgttttcgcgtggtgaactttcgggcctattccgacaacaagcatcaaaccgttgacgattatccatacggcggcggagccggaatggtgctgaaaccgcagcccgtctttgacgcggtcgaaaagctgacggctgaagccggagggtctccgagaatcatcctcgtctgcccccagggtgaacgctatacccagcagaaggcggaagaactggcgcgggaagagcatttaatgttcatttgcggccattatgaagggtatgatgaacggatcagggagcacctgtctacagacgagatttcgatcggagatttcgttttgacagggggagagctgccggcgatgatgatcgcagacagcgttgtgcggcttttgccgggcgtgctcggcaaggaagaatcgcaccttgaagactctttcagcacagggcttcttgaacaccctcattacacgcggccggcagattataaaggcttgaaggtgccggacgttctgacatccgggaaccatgcgaagatcaaagaatggcggcggaaggagtctctcaggcgcacatttttaaggcgtcccgaccttctggaaaactatcctttgtcagaagaagagcgaaagtggatttctgaatggaaaaaccggtagattctattgcgcccgggaaaaaggtgtggtatgatactacttgtgacttgaacgggaacgctcgtttaagtttgaaaacgatgttccgctgtgccggttaactcgcgcaagagcatctgttggaaggagttgaagacgatgcaaaaattgattgaagaaatcacaaaagaacaattgcgcactgatttgcctgcgttccgtcctggtgatactttacgtgtacacgttaaagttgtcgagggtaaccgtgagcgtatccaggtttttgaaggtgtcgtgattaagcgtcgtggtggcggaatcagcgaaactttcacagttcgtaagatttcttacggtgtcggagttgagcgtacattcccattgcacacaccgaaaatcgcgaaaatcgaagttgtccgtcatggtaaagtacgccgtgcgaaactttattacttgcgcgaacttcgtggaaaagcggctcgtattaaagaaatcagacgataatgataacgaacgaaaagagcttgttaaccataacaagctctttttttgtcaaacaagtataaatgcatcgcaccattaaaagaatagcaataacagaaagtaggtggcagacaaatggtgatccaatggttccccgggcatatggccaaagcgaggcgggaagtaacggaaaaactcaagctgatcgacattgtatacgaactggtcgacgccagaattccgatgtcttcaagaaacccgatgatcgaagacattttaaagaacaagccgagaatcatgctgctcaacaaggcggataaagcggactcctccgtgacaaaggcttggaagcagcactttgaaaaagacggaattcctaccctcgccatcaactcggtcaacggacaggggctcaatcaaattcttcctgcatcaaaagagctgctgaaagaaaagtttgataaaatgaaagcaaaaggtgtaaagccgcgcgcgatcagagcattgatcgtcggtattccaaacgtcggcaaatcgaccttgatcaaccggcttgcgaaaaaaaacatcgccaaaacgggcgacagacccggagtaacgactgcacagcagtgggtgaaggtcggaaaagagctggagcttctcgatacaccggggattttatggccgaagtttgaggacgagcttgtcgggctgaggctcgcggcaacaggcgcaattaaagattcgattatcaacttgcaggatgtcgccgtctacggtttgcgctttttggaagagaattaccccgaacgcttaaaaaagcgctatgacctggaggagattcctgaagaaattgcagcgctttttgatgagatcggaaaaaaacgcggctgcctcatggccggaggcgagatcaattacgacaagacgacagaagtcatcatccgcgatatccgcaccgaaaagttcggcccgctttcttttgaaaagccggaggatatgtaaaaaggcgcgcttttaaaagagcgggcctttatttttgcagaagatgcgccgataagaacattaggggagaagagaaagtgaaaacattaaccgtcaaagaaattaaagaacatcttcaatcggtgagcgatgaaaaggacccttttatagagcagtgcaaaaatgatgagcgaaaaagcgttcaagcgctcgtcgacgcctggctgaagaaaaatgaaaggctttcggccatgcgggaagagtggcaggcgatgacgtcttttgaacggtcgctgagagcgcggggctatcaatatatcgccggaatcgacgaggcgggcagagggcctctcgcagggccggttgtcgccgccgctgtcatcctcaaagaagattgtgaaatattagggctgacagattcgaaaaaactgtcaaagcaaaaaagagaagactattattcatacataatggaagaagccgcagcagtcggcgtcgggatcgcggacgcccatgagatcgatgagctgaatatttatgaagcctccaaagcggcgatgctgaaagcggtccaagcgctggacgtcgcaccggattatcttctgatcgacgccatgtcgcttgcggtcgatacagagcagtcatcgattattaaaggggatgccaaaagcgcctcgatagcagcaggcgcatgcatcgcaaaggtgacgagggacaggctgatggatgaatacgctgaaaagtatcctctctacgggtttgaaaagcataaaggctacggaacgaaggagcatctgaatgccctggcgaaatacggcccgtcgccgatacaccgaagatcgttcgcccctgttaaagcacatgaataacgttccggaggaagaatgactttgatgatgctgaacgatgtacataacagcttaagaaaacaatttgaacaagcggattctctccagcggatcagcggaacggagacggatcagaaaaggctgatgctcggcaaagtgctccgctttatcagcgagcagttcgccgaaatacaaatcggcaatacgaaatggcaggggaagcttgaggcacccctgaaagcgggcgctcattactggttttcgtatgaaaagaagccggatgaagcgacaggccgccttcaggtcgttgaagcgtttgacaaaaacccgaagaccgtgcaggatgccgcctttaagctgttgaacgggctttctctgaagcggacgaaggaagccgtctttctggtcggagcgttgctgaaggagcagcagccgatcagggaaaacgatttaagagccgccatcaagtggcttgaaaatctgccgaagtccgatgcccaaaaaggcgccgatgccgtcatgttcgctcttaaacgcgaacttcccgtccaccccggcgtgctcgattcgattatggccgtcaaaagccccgttccgctcaatgagcagattgcgagaacgcttgatatgatcgcgaacgccgctcagccatccccaggcatggaaaagctgaaacaggcgcttttgccagttttacaagcggagactgaggtgcatgccgaaaggctgattcaaaagcttgcggaacacatcagatcgctggaaaaaggagaactgcaggccgttctgccattaaagccgcaggttcagtcagaaggcggaaaacctccgcaaaaagcagacgctggcggcgcatacggacaggaagcaaaagcagcccagcacaatccgcaaatcgcagcagctaaagacgtgttcgctaaattggcggcacaagccgaaacgaacgggacgcatattgcaagagaagcggcaggcgtcatcaaagcgcttgaatcgcgcggagctctcggacaagctccggccgttctggaaggattcacgccaaaagagacggaacttttgcagcatatcatgaaagaaacagcgcctgcattgacgaataaagccgatgtattatccgttctcctcaagatcaaagatgttttaggcgtcagagatgagctctcattgttgagagcgatggaaaacggcgccgttctcaaagagcagggcctgcaatctttaaagctcgtgctgaatgaaatgaggcatgcttccgatcttccggctcctgtaaaacaggaagcggaccaaatctttcaccgtttaaacggacagctgtttttgcagaatgatcagcctgcccagagccagctttttctgtcgtaccctctgttttcaaagaacggcgtccaggatttgaacgttttcttaaaagggcagaaaaaagacgacggaaaaatcgacccttcccagtgccgcctcatgttttaccttcagttggaagcccttgaagagacggtgatcgattgtttgatccagcaaaacgtcatgacggttacaattgaaacaaagttcgatttggagtctttgattgaaccgctggtcccggctttaaaggaaaacctgaaagagctgggctacagcttgtcaggcgtctcagcaaaaaaacgggaaaacatgaagctcgctccgtttttggagtcccgttttgaacaaattacagagagcgcagtggatgtgaaaatatgaaggaatctgttccattaagaagagctgttgcgcttcactacgatgaaatgaaggacaaggcgccgaaggtggttgccaaagggtcgggatacacggcggagaagatcattgaagaggcgcagaaagccggtgttccgattcaggaagatgcgacgcttgtcgaattgatgcgccacttggagcttgacgaccacattcctgaagcgctttacgagatcgtcgccgagatcttttcattcgtctatacgcttgatgaaaaaatgaaaaagagggaatgacttttgaaaaaaagccgtttcctctattaattttatatttttaataaaataaaagtgtgaatgtttagaaggattttacgatttctcatcgaaacctagacaatcgatctatgattatataaaatgaaagcgcagtctatttttatttttgctacataagttaggaggatgggaaaatgaatatccatgagtaccaagggaaagaagtactcagaaaatacggagtggctgttccggaaggtaaagtggcatttacagcagatgaagcggtcaaagcagcggaagcgctgtccagctcggtttatgtcgtgaaagctcaaattcacgccggcggacgcggtaaagctggcggggttaaaattgcaaaatcaaaagaagaagtcaaagcctatgcggaagaattgttgggaaagacgcttgtcactcaccagacgggtcccgacggccaacaaataaaacgcttacttattgaagaaggctgcgatatcaaaaaagaatactatgtcggcctagttctcgacagggcgacttcacgcatcgtgctgatggcctctgaagaaggcggcacggaaattgaagaagtcgctgaaaaaacaccggaaaaaatcgtcaaagaagtgatcgatccggctgtcggactgcagagctaccaggcgagaaaaatcgccttcgccatcaatattccgaaagagcttgtcggccaggccgttaagtttatgatggggctgtacaaggcgtttactgaaaaagactgttccattgctgaaatcaatccgctcgtcgtcacaggggacggaaaagtcatggcccttgacgccaagctgaactttgacagcaatgcgctatacagacaaaaagacatcttggagtacagagatctcgatgaagaagatccgaaggaaatcgaagcatccaagtatgatttaagctatatttcgctcgatggaaacatcggctgcatggtcaacggagcggggcttgcgatgtcgaccatggacattatcaagcactacggaggggaaccggccaacttccttgacgttggaggcggcgcgacagccgaaaaggtaacggaagcgttcaagatcattttgtctgatcaaaacgtcaaagggatctttgtcaatattttcggcggcatcatgaaatgcgacgtcattgcagaaggcgttgttgaagcgacaaaacaagtcggtctgacattgccgcttgtcgttcgccttgaaggcaccaatgtcgatctcggcaagaagatcctcgatgattcaggactcaatattacgtctgcggaatcaatggctgacggcgcgcagaaaatcgtatccttagtgaagtaagaaaggcaggggaccaaaatgagtgtatttattaataaagacacaaaagtcattgttcaggggataacgggttcaaccgctttgtttcacacaaagcagatgcttgaatacggaacgaaaattgtcggcggagtcacaccgggcaaaggcggaacagaggtcgaaggggtgcctgtgttcaatacggtcgaagaggctgtaaagcagaccggggcaaatgcgtctgtcatttacgttcctgcggcttttgcggccgatgcgattatggaagcgacagatgctgagcttgatcttgtcatctgcattactgagcatattccggtgcttgatatggtaaaagtcaaaaggtatatggaaggcaagaaaacgagactcatcggtccgaactgcccgggagtcattacgcctgaggaatgcaaaatcgggatcatgcccggatatatccataaaaaaggccatgtcggcgttgtgtcgcgttcaggaacccttacatatgaagcggttcatcagctttccgaagcaggagtcggccagtcgacagcagtgggcatcggcggagaccccgtcaacggcacaaacttcatcgatgtgctgaaggcttttaatgaagatcctgatacacatgcggtgatcatgatcggcgaaatcggcggaacagctgaagaggaagcggctgaatgggtgaaagccaacatgaccaaacctgtcgtcggtttcatcggaggaaagacagcgcctccgggcaagcgcatggggcatgcgggcgccatcatttccggaggaaaaggcacggcggacgaaaagatcaaaacgatgaatgcctgcggaatcgaagtggctgaaacgccttctgtcatgggagaaacattgattaaagtgctgaaggaaaaaggtctttacgaaacgtgtaaaacacactgatgattaaaaagagcgggaatagtccgattggtctattcctgctttttcataactggttatatcgtttagtactttcagattgttttgttttaaaaatttttggaggtttttgaatgaacgacagcagcgagcttttgatattgctccgccttcgcggcacactctccccttctctgctgaccaagtggtggaagcaggacccttccttgtctcttacgggcgaaaaaaaccatcttttaacgaagctttcattaaaaagatcagacttgtgctccatacgaaaactggcggaacaagaactgtctaatgttaaacggctcatccgttcttacgaggcggccggcgtccgcatgaccgccatatcttcccctgattatccagccagcctgaaaaccattcatgacccgcctcccgtcctttttttaaaaggaaacaaaaaacttctccatgaacaaagaaagatcggaatcgtcggaactcgctgcccgtcattatacggaaaaagagctgcggtccagcttgtcagggagctttgcaaaaacagctggacgatcgtcagcggtcttgcaaaaggaattgacggtctcgcccatcaggagagcatccgttcaaagggaaggacaatcggcgttatcgcgggcggattcaacagcatatatccccgtgaacatcgccagctcgccggacaaatggccgaaagccacctgctggtatcagagcaccctcctcacattaaaccgcaaaaatggcattttcccatgcgaaatcggctgatcagcggattaacggaaggaatcgttgtcgtccaaggcaaggaaaagagcggatcgctcattacagcataccaagcccttgagcaggggcgggaggtgttcgccgtgccgggtccgatctttgatgccaactctttcggtccttcaaggctgatccaggaaggggcgaaactcgtattaactattgaagacattttgaacgaacttccgccttcaaacgctcaatatacagagcctgtttagaattatcgtttgacaaaccgtattgtaatatttaataatagtgaggatttcaagtttaaacgctttaatcggcgttcaacatatagaaggattaaatcagacacttttcgtaaaaataatgactatataaacgacgattatgctgaatacaataaaaaggctaaattgaaaagagagagaacacctcttgagggggataatgttatgtccgaatacttagtcatcgtggaatcgcctgcaaaggcaaaaacgattgagcgatacttaggaaaaaaatataaagtaaaagcctcgatggggcacgtcagagatttgccgaaaagccagatgggcgttgacatcgagcagaactttgaaccaaaatacattacgatccgcgggaaaggccccgtgttgaaagaattaaaaacggccgccaaaaaggcaaaaaaagtttatctcgcagccgaccccgacagggaaggggaagcgattgcgtggcatttggcgcacagccttgatttggacctgaattccgactgccgcgtcgtatttaatgaaattacaaaagatgcgatcaaagaatcatttaagcatccgcgcatgatcaatatggatcttgtcgacgcccagcaggcgagaagaattctggaccgccttgtagggtacaaaatcagtccgatattatggaaaaaagtaaaaaaaggcttgagtgcgggacgtgtccaatctgttgcgctccgccttatcattgaccgggagaaagaaatcaacgattttataccggaagaatattggacaattgaagggtcttttctcaaaggtaaagaaacgtttgaagcgagcttcttcggaatcaacggggaaaagcaccagctgaaaagcgaagatgatgtgaagcaaatcctatcccggatcaaagggaacaaatttgaggtcaaaaaggtaacgaaaaaagaacggaagcgaaatcctgcgctcccatttacgacgtcgacgcttcagcaggaagcggcgcgcaaattgaatttccgggcaaagaaaacgatgatgatcgcccagcagctttatgaaggaatcgatctcggcaaagaaggaacggtcgggttaatcacttatatgagaacggattcaacccgtatctcgaatactgctcaagaagaagcggcatcattcatcggcgaacagtacggaaaagaatttttgggtagcaagcgaaagccggccaaaaagaatgaaaacgcccaggatgcccacgaagcgatcaggccgacctcggtgctcataaagccttccgatctgagggcggtattgggaagagaccagcttcggctatacaagctgatctgggagcgctttgtcgcaagccaaatggctccggcgacactggatacgatgagcgtcgaccttgaaaacaacaggttgacatttcgggcaaacggcagtaaagtcaagttttcaagcttcatgaaagtgtacgttgaaggcaaagacgatcagatggaagagaagaataagatgcttccggatctcgctgaaggcgataccgtgctttcaaaagacatcgagcccgaacagcacttcacacagccgcctccgcgctatacggaagcaaggctggtcaaaacgcttgaagaactgggaatcggacgtccatccacatacgcgccgacgcttgacacgatccaaaagcgcgggtatgtcgcccttgataataaacgctttattccgactgagctcggtgaaattgtgcttgacttgatcatggagtttttccctgagattattaacgttgagttcaccgccaaaatggaaaaagagcttgatgacgttgaagacggaaacattcaatgggtgcagatcatcgattccttttacaaggactttgaaaagcgtgttgaaaaagcggaagccgagatgcaggaagtggagatcgaaccggagtatgcaggtgttgactgtgaagcgtgcggacatccgatggtctataaaatgggccggtacggcaaatttatggcctgctccaattttccggactgccgcaacaccaagccgatcgtaaaagagatcggcgtcaaatgcccatcatgcaaaaccggcaacatcgtcgagcgcaaatcgaaaaaacgccgcattttttacggctgtgaccgctatcctgaatgtgaattcgtatcatgggataaaccgcttgaacggaaatgtccgaaatgcgaggacatgcttgtggagaaaaagctcaaaaaaggcgttcaagtgcagtgcgttaattgcgattataaggaagaacaacaaaagtagcggtgagcagggctttgctcaccttctttgttgtgttaaaagaataagtcaattcataaattaggagatgtgaatatgaatcaaacagtaaatgtcatcggtgcaggacttgcaggaagcgaagcggcatggcagcttgctaagcgcggtatcaatgtccgtttatacgaaatgaggccagtcaagcaaacgccggcgcaccatacagataaatttgccgaacttgtctgcagcaactcgcttcgggcgaattcattaacgaatgctgtcggtgtattaaaggaagaaatgcgggttcttgactcggccatcatcgctgctgctgacgaatgttctgttcctgccggcggtgcgcttgccgtagacaggcatgaatttgccgcaaacgttaccgaaaaagtaaagaatcatccgaatgtgaccgtgcttcatgaagaagtcacggaaataccggaaggaccgacaatcattgcgacaggaccgctgacatcagaagcgctttccgcaaagctccgggagctgacaggcgaggactatctatacttttatgacgcggctgcgccgattgttgaaaaagacagccttgacatggataaagtctatttgaaatcccgctatgacaaaggggaggcagcgtatttgaactgtccgatgacagaagaagagtttgacaggttttatgacgcccttgtgtctgcggaaaccgttccattgaaagaatttgaaaaggaaatcttctttgaaggctgtatgccgattgaagtcatggcgaagcgcggcaaaaaaaccatgctgttcggcccgatgaagcctgtcggacttgaagacccaaaaacaggaaagcgtccgtacgccgttgtgcagctgcgccaagatgatgcagccggcacgctttacaatatcgtcggttttcaaacccacctcaaatggggcgaccaaaaagaagtgctccgcctcattccgggactggaacaggcagaaatcgtccgctacggcgtgatgcacagaaatacgttcatcaactcgccgagtctgttaaaagcgacctaccagtttaaaaagcgggacgatctgttttttgccggtcaaatgacaggtgttgaagggtatgttgaatcagcggcttcaggtcttgttgccggtataaatgcggctcggctcatccagggaaaagaacctgtcactttttcaaatgaaacagcgatcggcagcatggcccattacattacggaaacaaacaagaaaaacttccagccgatgaatgcaaacttcggcctgttcaaagaattgggtgttaaaattaaaaacaagcaggaacgaaatgaacagtatgcttcgcgcgcattggagacaattcgaaatatttcgaaaacgctatagttattcattgccagatgaacttgttatgtgataacatttaaaagcccttttcgaagaggtgtaatgatggcaaatgttaagaattttttaactttattcattgaatatttacaaatagaaaagaattattcaaaatatacaattgtgggttacatttcttccattgaagactttgaacgctttttacacgttcagggcataaagggttttgaagacgtgacttatccggatgtgagaattttcttgacggaagcgcatgaaaaagggctcactcgcaggacgatcagcaagaaaatttcggctctgcgtagcttctataaatttttattaagggaaaagctggtaaaagaaaacccgtttctgcttgtcagtctcccgaaacaggataagcggattccgaagtttttatatgaaaaggaacttgaagaactgtttgaggtttcggatttgagtacaccgctcggccaaagaaatcaggcgctcctggaatttctctacgcgacaggcatgcgggtaagcgaactttgcagcctgaaggaatctgatttggatctgtttttagatacggttttggtccacgggaaaggcaggaagcaaaggtatattccatttggttcattcgcccgggaggctttggatctgtatttgcaaaatggaagacgcatccttctgttaaaagcgaaagagccctgcccttttatttttttgaatcaaaggggcgggcccttaaccccgaggggggttcgttacattttgggagaactggtcaagaagacttcgggtacattacatatacatccgcatatgctccgccatacatttgccacccatttgttaaatgagggtgcggatctgaggagcgttcaggaactgcttgggcattcaaatctttcttcaacccaggtgtatacgcatgtatctaaagatatgctcagaaagacatatatgtctcatcaccctcgggcacataaagggaaataaaggaggttcttttatgtcatcttttcacgcaacgacgatatttgccgtccagcacaacggaaaaagcgcgatggcgggagacggccaggttacgttcggtcaggctgtcgtcatgaagcataccgcaagaaaggtaagaaaactcttcaacggaaaggtcattgccggttttgccggttctgttgcagacgctttcacgctctttgaaatgtttgaagcgaagcttgaagaatacaacggcaatttgcagcgggcggcagtcgagcttgcaaaagagtggcgaagcgataaagtcctcagaaagcttgaggcgatgctgatcgtcatgaatgccgacagcatgctgctcgtttccggaacaggcgaagtgattgaaccggacgacggcattttggcgatcggctcaggtggaaactacgcgcttgcagccggaagggcgctgaaacgtcatgccggcagccagcttgacgcgaaagcgattgcgagggcttcacttgaaaccgcgggcgaaatctgtgtgtatacgaacgatcagatcattgtagaagaacttgaatagaaaggatatgaggcatatggaaaaaaagccgctgactcctaggcagatcgtcgaaaggcttgatcaatacatcgtcggccagctcgatgcgaaaaaagcggtcgccgtggcattgaggaaccgctacagaagaagtcttcttgatgaaaaactgcgcgaagaaatcgttccgaaaaacatattgatgatgggcccgacaggtgtgggaaaaaccgagattgcaagacgaatcgcgaaactcgtcggcgctccgttcgtcaaaatcgaagcgacgaagttcacggaagtcggttatgtgggcagagatgtggagtcgatggtcagggatcttgtggaaacgtcagtccgcctcgtcaaagaggaaaaaatgaacgaagtgaaaggcatcgctgaagaaaacgcaaataaacgcctcgtccgcctgcttgtaccgggaagaaaaaaacagacaggtgcgaaaaatccttttgaaatgctgtttggcggaaatcaggatcaagaaactggtgaagcggaaaagcaagaagacgcggatatcgaaaacaaccgaaaacggattgcgcatcagcttgctctcggcgaacttgaagaccattatgtcaccgttgaggtggaggagcagcagccgtccatgtttgatatgctccaaggctcgggtatggaacagatgggcatgaacatgcaggatgcgctcagcagcctgatgccgaaaaagaaaaagcgccgcaagcttacggtcagggaagcgcgaaaagtgctgacgaatgaagaagcggcaaagctcatcgatatggacgaagctgcccaggaagctgtccagagagccgaacagtcgggaatcatctttatcgatgagatcgataaaatcgccaaaaagagcggtgcttcttcatcggcagacgtctcaagagaaggcgtgcagcgcgatattcttccgattgttgaaggatctaccgtcatgacaaagtacggtgcggtcaaaacggatcacgttctgttcattgctgcaggtgcattccacatggcgaagccttcagatctaattcctgagctgcaggggcgctttccaatacgcgttgagcttcaaaagctgagcatcgatgactttgtgaaaattttaactgagcctgacaacgctcttcttaagcagtataaggctttattgaagacggaaggtatatctcttgaattttctgacgatgctattcgtaagattgcagaagtggcttatcatgtgaaccaggacacagacaatattggggcgagaaggcttcacaccattttggaacgtcttttggaagaactgtcattcgaggctccggatgtgacgatggaagaagtggtcatcacgcctcaatatgttgaagaaaagctcggttcgatcgctaagaataaggatttaagccagtttattttataaacaattaaataagagtaatttaggaggatcaatttattatggctttattacaaaaaacaagaaagattaatgcaatgctgcaaaatgcggcagggaagccggttaattttaaagaaatggccgaaacgcttcgcgatgtgattgattcgaacattttcgtcgtcagccgcagaggaaagcttctcggtttctcgatcaaccagcagatcgaaaatgaccggatgaaaaaaatgcttgaagagcgccagtttcctgaagattatacaaaaagcctgttcaacattccggaaacgtcatctaaccttgacatcaacagcgaatacacagctttccctgtggaaaaccgcgatttgttccaagcgggtctgaccacggtcgttccgatcatcggaggaggcgaaagactgggcaccttgattctgtcccgccttcaggagaaattcgaggatgacgatctgatccttgccgaatatggcgccactgtcgtaggaatggaaattctcagagagaaagcggaagagatcgaagaggaagcgcgcagcaaagcggtcgttcaaatggcgatcagttcactatcttacagcgagcttgaagcaattgaacatatttttgaggagcttgacggaaatgaaggcctgcttgtcgctagtaaaattgcagaccgcgtcggcatcacccgctcggtcattgtcaacgcgctccgtaaacttgaaagcgccggtgtcattgaatcaaggtcactagggatgaaaggcacatacatcaaagtgctgaacaacaaatttttgatggagttagaaaaactaaagtctcattaaaaggcgaaagccgcagaacatgccgttctgcggctttttttatttcatgttttaaactatattatcgtaattttttcatatcaaaaaacaactaaaacgcggtgcaaaatcaatgcgttacttgaataaaagatatactaacataattttttgaaactttaatgaacgtaacattacatagttcttataatctaggtcaaaatacctattcataaaatagatatttcttacgatttttttttgcttccagatcatagactttaagcctattattccttacaataggcttatggtttttacaattctcgacaagattttaagacagatggaaaaagattggaggtatttggacggtggatatattttcaggaacgatacatagactagagggagccttgaatcaagcgaacattaagcaaaaagtcataacgaacaatctggccaatgtagatacaccgaactacaaggcgaaaaaagtatccttcaaaaatgtgctgaatgaggagtcctcccggattaatgccataaaaacagactatagacacattgactttaaagggaatgagccaaattattcagttgtgtcgagaaagaatacaacttatcaagaaaacgggaacaatgtggacgttgatcaggaaatgagtgaaatggcgaaaaatcaaatccagtatcaagcgctggttgaaagaataagcggaaaattcaactcgctaagaaccgcgattacaggaggtaaataatgggggtattcaatagcatcaacatttcagcttcagcgttgactgcacagagagtcagaatggataccgtttcttccaacctggcaaacatggatacgacgagagcgaagctggttgacggacagtggcagccgtatagaagaaagcttgtatcgacggctccgaaaggcgaatccttttcatccgttctccaatcatcgatgaatgcatcggcgagagtcggcgaaggggtgaaggtgaccaagataagcgaagacaaaacaccgtttaagctcgtttatgatccgacccatcccgacgcaaacgaagacggatacgtgcagatgccgaatgtcgatccgctaaaagagatggtcgatttaatgagcagcacaaggtcatatgaagccaatgtcacagcaatgaacgcgacaaaaggaatgctgatgaaagcattagaaatcggaaagtagggtgatgacacgaatggttaatggaatctctccgtttggagttcaatccgtgcaggcgggaacgaatgcaacaaatcagatcaagaacaagcaggacggttcagagaaccaagtcagcttttccaacgtgctgaaagattctatcaatgctttgaatcaatctcaaaatgaatctgataaactgacaaacgcgcttgctctcggtcaggatgtcaaccttgatgaagtgatgattgcagcccagaaggcaaacattacattgacggctgcgacggaattccgcaacaaagcggttgaagcttatcaggaaatcatgagaatgcaaatgtaagaaaggagtctgaaagcgaagagaattagtgtaactaccgggggagtaagatgaatcgtaatttattgcaaattaaaacgaaaataactgatttttggaaaaacagatcaaagctgcagaagattctgctgatcggcattgtcgctctggcagtcatcctgtcaatcatcattggaattgttgcttcgtcaaataaaatggtgccgctctataaagatttgtcagctgaagaaaccggccaaatcaaacaggtgctcgatgaaaaaggtattccatctgaagttgcgactgacggttcagtcatcaaagttccggaagaaaaagtcgatgaactgaaagtcgatcttgccgcagagggccttccgaaaagcgggagcatcgattattcattctttggcgaaaatgccggttttggcatgacggacaacgaatttgacgttttgaaagtgaaagccacgcaaaccgagctatccaacctcatcaaaggaatagacgggattaaagattcgaaggttatgattaacctgccgaaggaatccgtctttgtcggagaggaaaagccggaagcatccgcttcgattgttcttcaggtgaagcccggccacacgcttgatcaaaatgaaatcaacggcctttatcatctcgtatcgaaaagcgtgccgaaccttgacccgaaaaacatcgtgatcatggatcaaaactccacatattacgatcaaacaggcaaagagtccggttcttacgccgacagctattcttcccaaagggaagtcaaggcccagatcgaaaaggacctgcaaagacaaatccaaaccatgctcggcacgatgatgggacaggataaagtggttgtatccgtcacatctgacatcgatttcacaaaagaaaacaggacggaagacctggttgaacctgtcgacaaagaaaatatggaaggaatcacggtcagcgcagagcgcgtcagtgaaacatattccggacagggagcacaagcgggaggcgtcaacggaacaggtgaaaacgatgtaacgaactatgctgaaacagaaggcggaacaggcaacggagactatgagaaaagcgaagaacgaatcaacaatgaagtcaacagaatccataaagaaatcgctgagagcccgtacaaaatcagagatctgggcgtccaggtcatggttgaaccgcctgatgcaaacaacccgcagtcactgcctgctgaaagggaggacgatattaaaaaaatcctctcaaccattgtgaaaacatcgattgacaagaactatgaagaagagcctctgacagatgaggatgttgaaaataaaatcgttgtttctgtccaatcgttcgacggcaagcagacaatcgatgaaggaacggaaacaggcggcataccgatgtgggcttacatcgcaggcggagcagcgcttgttgctgtaatcggcctcatcatctggcttgtcagaagacgtaaaaatagagatgacgaatacgaggaagaatggtatgaaacgcctcaggagccgattcgggttgctgatgtgaacaatgaaaaagagacagaagaaactgtcagacgaaaacagcttgaaaaaatggcgaaagacaagcctgaagaattcgccaaattactgcgcagctggctgaccgaggattaggaggagtattgaaatggcaaaaatgaaacaagacaggcttacaggcaaacaaaaagcggccattctcatgatatccttagggcttgatgtgtcagcttccgtttacaagcatttaacagatgaagagatcgaaaggctgacgcttgaaatatcaaatgtcagagctgtatcacctgagaaaaaagatgagattattcaggaatttcatgaaacggctattgctcaagaatatatttctcaaggcggcattcattacgccaagcaggtgcttgacaaagcgctcggcgaagacaaagccgccagcattatcaacaggctgacatcgtctcttcaagtcagaccgttcgattttgccagaaaagcggatcccgagcagattctgaactttatccagcatgagcacccgcagacgatcgcattgattctgtcttatctcgatcccgtgcaatcgggtcagatattgtcagagctgaatcaggatgtgcaggcagaggttgcaagaaggatcgctgttatggacaggacgtcgccggaaatcatcaatgaagtcgaacagattctggagcaaaagctatcgtccacattcactcaggactacacgcagaccggcggtatcgaagccgtagtcgaagtgttgaacggagttgacagaggtacggagaaaacgatccttgacgcccttgaaattcaggatcctgagcttgccgacgagattaaaaagcggatgttcgtctttgaagatatcgttacgcttgataaccgcgctattcaaagggttatccgcgatgtggaaaacgacgatctgcttctttctctcaaagtggccagcgaagaggtcaaagacatcgtcttcagcaacatgtcgcagcgtatggctgaaacatttaaagaggaaatggaattcatgggccctgtgcgtctgcgtgacgtagaagaagctcaatcgagaatcgtaagcgtcatccgaagacttgaagaagcaggtgagatcgtaatcgccagaggcggaggagatgatatcattgtctaacattattaaacagcgattatcatcaataccgaaaaaagaaaggcggacgatttcattaaaggaagtcaaacttcctgagacagaaaccgaacttgataccggacaggatccggaatacctcctcgaccatgccagacaagaagccggaaaaatatacgaaaaagcgagcgctgaactcgaacaggtcagacggcaaatcgaagaggaacggtcaagctgggaaacagaacgcgaagcgctgatagaccaggcgaaacaagaaggctttcaagctggatttgaagagggaaaggccgaggcccgaagcgcttatcaagcgtatttggatgaagccaatgccatcgtccgggcggctagacgtgactatgaagaaaaaatcgaacaatcatccgaagaaattgtcgaacttgccgtgtcactggctaaaaaagtttggaatcaaaaggctgacgacaaagaagcttttacagccctcgtaaaacaggtgctgtcggaaatgaaggaattcgatgacattgccatctatgtagatccggagtactacaccgaggttcaaagccacaaaaacgaacttgagcagctcctccaatacggcgcccatatcgcgatatacgccgatgaaaaagcgccgaaaggaacgtgctatgttgaaacggctttcggaagaatcgatgcaggcatcgacactcaattgcagcagctgaaacaaaaactgctcagcctgcttgaaacggcaggtgttgtccggtgatgctcaagcagctgcttgaatgtatagaaaccgcagattcctacaaacgatacggaaaagtcaaacaggcggtcggcctgatgattgaatccaaaggacctgaatgttcaatcggcgatgtctgcaaaatctatacaaaaggtgacgggccaaaggctattaaagctgaagttgtcggcttcaaagaccaaaatattcttctgatgccatatttggaagcggccaatattgcccccggcagcattgtcgaagcgacgggcgaatcgcttagggtcaaagtcggctccgggttgatcggacaagttgtcgatgcattcggcaatccgctcgacggcagcgtgcttccgaaaggtctggctcaagtatcgacagaccaggcgccgcctaatccgatgaaaaggccgccgatcagagaaaaaatggcggtcggcgtcagatcgatcgacagtctgctgaccgtcggaaaaggacagcgtgtcgggatattcgccggaagcggcgtcggaaaaagcacgcttatgggaatgattgcgagagagacggccgcagacttgaatgtcatcgctcttgtcggagagcggggccgggaagtcagggagttcatagagaaagatctcggcgaagaagggctgaagcgaacgatcgttgtagtggctacatctgaccagccggcgctgatgcgtctgaaagcggcctatacagcaacagcgattgccgagtacttccgcgacaaaggacaaaacgtcatgttcatgatggactcggtgacaagggtcgccatggcccagagggaaatcggcctggcgacgggcgaaccgccgacgacaaaaggttatacaccctcagtgttcgctattttacctaagctcttagaacgaacaggaacgacggaaagcgggtcaataactgctttctatacggttcttgtcgacggcgatgatatgaatgaaccgatcgccgatactgtaaggggaatcttggacggccatatcgttcttgaccgagcccttgcgaataaaggccagtttccggcagtcaacattttaaaaagcatcagcagggtgatgtcgaacatcgccgagaaagaccatatcagagcagcgaaccggttcagggaaatgctgtcaacctatcaaaactcagaggatctgatcaacataggagcctataaaaaagggtcttccagagaaattgatgaggccatacaattccaccctaagctgatcagcttcctcaagcaggaagtggatgaagcggcatcgctggaagagagcatttccttattaaagagtcttacaggaagagaggattaagaatggcttattcatttaaatttcaaaagctcctcgagcttaaagaaaatgaaaaagaccaatcatttgctgaatatcagcactcagtttccgaattcgaaaaggtcgcggaaaagctgtatgaaagcatgagccaaaaagaaacgctggaaaaaaacaaggaaatcaagatgcagacggggatgagcgttcaggaaatgcggcattatcagcaatttgtcacaaatcttgaaacgacaatctaccattatcaaaagctcgtcatgatgaagagaaatgaaatgaatgaaaaacagcacgatttgacggagaaaaatatcgagctgaaaaaatttgaaaaaatgaaagaaaagcagtttgaaatgtattcgctgcaaaacaaagcaaatgagttaaaggaaatggacgatatctccattgcccagtacataactcaaggaagctaggggtagaaaaacgatgaccgaagaaaaaaaagccggtaaatttcagacatttttgtttgtcatcgtcattccgctgatctttttaatcgttgtagcgttcgtcggcatgtggcttttgggcgtcaattttcaggatgcagcctcaaaaattcccgtcgtaaaagagcttgtgaaaaacggcgaggatcaggacatagatcacgcaactaaacagcaggagaacaaagcagaaaagctccaaaagacgatcgatgaacaaaaaagcgaaatcgaaacgctgacgagtgacttaaaaacgagtgatcaagagattaaaaggctgaaacaaaaaatcagctcgctcgaaaaaacggaaaaagatgaaaaagagcaggataaaaagaacgccgaaggtcaaggagacggaaaagtcgtcaaaatttatgaaagcatgcaaagcaataaagctgcaaaaattttaagcgaattaaaagaggaagaggcaatcaatattttagattctttaagcaaaaagaaagtgactgagatcctctcaaaaatgtctcctgataaagcggctgtattcacagaaaagcttgtgaaaaacgaggcgaaaaacgaagcgaaaaaagaagggggggaatagcttgaggctttttgacgcaatctcctttgatgccaaacctgcggtggacactgcacctgcaaaaacgagcaggacgccgttgggcgcgctctttcagaatgtgctccagaaggaaaacagctcactttccccttttcaaaagggagaagagccttctcaggatacgccgttggaagggcttttgcatgaactgaagcaatggctttcaaataaggaagacagctctttcaatgaagactggctgaattcccttcagcagcttgaagagctgaatgcatctccggatgaactggcattggcagaacagctgttacaacaaataaaagagctgcttgaaaaagccgccctgcctgaacaatcaggcaaaacggctgatgctaaagctttgcctgccgacgaaagcgggacagaagagccgaaaaagcccgacctgcaaattctcggccagattcagcagctgctagctgcgattgtaaatgaaaatcaaccgtcactcaaaacttcgcaaatcgcagaattattgaaacaggcgccggaatttctcgccgctcttcaaacaaaggcgggagcagaagggctgattgatgagcttaaacgtcaatttttcacgaaagatccgagccaatcgcagcttttgtccatgtcaaacaccgagctgaaaagcttgaaaagcttaatggagcagatgatgaacgcaaacgctgaaccggatcaaaaagagtggaaaatggccgaaagcgaactcaaggcaatgctcatgagcaagaaaaccgatgtttctctttctgagaagccgttgtcctttgttttgaacagaagagaaattcaaactgaaggaaagcaaggccaaaaggaacagccgattcaatcctctgtactggccaatcatcggacaggcacagcgctgatccagggtctccagccttcggcggcagaggaagcttccgctcagccgaaaagcttttcagaacaaattctcagctcatggaaacagatgaagtatacgccgttcggcaggtcgacaggcagtttcacgatccgcctgaatcctgaaaatcttggctttatcacgatcaagctcgtcaaacagcacgggatgttttcaagcaaaatcatcgcatcgacccagtcggctaaagagctgctcgaacacaatctcgcgcatcttaaacaggcgctgcccaacatgtctgtgcaaattgaccgcttcggtgttccgcttcaaaacagcgatcagactttcggacagctggcggacgatgagaaaaaccagcatcagccgaagcaagatcagcaaagtaagcaggaaaatgaggattttcaggagtttctggatgagcttatcgagactcgatcacaggacagcgaggaggagatctaatgtctgatacttcaattgataccagaaccgccttaggaacaacaaacacgaaatcgacgacatccgattttttatccgaggcaaaaaaagccgagaaagcagggagcggctccaatcttgggaaggatgaatttttgaaactgctgatgaaacaactgcagtaccaagatcccttaaatccgatggaagaccgcgaattcattgcgcaaatggcgaccttttcaagcctagagcagctaacgaatctgaacacaacgatgtcgacgttcgtcggacttcaggacccgatgacgatgtatgtcagctggatcggaaaagaagtcacctatgaaggcgaagacagcgaagaaaaaacggcgctcgtcaaatcagttaaaagctcagacggacagtatctgcttgtccttgacgatggaaccgaagtcaatccgtggaatgtgacggcggtaagccattctgataaataaaaacagacaattcagggaggaataattatgttacgttcactatactcaggaatcagcggcatgaaaaactttcagacaaagcttgatgtcgtcgccaacaacatctcgaatatcaatacggcaggctataagaaaagccgggttacgtttaaagatattgtcagccagcagctttccggcgcgtcgtctactgcaaaccgcggctctgtaaacggccagcaggtcggactcggtgcaacgatcggatcgatcgatatcattcacacaaacgcagcgccttcgacaacaggccgccagcttgacatgaccattacaggagacggctacttccgcgtcggatcaggagatgaagtgtactacacaagatcaggaaacttctaccgatctgatgaaggtgacctcgtcactgttgacgggctgttcgtcttaacggccaataatggaagaatcaacattccgcaagacgcgcaaagcttcagcatcgctcctgacggaaccgtttcttatgtcgatcaaaacaacgagaaccagaccgccggccagatctcgcttgcgacattcagcaacacatccggattatcaaaagctggagacaacctttaccgcgaaacattgagttcgggagatccgcaagtcgttgtacctggggaaggcggctcaggaaaaattcaaacgagtgcgcttgaaatgtcgaacgtcgacctttcagaagaattttccgaaatgattatcgcgcagcgcggcttccagtccaatgcgaaaatcattacaacctctgatgaaattcttcaggaactcgtcaatctgaagcgataggagggaaggaggcgccctcgtgaaggcgcctcttgataacacatgatcaaagttacgcgattaaacggacagccctttattctgaatgcactattcattgagcaaattgaatgttttccggatacgacaattacgctgtccaacggaaaaaagtttgttgtcaaagaagatgaagatacagttgtggatacaatcgtgtcattctatcaaaaaatccaaatactttcttgtgaccaaagaattgaggaatctgaatgaataaaaaacttctaggaattatgatgacgattattttggcaattgctgtgttgggaaccgctgcgttctttgtcatcaagggaagcgcaagtgaaaaagatcaaaacgcagaaccttcgatcgatgaagtggtcgaatcttcagttgaagtcgccgaaatcacgacaaacttgaaatcagacaatgtagtccgtttgtcaatcaagcttgaaaccgattcgaaagaggcgaaagaagagcttgaaaagcgggatttccaaattaaagattcagtcatctcccttttggcgaacacgaacgcagatgagcttgaaggacaaaaaggaaaagaaaaatttaaagaacagctgaaagaaaagctgaacacgaactacatgaaagagggaaaagtgaaaactgtgtacattacctcctttaatctgcagtaggaacatagatgacagaaccatggaggtgaaaacagatggcaggagaagtgctctcccaaaatgaaatcgatgcactgctttcagcgatatcgaccggtgaaatggacgccgacgagctgaaaaaagaagagtccgttaaaaaagtaaaagtctatgactttaaacgggcgctccgcttttcaaaggatcaaatccgcagcttgaccaggattcacgataactttgcaaggctgctaacgacttatttctcagctcagttgagaacctatatccaaatctcggtcagctcggttgatcaggttccgtatgaggaattcatcagatcgattccgaatatgacgatcctcaatctgtttgaggttcgccctcttgaaggaagaatcatgatggagatcaacccgaccatcgcctatacgatgatggaccgggtgatgggcgggatcggctcgagccacaacaaaattgacagcatgacggagattgagacgaaaatcatgtccaatttattcgaaagctgtctcacgaattacaaagatgcgtgggaatccatcacggaaatcgagccggaaatgtccgattttgaagtgaatccgcagtttgtgcaaatggtatcgccgaatgagacggtcgttgtcatttcgctgaacacgcaaataggagacatcagcggggttatcaacctgtgcatcccgcacgtcgtcctggaaccgatcattcctaagctttccgttcactactggatgcaatcagacagaattgaaccaaaaccggaggaaacaaagtcgatagaaaagcggattttgacggcgcaaattccaattgtcgcagaactcggatcatcggaattaaccattgaagagtttttaaatttagaaattggagattgtatcactttggacaaatcagtagcagaacctcttactgttttggtcggagataaaccgaaatttctagcacaagccggccgaatgaatcgaaagactgcgattcaaattctagatcacgacataagaggtgaagaatatggagaataacaataggttatcacaggatgaaattgatgcgctgcttaaaggcggcgatgatacggctcaagagcagccagaatcagggttgtccctgatggaacaggatacgatcggggaaatcggaaacatttcctttgggagctctgcaacagctttgtccactttattgaatcaaaaagtcgaaattacaacgccgactgtttcggtgattgaaaaaagccatttaaatgatgagttcccgcacccgtatgtttcaatcggtgtgagctatacagaaggtttttcaggaaacaatcttctcgtcatcaagcaggaagatgccgcgatcattgctgacttgatgatggggggagacgggacgaacgcagatccgtcgcttggcgaaattcatctaagcgccgttcaggaagcgatgaaccaaatgatgggttccgctgcgacatcgatgtccaccgtcttcagcaagaagatcgatatttctccgccggaagttgacctccttgatgtgaaagaaggggaagggacagagcaaattccgaaagaggacccgctcgtcaaagtatctttcagactaaaagtcggagatctgatcgattcgcatattatgcagctttatccgctgacctttgcaaaagatctgattgatgaattaacaaatcaggacggcggagaagagcctgtgaagactgaagaggtacagacgcccgtacaggaaaaaccggcgcctaatccgaattcggcacctgctcagacacagagacaggagccggcgcctaaacggcaagggacggcaaaagtttcagagcctgtgcaggtggcaccggcagagtttcaatcctttgcccctcagactgaagcgcagccgcaccttcaaaaccttgacatgctcatggatattcctttgtccgtcacggtcgagctggggaggacaaaccgcagcgtcaaagaggtgcttgaactgtcaaccggcagtatcattgagcttgacaaactcgccggtgagcctgttgacatcttggtcaaccagcgcgtcgttgctaaaggcgaagtcgtcgtcatagacgaaaacttcggcgtcagggtgacagacattttgagtcaggctgaacgaatcagcaaattacgataataacagattgattggagagattaataatggcttacaagattttagtagttgatgatgcagcatttatgagaatgatgattaaagatattttggtgaaaaacggctttgaagtcgtcgcagaagcgcaagacggggcacaggctgttgaaaagtataaagagcattcacctgatcttgtcacaatggatatcacgatgccggaaaaagacggaatcacggctcttaaagaaatcaaggaaatcgatccgcaggcaaaaatcatcatgtgttcggcaatgggccagcaatcgatggttatcgacgccatccaggcgggagcgaaagactttatcgtcaaaccgttccaggctgaccgcgtcatggaagccatcaataaaacgctaagctaaagggtgtacaacttgtttaagaaacctcttattttcatagccggcctttgtctatgcgcctttctcgcattgccgtacgctccggctctcgcagaggaatcgggggaccagaccgttgatcatctgtttgagcaaaaaggtgcgggcaaagagaaagaaaaagcaaaagacaaagacaaaaccgaggaaaaaagttctctaaaggaagaggcggagaccgaacccccgtctccttccgtttccatatttgattttgtgaaaatgatcggcgcgttactgttcgtcatttttctgatctatgctttggtcaaattcatgaataaacgcaaccgtttgctaaaacccttccagtatgttgaaaacatcggcgggacttcactcgggcaaaacaagtccgtacagctgattaaagtaggaaacagggtgctggtcgtcggtgtcggcgaaaatatccagctgctgaaagagatcgatgatgaaaaggaatataaagaaattctcacgcagcatgaagctgcgatgaacagcaagattgaatggcagaaatggatggatcaagtcaaagttccaggcgtgcaaaaacaaagcggcacggcatctttttccgagtcgttaaaagcacagcttgcggaactgaaacaaaatcgcgcagaaggcagaaagaaaggccaaaatcaacatgaatgagtttatggatttatttaattcaagcgatgcggcaaatgtcagcgccagcgtccggctcttgctgcttttgacagtattttcgatcgctccgggtatcttgatcttgatgacttgtttcacaagggttgtcatcgtcctgtcctttgtccggacatcgctggcaacacagtcaatgcccccaaaccaggtgctgatcggacttgcactgttcctgacatttttcattatggggccgactttttcagagattaataaagaagcgctgacgcctttaatgaacaataaaatcaccttggatgaagcttatacaaaagcggaagccccgatcaaaacatttatgagcaagcatacaagacagaaagatctggctttatttatgaattacgcaaagatggaaacgcctgagtccatcaatgatattccgctttcaactatggttcctgcgtttgtcatctcggaattgaaaaccgcgtttcaaatgggatttatgatatttataccgtttctgattatcgatatggttgtggcaagtgttttgatgtcgatggggatgatgatgcttccgccggtcatgatttcactgccgtttaagattttgctgtttgtgcttgtagatggctggtatttaatcgttaaatctttgctgcaaagcttttagagtaggtgctaatacatgaattcagaatttgttatatcgatggctgaaagggctgtatacgttacattgcttatcagcgggccgcttttggcgctcgctcttctcgtcgggctgatcgtcagcgtttttcaggcaaccacccaaatacaggaacagactcttgcattcattccgaaaatcgtcgccgttttggtcggactcgtcgttttcggcccgtggatgctgtcgacgattttgtcattcgcgactgagctgttctctaatttaaaccgttttgcagggtagttttaacatgtcaataatcgaatcatttccagcctttttacttgtgtttgtcagaatcacagcattctatgtaacggtgcctctattttcttatcggacaattccggccgttcataaaataggttttgcattttttcttgcgctcgtcagttttcaagcgattgaaaagcctcctcaccttgacgttgacggaatttacatgatgttggccatgaaggaagcgctcatcggacttctgcttgggctgatcgcttacatgatgatctcagccgttcaaatcgccggatcgttcattgattttcaaatgggatttgcggtggcgaatgtgatcgatccacagacaggggcgcaaagcccgcttgtcggccagtttttatatacgatggcgctgcttctcatgctgagcctgaatgcgcatcatctcctgcttgacgggatctattacagctatcaatacattccggtcgacaagatggcgctgtcgtttggaagcgaagaatttgccgagtttatcgcaaaaagcttcaatacgatgtttattacagcatttcaattgtctgcgcctgttgtggcttgtttgtttttagtcgatctggcattggggattgtggcgagaacggtgccgcagctcaacgtgtttgtcgtcgggcttcctttgaaaatcgcgatcacctttatcatgctcatcatctgcatggccgttatgttcagcatgatgcagcacgtcttcgaatttgccattcggacaatgagagatctattaactttgcttggggtggcatgatgaagctgacgttggatttgcaatttttcgcaggtgaaaaaacggaaaaagcgacgccgaaaaaacggcgggaaagcagaaaaaaaggtcaggttgccaaaagtgcagatgtcaatacggcggtcactcttctcatcgtgtttttatcctttttattcatcggaccttttatgagagaccgcctgctcggcctgatcgaaaagtattacaaagaattaatcacgatgaaggtgtcagtcgccaatattcccggcctgtttcaaagtgttgtgcttgaatcgggcctcattatggcaccgcttttgctgacagccgtcgtctctggggtattgagcaactatatgcaagtcgggtttttatttgcccctgaagcgatcaagcctgatttgaaaaagcttgacccgcttaatggattcaagcggatttacagcatcagggcgatcgttgaactgcttaaatcgattttaaaaatcgtgattgtcggaggcgtgacattcgccgttttatggctgaactttgacaaaattctcagaatcccggcgctgtcggctggcgaggctttgtcatatgtcggctggctcacctttttaatgggggtttccgctgcagtcgcattaatttttctcgcggtgctcgattacctctatcaaaaatttgactatgaaaaaaatattcgcatgtcaaaacaggacatcaaagacgaatacaaaaaaaccgaaggcgatcctctgatcaagtcgaagatcaagcagaagcaaaaggaaatggcgatgcgccgcatgatgcaggaagtgccaaaagcggatgtcatcatcacaaacccgacccattacgccgtcgcattgaaatacgacgaaaacaaaatggatgcgccgtttatcatcgcaaaaggggtcgatctaatggctctgaaaatcaggcagatcgccaaagaacacgatgtcatgacggtcgagaacaggcctttggcaagggcgctctatgaccaggttgagatcgaccaggccgttccggaagaattctttaaggccgtagccgaaatcctggcctatgtttacaaaacaaagcaaaaaatctagtgaatttttcagttttaaaaggagagaaacagcatgtctgcaagagatttatctattttatccggcgttgtcctcattgtggcaatgcttatcataccctttccaacatggatgttgagcatcttaattatcgttaatatttctcttgcgttaatcgtgcttctcaccacaatgaacatgcaagaaccgctgcaattttcgatttttccttctttgctgctcctcttgacgctgttccgccttgggctgaatgtatcgacgacgcgttcgattctgtccaacggtgatgcgggaaaagtagtcgagacgttcgggtctttcgttgtcggcggaaacgttttggtcggtctcgttgtctttatcattttgatcattattcaatttatcgtcataacgaaaggggcggaacgggtatctgaagttgctgccagattcacgctcgacgccatgccgggaaaacagatgagcattgatgccgatttgaatgccggaatggtgaccgagcaggaagcgaaggtgcgccgtgagaaggtggcccgtgaagccgacttctatggagcgatggacggagcgagcaaattcgtgaaaggggatgcgatcgcagggatcatcatcgtccttatcaacgtcattttcggaattgtcatcggcatgctgcaaaaacaaatgagcattcaggaagccgcttcacactttacactcctgtctgtaggcgacggaatcgtatctcagctgcctgcgctcttgatctcaacggcgacgggtatcgtcgtgacaagagcggcgtcggacggaaacctcggccacgatattacaggccagctgtttgcctatccgaagcttttgtatgtcacggcgggaacgattttcctgctcgggattttcacgccgatcggcattctcctgacaggccctctggctcttcttctcgccgcaggcggctatatgctctccaaagccggtgaagagaaggaaaaagtggaggatatccttgaggaagaagctgaagtggatgaattaaaaagccccgaaagcgtcgtccatctgcttgatattgatccgatcgagtttgaattcggctacggattgattccgcttgcagatgcaaatcagggcggcgatctgttggacagaattgtcatgatcaggcgccagctcgcgcttgaactcggacttgtcattccggtcgtcagaatcagggataacatcgctcttcagccgaacgagtacaggctcaaaattaaaggaaacgaagtcgcgaaaggcgagcttctcctcgatcactttctggcgatgtctccgacaggcgaagacgatcagatcgaagggattgacacaatcgaaccgtccttcggtcttccggctaaatggataccggaatctcagaaagatcaggccgaaatgctcgggtacacggttgtcgatccggcttcagtcgtatcgacccatattacggagcaggtgaaaaagcacgcccatgagctgatcggaagacaggaaacgaaacagctgatcgaccacttgaaagaatcttatcctgtactggtcgaagaggtctcgccgaatccgctgtctgtcggtgacattcagaaagtgctggcaaaacttctgaaagaaaaagtatcgatcaggaacttggtgacaatctttgaaacgctggccgactacggaaagctgacgacggattcagatatgctgaccgagtatgtcagacaggctctggccaagcagatcaccgcccaatatgcgaaggaaaatgagacgctgaaagtggtgacttgttcgggccgcgtcgaaaaggccgtggcggaaggaattcagcagactgaacacggcaactttttatctcttgaaccaacattatccgaaaatatcattcaatctgtagcaagagaaatcgaacagctctcattgaggcaggaagtgccgatccttctatgttcgccgcctgtcagaatgtatgtcaagcagctgcttgagcgctatttccctgatctgccggttctttcctataacgaattggaagccaatgtagaagttcaaagcatcggagtggtggatattcaatgaaaatcaaaaaatttgtagctggttctatgcaggaagccacaaagcaaattatacaggagctcgggaatgacgccgtaatcttgaattctaaaaaaattcaaaagagaaaatttctcggctttgtgaaaaaaaccggggttgaagtgatcgcggtcgtcgaccaggacttttccgacgcaaggaagcaagagcgtcaaaagcccgttttccgggaacaaagcccttcgcctgtcccgcagccggaccatcttgatttggcaagccaagtgaaagagctgaaagaactgctggaaatgcggcatcatgagcagcctgttgatgtgctgcctgaaccgctgaaaaaggcggaccagctcctggcaaagaaaggggtatcgccggccatccgtacgaaagcgctcggccggttgatcagcacttctttaagagacggcgaagagtggacggatgaaaagacgctggcgcacttaacagatgctttggccgatcttcttcccgataatctggaacaggacgtggcgattcattcgcaatatgtcgtgctcttcggatcgaccggagtcggcaaaacgacgacattggcaaagctcgccgcttcttctgtactggaaaagcagaaaaaaatcgcttttatcacgaccgatacgtacaggattgcagcggttgaacagctcaggacatatgccgagcttctgaatgcgccgcttgaggtgtgctacacgaaagaagagtttaaagctgcccagcaaaagttcgccgattttgaccacgtcttcattgatacggcgggccggaatttcaaagacgggcaatatgtcagggagctgaaggaaatcattccgtttgagcgtaagatacaggcgtttctcgtcatgtccgcgacgagcaagtacgaggatatgaaggagctcattaagcagttctcaagcattccgatcgatcagttgatattcacgaaagtggatgagaccgattcgttgggaagcgtcatgaatctgctcgccgaatcgagaatcggcctcggctatattacaaacggacaaaatgttccggaggatatccgctacttgtcaaacgcagcatttgtcagactgcttacggggtgttgaacatggatcaggcagaaagcctacgaaggcggatggggcagcgctttgccgaaccgcccgccgctatcgctcatccaaaagcgaaaacgctcgctgtcatgagcggaaaaggaggcgtcgggaagtcgaatgtatcgctgaatacggctctcgccattctggaaaaaggaaagagcgtgctgttgatcgatcttgatgtcggtatggggaacattgatattctgatcggccggcaatcgctctacacggtgatggacctcctccagcaaaaaatgccgtttgagcgcgccttgtcagccggcccgcgaggccttcaatacatttcgggcggaaccgggctggatgcaatgttcgaattgaacagggaaaactgggcgttttttctgaaggaattgacgcgggctttgacaagcttcgactatgtcatatttgacatgggagcggggctgtcaaaagatcagctgcctttcgtcctgtcagcggatgaaattctggtcgtcaccacgccggagccgacatccatcatggacgcatacagcgcgatcaagcatttggcattaaccggacgcgatcttcagctgaaagtcgttgtcaatcgctgtacaacccaaaaagacggaatttctgcttttctccgcctttccaacacggtaaacgcttttttgcagcaaaagcttgcatatgcagggccgattcctgaggatcccctggtctcaagagccgttgtggagcagcagccgtttctgataaagaatccgcgttccaagccgagcagggcggtttacctgctggccgaatcgctgcttcataacggcagaacggaaatgggcgaaaaccggtcctttatcgaaaaattatcttcattcctgaggaggggcaatacattatgattcgtgttcttgtcgttgacgactctgcttttatgagaaacatgatcaccaagtttttaacatccaatcacgagattgctgtagcaggaacggcaagaaacggcgaggaagcgctccaaaaaatcaaggagctccgtccggatgtgatcacattggatattgaaatgcctgtgatgaacggaaaagaaacgttgaaaaggattatggcgagcgatccgcttccggttgtcatggtatcgagcctgacgcagcagggagcagatatcacgatcgaatgtctggagcttggggcgatcgatttcgtcgcgaagccgtcgggttcgatttcaatagatttatataaagtaagagacatgctgattgagaaggttttgacagcaggacgggtgaaactgaaaggccggcaagttccgatctcaaagcccgccatcgagacggcgaagcagccgattgtgggcggcagcgattcagtccgctttcgggctggaaaacagctcatctgcatcggtacatcgacaggggggccgagggcgctgcaaagagtgcttcccaagcttcccaaaacgttgaaggcgcctgtttttatcgttcagcacatgccaaagggctttacggcctcattagcgaacaggctgaaccacctctcagaagtaaccgtgaaggaggctgaaaacggtgagagagcgaaagacggctgggtttacattgcacccggaggaaaaaacatggcggtcggccttgaaaagggcgaattggtgatcacgctcgatgaccgcgacacagaaagccgccacaagccttctgttgactacttgtttcaatccctggcctcacttcgggagtttgaaaaaatcgccgtcattatgacggggatgggaagcgacggaacagaaggcgtaaaaggccttttgaaacatgggagcggaacggtgatcgccgaagcagccgagtcgtccgtcgttttcggaatgccgaaatcggtcattaacaacgggcttgcaaacgacatcaagcatgttgatgagattgccgcagccattatgacgtatatgaaaaaagagagggcgtgactcatatggatatgaatcaatatttagacgtctttattgaagaaagcagagaacatttgcaaacctgtaacgaaaaattgctcgaactcgaaaaaaatccgacagacttgcagcttgtccatgatattttcagagcggctcataccttgaaagggatgagcgcaacgatgggctatgaagacatggctcatttaacgcacagtctggaaaacgtgctggatgcgattcgaaatgaagaaatgaccatcacgtcagagtggatggacgtcatgtttgaagcgctcgatgaccttgaagcaatcgtcctttcgatcatcgaaggcggcgacggcaaaagagatgtttccgaagtctgcgccaagcttgatgtgacaggggcaaacaaggaggcggcagcagcggcagaagcgcctgaagcggcgtcttccgaaacgaaatggtcctatgacgaatttcaacgaacggtcatcgccgaagctgaggaacaaggctttaaatgtttcgaaatcaaagttgcattgaaagaggactgtctgttgaagggcgttcgggtgtacatggtatttgagcagctgaacgaggtcggcgaagtcgttaaaacgattccggaaacagaagtccttgaatcggaggattttgattccgaattcgtcatctgctttttaagcaaacacggaaaagaagagattttcaacaaaatcaacggcgtatctgaaattgaaaaaatagaagtgaccgagctgaaaaacgatttttcggcacaagaagaagcgaagcccgccgcatccgaaaaagaaaccgcaccgaaagaggcggagaaaaaaccggctaagcagccggacggcaaaaaagacgcggcgaaacctgcggcaggcggcggaacgaagacgatccgcgtcaacatcgaccgcctcgattcattaatgaacctgtttgaagagctggtcattgacagggggcgcttagagcagatcgccaaagagctagaacacagcgaattaacggaaaccgtcgaacggatgactagaatttcaggcgacctgcagtcgatcatcctcaatatgagaatggttccggtagaaacggtgttcaaccgattcccgcgcatggtccgccagctgacaaaagaattaaataaaaagatcgagctgtcgattttcggagcggaaacagagcttgacagaacggtaatagacgaaatcggcgacccgcttgtccacctcttgagaaacagccttgatcacgggatcgaggcgcctgaagtcagggtgaaaaacggtaaacctgaaaccggtcaagtccgcctgaaagcataccacagcggtaaccatgtctttatcgaggtggaggatgacggcgccggcatcaaccgcaaaaaggtgctcgaaaaagcgcttgagcgcaacgtcattactgaacgcgaagccgaaacgatcgaagatcatgaaatcgacgcgctcatttttgcgccgggattctcaaccgcagatcaaatctcggatatttcaggacgcggagtcggcttagacgttgtcaaaagcaagctggaatcgttgggcggttctgtcagcatcaaatcgagcgaaggcgaaggttcgcttttctccatccagcttccgcttacactgtcgatcatttccgtgctgttagtcaaacttgaaaatgaaacgtttgcgattccgatttcttctattatagaaacggctgtcatcgataagaaagatattcttcaaacgcacgaccgcgaagtgatcgatttcaggggccatatcgtaccggtggtttacctgaaagaacagtttaatgttgaggattcttcagatgatcttgatcagcttcacgtcatcgtcgtgaaaaaaggagacaagctgacggcatttgttgtcgactcctttatcggccagcaggaagtcgtattaaaatcactcggcgattatttaacaaacgtctttgccatttccggcgcgacgattttgggagacggacaagtagccctgatcatcgactgcaacgcccttattaaatagaaagcgaaaggagagcgatcctcttgaccacacagactaccaccggtgagaaaatgattgtgttcaaagtaaatcataaagagtatgccatctctgtatcagaagtaatgtccattgaaaaatggcagcagccaacaagggtgccgggagtggaaccgtatatttgcggcgtcattaatttgagaggtgttgtcacacctgtcatcgatttaagaaagcggattgaagcgcctggagacacgattactgatgaaacgagaatcatcatcatcacccatcaggacattgaagtcggctgggtggtggatgaggcgaacgatgtcatcacagtcgaggaagaggaaattgaatcggctcccgaaacggtaggaaaagacggcaggcaatggattaaaggcatcgtcaagcaagggtccagacttctcaatctgattgactctgaagctgttttaaaccggaagtcgagccttgccgccgcttctgaaaatgtgaagaaataaggagccaatgatgagcgtatttaacggaattagagaagagcatcttgatatattgcgggaagtcgggaatatcggagcgggccattccgcttccgccctggccctgttgctgaacaggaaaatcgaaatggaagtgccgtttgtcaagctgatgtcgtttgatgagcttgtcaacctattcggcggtgcagatcttcctgtcgcaagcatctttttgcgcatggaaggggattttccaggttctatgttcgtgatcatgcctttttcagaggccgagcagctgatcagggagcttgtcggcaatccggaattcgagattgacagcatgacgccgaacgatatcggagcctctgccctgcacgaactcggaaacattatggcgggatcttatttgaccgctctcgctgatttgacaaaccggcaaatgtacccgagcgtcccagaactgacgctagatatgttcggagccgtcatcagcgaagggctgatcgagctcagccaagtcggagatcaagttatcgtgatcgacaactccatttttgacgaggagcacaaccggaaagttaaagcgcatttgttccttctgccggactatgattcttttgaaaagctctttcatgcattgggtgcagcgctatgaaaatcttagaaaaagaaacatcgattatcagagtgggaattgccgatgtaaaaatcgtccgcactcccgacaagatcagaacatcgggtctcggttcgtgcgtcgggctcgtgctgtatgatttggaagcaaagacggccggtctcgtccacgtcatgcttccggactcttccttatccaagacgccggacatcaacgtggcaaaatacgcggacacagccgtcgaagcgacggtcaagatgctgcttgaagccggatgccgaaaatacgctttgaaagcgaaaatggccggaggagccgaaatgtttaaatttaagatgacaaatgatttgatgaaagtcgggccaagaaatgtgcttgcgattaaaaaacatctatctctcttaaacattccgattgtaagcgaggatacaggcggaaacagcggaaggacgatcgagttcgatccgcaatcagctgaacttgtcatccggacagttaaacaaggtgtaacaacgatttaataagcaatatagggggataaagatgcaatccttgaactatgaagatcagatgctttggtcgcggtggaaagaatggaaagatcctcaggcaggcgatgatttaatccgccgctatatgccgcttgtgacatatcatgtcggccggatagccgtcggcttgcccaagtccgttcataaagacgatttggtcagccttggcatgctgggtttgtatgatgcccttgaaaaatttgatccgggaagggatttgaagtttgatacatacgcttccttcagaatcagaggcgctatcatcgacggtcttcgcaaagaagactggcttccgagaacgtcccgtgaaaaaacgaagaaagtggaagcagcgatcgaaaagctcgaacagcgttacttaagaaatgtttcgccgagcgaaatcgcagctgagctgggaatgagcgaacaagacgtcgtgaccacaatcaatgaaggtttctttgcgaacctcctttcaattgatgagaagcttcacgaccatgaagacggggagaacgtccaggtgatgataagggacgacaaaacgagcacgcctgaagaaaaaatgctcaaagacgaactgatctcccagcttgcggaaaaaataaacgagctatcagaaaaagagcagctcgtgatcagcttattctataaagaagagctgacgctgacggaaatcggacaggttttgaatttgtcgacttcccgtatttcacagattcactccaaggcgcttttgaaattgaagcatctgctggataaagtggtgcaatagcatgtaagctgccggcatgaaaccggcagcattttttaagcgtccgacgggaagtctttttttgattaaatttcatggttagcgagtgaaaaatatgtcaacaatattatggcttgtgagcttcacgctccacggtatattgatttatttcgtcatcattttgaatacgaggctcagcgctttcaaggcagcggagaaagagcaaaaacagcttttggaagaaaccgagaatacattgaccgcttttttgatggagttaaaagacgaaaatgaaaaactcgttcaagagattcgggcgaatgccgaaaaagagccgcaaagaccggaaacacagcctgaaattcccgctcaaacccccgtccttccggaagcggacgaatcgcgcgatctgccgcttcacatcgaagcgatgatcaatgaggtggagcaggaagaggatgagctcaatcaaaaggagcaggaagcatccatatcctatgaagaagaagctctcgcattatatgaaaaggggctctctccggaggaaatcgcaagacagctgaaaagcgggaaaacagaaatcgagcttttcttaaaatttcgcggaaagctcaaaaacgattcttgattgtcgagaaagcttatgttatattatttcttggtgttaattacacacgcttaacgatttatgcaagcggtgctgtgcgattctcgcgtgcagtcctgcataaaaatgacctaagcggaggaaaaaaaccattatattaggaggaaataacacatgtcagtcatttctatgaagcaattgcttgaagctggtgttcacttcggccaccaaacgcgccgctggaacccaaaaatgaagcgttacatcttcacggagcgtaacggaatctacatcatcgatcttcaaaaaacagtcaaaaaagttgaagaagcatacaacttcacgaaaaaccttgcagctgacggaggaaaaatccttttcgtcggtacgaaaaagcaagctcaagactctgttaaagaagaagcggaacgttctggaatgtactatgtcaaccaacgctggcttggcggtacattaacaaactttgaaacgatccaaaagcgtatcaaacgccttaaagatatcgaaaaaatgcaggaaaacggcacatttgacgtacttcctaaaaaagaagtcgttcaattgaaaaaagaattagagcgtcttgaaaaattcctcggcggaatcaaagaaatgaaagagcttcctgacgcactgttcatcatcgatcctcgcaaagagcgcatcgcggttgcagaagcgcgcaaactgaacattccgatcatcggaatcgttgacacaaactgcgatcctgatgaaatcgatgttgtcatccctgcgaacgatgacgccatccgcgctgttaaattgctgacttctaaaatggcagatgccatccttgaagcaaaacaaggtgaagaatcagctgaaacagaagcgaaagaagcagaaacaactgaaacaacaactgcttaacctgggtcaaaaggtgataagggggtctgccttttatcaccttttttttcaccagatcaacatttacatatgttgtttgatatataaggaggaaatcaaaaatggccaatcctgcacaaatggtaaaagagcttcgcgaaaaaactggcgcaggcatgatggactgcaagaaagcgttaacggaaactgacggcaacatggataaagcgatcgatcttctaagagaaaaaggaatcgcaaaggctgccaaaaaagctgaccgcatcgcggctgaaggcttgactttgatcaaaaccgacggcaacacaggcgttattcttgaagtgaactctgaaacggacttcgttgcgaaaaacgaaggcttcaaggagcttttgaacgacctggctgaccacattctggctgaaaagcctgaaagcgttgaagctgctatgggtcaaaaaatggctaacggttcaactgtagaagaatacatcacaagcgcggttgctaaaatcggagaaaaaatcacgcttcgccgcttcgctgtcctgacaaaaggcgatgacgctgcattcggcgcatacctgcacatgggcggaaaaatcggcgtattgactgtccttaacggcacaactgacgaagaaacagcaagagacatcgcaatgcacgttgcagctgtaaaccctcgcttcatttcccgcgaccaagtgtcagaagaagaagcgaaccgcgagcgcgaaatcttgactcagcaggcgcttcaagaaggcaaccctgaaaacatcgtcgcaaaaatggttgaaggccgcctgaacaaatatttcgaagaaatctgcctgcttgatcaagcgttcgttaaaaacccggatgaaaaagtgaaacaggtcgttgctgcgaaaaacgcaacggttgaaacgttcgtccgctacgaagttggagaaggtatcgaaaaacgccaagaaaactttgctgaagaagttatgaaccaagtgaaaaaataagattgaaaagccgcttgccataaaacacacggcaggatcttttcaaggaaaataggggacacaatttgtgtccctatttttaaaacagtttacaaacctttttttctcttgcataataaataacggcaagcatgcacttggaggttattatggaaaaaccaaagtataatcgtatcgtattaaagcttagcggagaagcccttgcgggtgaacagggaaacggcatcaacccgaccgtgatccagtccatcgccaaacaggtgaaagaaatcgccgagcttgatgttgaagtggcggtcgtcgtcggcggcggcaacctgtggcgcggaaaaacgggcagcgatctcggaatggaccgcgcaacagcggactacatgggaatgcttgcaacggttatgaattcccttgcgctgcaagacagccttgaaacgctcgggattcagtcaagagttcagacatccatcgaaatgaggcaggtcgctgagccatacataagaagaaaagcgattcgccatcttgaaaagaagcgcgtcgtcatcttcgctgccggtacaggcaatccatacttctcaacggatacgacagcagcgctcagagcggctgaaatcgaagccgacgtcatcttaatggccaaaaataatgtcgacggtgtatacaatgccgatcctagaactgacgaaacagccgtaaaatatgaaaaattgtcttatctcgatgtgttgaaagacggtttggctgtcatggattcaaccgcttcttcactttgcatggataacgacatcccgctgatcgccttttctattatggaagaaggaaatattaaaagagccgttttaggcgaacaaatcggtacaatcgtaagggggaaataacgtgtcaactcaagtgatgaatgaaacaaaagaacggatgcaaaaagcgataagcgcttatcagcgcgaattggccactgtccgcgcaggacgtgcaaatccgtcattgctggacaaagtggcagttgagtattacggagcgcagacgcctttaaaccagattgcgtccattacagttccagaagcgcgcatgctcgtcatcacaccatatgacaaaacggcgctcggcgatatcggaaaagcgattcaaaaagccgacctcggtgtaactccgtcaaacgacggcaatatcatccggatcacgatccctcctctaactgaggagcgcagaaaagagcttgccaaactcgtgaaaaaatattcggaagatgccaaagtcgcggtccgcaacatccgccgcgatgcaaatgacgatctgaaaaaactagagaaaaatggtgaaatgactgaggatgaattgcgctcttcaacggaagacgtacaaaagctgacagatgaatatgtgtcaaaaattgatgagatcacaaaagataaagagaaagaaatcatggaagtttaatgaaaaactctgtacaatagataatagtgaaaagaccctctcatgtttacagggggtttttttgttaatactgttgttatctagaacgatataacaggaaagcaaccttttgggtgatggaggactctcatgctcaatatactcaaaaattggaagaatcagcattcggctgcttccaacatggaatgttacacaaaagaaaatattttaaaaggagaaattcctgaacatatcgccattattatggacggaaacggccgctgggcaaagaagcgggcgatgccccgcatcgcgggtcatcacgaaggcatgaaagtggtcagacagacgacaaagcttgccaatgagctcggtgtcaaagcgttgacgctgtatgccttttcgacggaaaattggaagcgtccaaagcttgaggttgactttctgatgaagctgcctgaagagtttctgggaacgtatctcccggagctggtcgaagaaaatgtccgggtccgcatgacaggcgatagggaaggactgccgccccacacgatccgcgcggttgaaaaagccatccgtgatacggagaacaatgacggacttattcttaattttgcattgaattacgggggacgtgcagaaatcgtcagagccgcaaagaaaattgccgaagaagccaaaaaaggcacattgaataccgaggaaatcgacgaaaagctattttccgattatttaatgacagaaactttgcaggaccctgatttgctgattcgcacaagcggcgagatcaggctgagcaacttcatgctttggcagcttgcctacagcgaatttttatttaccgatgtattgtggcctgattttaaagacgttcacttgcttcaggctatcggagaatatcagcgtcgcgggagaaggtttggcggaatttagaggatggtgcagatgaaacagagaatattgacgggtgtgatcgcggcagcggtttttctgccgctcgtgattttcggcgagctgccgttcaccctgctagtttatgcaataggtatacttgctctatttgaacttttaagaatgaaaggcctgaagctgatcagcgctccgggtatcatcagcatgctgctgttggcggttttgctgtgtccaagccaatacgcggaagacgctgggctgggtataaccaaaggggaggtcgtctttttggcggtccttttgcttttggcatatacggtgctcagcaaaaactcgtttacttttgacgaagcggcattcgtggcgctggcagcagtttatatcggattcgggttttattactttattgaaatcagaaacatcggactcagctatgtcttttttgcgatcggcgtcgtctggtcaacagattccggcgcttattttatcggaaaggcgtttggaaagcggaagctctggcctgaaatcagccctaacaaaacggtagaaggcttttggggcggaattttgacagcggtcgttttttccgcgatttatcaggccgccacaggttttccgcacgcttatctgtttgtgctgatcattaccgtgcttttgtcaatcgtcggtcagatcggcgatttggccgagtctgcgttcaaaaggcattaccaggtgaaagactcgggccggatcctcccgggacacggcggaatgctggaccgctttgacagctttttatttgtcatgccggttctgtacttcctgcttgttctttttcagccgttcgggctatgatagaaaagggtactgatagctagaaagaaacagaggtgcggcaattttgaagaacatatgtctattgggagcgacaggctccataggagaacagacgcttgatgtcatcaaagcgcatgacgataagtttcggctgaccgccatgactttcggcaaaaacgccgaaaaagcggcagaaatcattgaaacctttaaaccgaagtatgtaggcgtcggggatgagcatacatatgaaacattaaaacagcattctttctcctacacctttaaaacagggatcggggaggaagctttaatcgaagcggccgttatcccggaagcggatatcgtcgtcaatgctctcgtcggcagcgtcggtcttcttccgactttaaaggcgatggagcataaaaaaacaattgcgcttgcaaataaggaaactctcgtgacagccggtcatatagtgaaagaacacgcccaaaaatacgatgtcccgctcctgcccgtcgacagcgaacattccgcgattttccaggcccttcagggggaaaatccgaagcatatcaaacggctgatcgtcacggcttcaggcggcagcttcagggacagaacaaggcgggaacttgaaggcgtcacagtggaagaagccctcaatcatccaaattggtcgatgggtgcaaaaatcacgatcgattcggctacaatgatgaataaaggactcgaggttattgaagcccactggctgtttgatctgccctatgaccagatcgatgtcctccttcacaaagaaagcattattcattcaatggttgaattccacgaccgcagcgtcatcgcccagcttggcacacctgatatgagagtgccgattcaatatgcgctcagccatccggaacgcctgccgtttaatgaagcaaaatccctcgatctctgggaagtcggacagctgaattttgcccaagctgattttgaaaggttccgctgcttacaattcgcttatgaatcaggtaaaataggcggtacaatgccgactgttttaaacgcggccaacgaggaagccgttgcggcatttctttcgggcaggatttcctttcttggaatagaagacatcattgaaaaggctttggaacgccatcaggtgatcgcaaagccgagccttcaagagatccgtgaagtggacaaagacgccagaaagtttgtccaaacattactcacataaggtggtatgttcgtgaatactgtgatcgcgtttattcttatttttggaacgctcgtatttttccatgagcttggtcatctcatccttgctcaaagagccggaatactgtgccgggagtttgctatcggcttcggtccgaaaatcttttcgtttaagaaaaatgagaccgtttatacgatcaggcttcttccgatcggcggctttgtcagaatggccggcgaagatcctgagatgattgaagtgaagcccggttatacggtcgggctgttgttcgacagcgaaaacaaggtcgaaaagatcattatcaaccaaaaagaaaagtatcccgacgcattggtcattgaagtggagcaggccgacctggagcaccagatgaggattacgggctatgagcacggcaatgaagatcatctctcttcattttctgtcagtgaaacgtcctttttcatcgtagacggggaagaagtccagatcgctccttacaaccgccaatttcattcgaaaacggtttggcagcgcatcaaagcgattgctgccggaccgatcatgaactttattttggcttatgtcatactcgtgatgctcggactgatgcagggagtgccgtctgacgagccggtgctcggcaagttgatagacaacggacgggcggcggaagcaggcctccaggagggagaccgcattcaaacgatcaacggggagaacatgaggtcgtggacggatattgtcaacacggtcagagaacaccctgaaaaagaactgaaaatcgttttgatgcgcgacaatgtcaagctgacgaaatacgtaacacctgaagctgtcaaggcaggggatgaaaccgtcggcagattcggcgcttacaatcctgtgaaaacaggcgttctgacatcgatttcctacggtgcgaccgaaacggcgacagtggcccagagcatcgtcaccaatctcggaaagctcgtcacaggacaattctcaatcgacatgctggccggtcctgtcggcatttatgacatgacagaccaagtggccaagacaggcgttatcaacctgctgaagctggccgcatttttaagcatcaacctcgggatcgtcaaccttctgccaatccctgcgctggacggcggaagactgttgttcctgtttattgaagcgatccgcgggaagccgatcaaccgcgaaaaagaagcgtttgtcgtctttatcggcgtcgcatttttgatgctcctaatgcttgtcgtcacatggaacgatatccagcgcttatttctgtaaaaccaatcgccttttttaagtgcagccaagccttttaaaaggctcttttttagggacaccgttcccgactcaaaaaagtaaccaactgaaacaaatgaggtgcgaatgaatgagacagagcaggactttaattcctacgctccgcgaagtgccggctgatgctgaagcgaaaagccatcagcttcttctcagagcagggtttatcagacaaaacacaagcggtgtatacagctatatgcctcttgccaataaagtcattcataaaatccagagcattgtccgcgaagaaatggagaaaatcaatgccgtcgaaatgctgatgccggcgctccagcaggcggaaacttggcaggaatcgggaagatggtatacgtacggtcctgagctcatgaggctgaaagaccgccacggccgtgaatttgccctaggcgcaacacacgaagaggtcatcacaagcatcgtcagagatgaagtgaaatcgtacaagcgccttccgctgaccctttaccagatccaatcgaagttccgcgatgaaaagcgcccgcgcttcggtctgttgagaggccgggaattcatcatgaaggatgcgtattccttccattcctccgccgaaagccttgatgaaacgtacaatgatatgtatcaggcgtatacgaatgtgtttacgcgctgcggcctgaatttcagaccggtcattgcagactcaggcgcgatgggcggaaaggatacccatgaatttatggcattgtccgatgtcggtgaggatacaattgcgtattctgatcagtcttcatacgccgccaacattgaaatggctgaagtgaaggaaacagatgccggcgagcaggcagaaatgaaagagctgcaggaagtccacacaccttcggtcaaaacgatcgaagaggttgccgcatttcttggcatatccccgtcagactgcattaaatcaatgctgatgaaagcagacggacgttttgtcctcgtcttgacgagaggggatcacgaagtcaatgatgttaaggtgaaaaacctgcttcaagcagaaataatcgaattcgcgagcgccgaagaggttgcagagataacaggcactgaacccggttttgtcggaccggtggggctcgaccgcgaaatcgaaatctttgcagactttgctgtgaaggcgatggcaaacgcagcagctggagcgaataaaacagattaccattatcaaaacgtgaatatcagccgggatgcgcacaatgtgacattcgccgatctccgctttatccaggaaggagacccttcaccggatggaaaaggaacgatccgttttgcaaaaggaatcgaagtcggacaagtctttaagctcggcacccgctattctgaagcgatggacgccacataccttgatgaaaacggacgcgctcagccgatgctgatgggctgctatggaatcgggatttcccggacgctttcggccatcgttgagcagcatcatgacgataaaggcttgatctggccgctggaagtgacgccgtatgacctgcatatcctcgcgcttaatatgaaaaatgacgcgcaagttcagcttgccgaaaagctgtatgaagaatttaaagcgaacggctatgacgtactgtttgatgaccgtgccgaacgggccggcgttaaatttgcagattccgatttgatcggtctgccgatccgcatcacggtcggaaaaagagctgacgaaggcgttgtcgaagtgaagatccgcaaaaccggagaatcctttgaaatcgctgctgatgagctgtttgactttatcgaaaaacaagtcaagagcttatcttctcactcttaaaacatggtaaactagagtaaaggaaggtacctcgggaatcgtcccaaggtaccttcaattatgattttcttttagggaggaatctgtcttggaagaccagctttctgtcaacagaagacagtttcaaattcttctgcagcagctgaatgtaacggaagatacgatgatccgccaccttgaaggcggacaaatcataaagctgaccgttcataaaaacaagaagacatggcactttcactttaaattgagaaatgtgctgccttatcaaatcttcgaacggtttcacagccagctgacccgcaccttttcccatatcgcccaggtcacctgttccatcgaggcggaaaacccttcgattgacgagcagcttgttcaggattactggacgcgctgcattcaggaactcgatggtatttctccgccgatcttggcgcttttgaacgaccaaaagcccaagcttacgggaaacaaaatcctgcttaaaacgaaaacagatacagaagcgtccgctttaaaaaagaaatacagctcgctcatccagtcaagctaccgcacattcggctttcctgagctccagctggacacagaaatttttgtatcagatcaagagattcagaaattcagagagcaaaaaatggccgaagatcaagagagggcccttcaggctttaatcgaaatggagaagcaggataaggaagcacaagacgatgaagcgccggcaggccctcttcagatcggctaccagattaaagactctgaagaaatcagaacgcttgacagcatcatggatgaagagcggagaattacggtgcaaggctatgtattcgacgctgaaacaagagagctgaaaagcggcagaacgctttgcatctttaaaataaccgactatacaaacagcattcttgtcaaaatgttcgcccgcgaaaaagaagacgctgtattgatgaagtccctgaaaaaagggatgtgggtcaaggcgagaggaagcatacaaaacgatacattcgtccgcgatttggtgatgatcgccaacgatgtcaatgaaatcaaagcgaaaacccgtgaggatacagcgccagaggacgaaaaacgagtcgagctccacctccattcaccaatgagccagatggatgccgtatcaagcatcggcaagcttgtcgaacaggcgaaaaaatgggggcacccggctatcgcgctcactgaccatgccgtagtccaatcgtttccggatgcattcgcggcaagcaaaaagcatggcgtgaaaatgatctacggacttgaagccaacctcgtcgacgacggcgtgccgattgcctacaatcccgtgcaccgtctgcttgaagaggaaacatatgtcgtgttcgacgtcgagacgacggggctgtctgccgtctatgatacaatcatcgagctggccgccgttaaagtaaaaggcggggaaatcatcgaacgctttgaaaggtttgccaacccgcatcgacctttatcggctacgatcatcgagctgacggggattaccgatgatatgctgaaagatgcgcccgaagtcgaagaggtcatccgcgattttaaagaatgggtcggtgatcacacgcttgtcgctcacaatgcaagctttgacatcggcttcatcaatgtcgcctataagcgcctgctgaattcggagaaagtgcagaacccggtcattgacacgcttgagctgggccgttttctttatccggaattcaaaaaccacaggctgaatacgctttgtaaaaagtttgacatcgagctcacccagcatcacagggcgatttatgataccgaagcgacgggttatctccttgtgaaaatgctgaaagatgcggccgaaaaaaatatcctgtaccacgatcagctgaatgaaaatatggggcagtccaatgcctatcagcgttcaaggccatatcacgcgacacttttggcggttaatgagacaggcttgaaaaaccttttcaaacttgtttcgctgtcgcatatccattatttttacagggtgccgaggatcccaaggtcacagcttgaaaagtacagagaagggcttttaatcggttcggcgtgcgacaaaggcgaagtatttgaaggcatgatgcagaaatcgccggaagaagttgaagacatcgcttcattttatgactaccttgaagtcatgccgcctgaagtctaccggcacctgcttcagctcgaactcgtcagggatgaaaaagcgttaaaagaaatcatcgccaacatcacaaagctcggcgagaagctgaatatcccagtagtagcaactggaaatgtccattatctgaaccctgaggacaaaatttaccggaagattctagtttcctcgcaaggcggcgcaaatccgctcaacaggcacgagctgccgaacgttcatttccgttcgacggatgaaatgcttgaggccttttcatttttgggtgaggaaaaagcgaaagaaatcgttgtcaagaacacccgcatgatcagcgagcgaatcgaagaaatcaagccgatcaaagacgatctttacacaccgaagatcgaaggcgcagatgacgaaatccgccgcatgagctatgagaaagcaagaagcatttacggcgaggacctgcccgaaatcgtcgaaaaacggatcgaaaaagagctgaaaagcataatcggccacggattcgccgtcatctatctgatctctcataagcttgtaaaacgctcccttgatgacggctatctcgtcggttcgaggggatcggtcggttcttcccttgtcgcaacattgacggaaattaccgaggtcaacccgctgccaccgcattacgtctgtccggattgccgccattccgagtttttcaacgacggatcggtcggttcgggatttgatttgcctgacaaagactgtccgaagtgcggagcggcctacagaaaagacggccacgacattccgtttgagacgttcctggggtttaaaggggacaaggttcctgatatcgacttgaacttctcgggcgaataccagccgcatgcccacaactatacgaaagtcctgttcggagaggataacgtctaccgtgcgggaacgatcggaacagtcgccgaaaaaacggcttacgggtatgtcaaagggtatgcaaacgacaacaatttgcatatgcgcggggcggaaatcgaccgacttgtccaaggctgtacaggcgtcaagcggacgacagggcagcacccgggcggaattatcgttgtgccggattatatggatatttacgacttttcaccaatccagtttccggcggatgccacagattccgaatggaagacgacgcattttgacttccattccatccatgacaaccttctgaagcttgatattctcggacacgatgatccgacggtcatccgtatgctccaggatcttagcgggattgatccgaaaacgattccgaccgatgatcctgaagtgatgaaaattttccaagggacagagtctttaggggtaaccgaggaacagatcggctgtaaaaccggtacactcggcatccctgaattcggaacccgctttgtcagacagatgcttgaggacaccaagccgacgacattttccgagctcgtacagatttccggcctgtcacacggtacggacgtatggctcggcaacgcgcaggagctgattcacaacaatatttgtgaactgagcgaagtgatcggctgccgtgatgacattatggtgtacttaatctaccaggggcttgagccatccctcgcctttaagattatggagtttgtccgtaaaggaaagggactgacgcctgagtgggaagaagaaatgaagaataataatgttccggactggtatatcgattcctgcaaaaaaatcaaatacatgttcccgaaagcccacgctgcggcatatgttttgatggcggtcaggatcgcttattttaaagtccatcatccgctgctctactacgcagcatacttcaccgtgcgggccgacgactttgacatcgaaacgatgatcaaaggatcgacagcgatcagagccgtcatggatgatatcaactctaaaggccttgacgcttctccaaaagagaaaagtttgctcacggtgcttgagctggcgcttgaaatgtgcgaaaggggcttctctttccaaaaagtcgatttatacagatcgagcgcttcagaattcatcattgatggaaacagcttgattccgccgtttaattcaataccggggcttggaacaaacgccgccttgaatattgtcaaagcgagggaagaaggcgaatttctttccaaagaagatttgcaaaaaagaggaaaggtgtcaaaaacgatcatggaatacttggagcgccacggctgtctcgagtcgcttccagatcagaaccagctgtcattattctagaaactgcctgcttaaagcaggcagtttttttatctgttttacggcataaagagcgttttttcggaattgggtgacaaatgccaggggagaaatgatcacaaaaaaataaagggctgtcagatctgttgacaataaataaacatcaatgttagaatttccaaaatataacacttcgtttggaatgtgctgtctattagatttctactctcataacttagtttattgaacaaataaactaagttacttatcaaattcctcgcttgcagccgtgtgctgatttaatgtgcaatcaatatcttcggtttttcaactttggccttgttttgttcgccggcaaatctaaaaggaggtgagcatgttgtagacagatggagttgcttgatcttaacgaacatgatggggaggaagcagtacgtgaaacagaaagcatttttaaaaatgaaagcgctttgtttggcacttttagtgatcttctctatgagcatagcgtcgttttcagaaaagacccgtgcagcttctgctgaagaatatcctcataattatgctgaactgctgcaaaagtctttgttattttatgaagcacagcgctcgggaagacttccggaaaacagccggctgaattggagaggagactccgggcttgaggacggaaaagacgttggcctcgatttaacgggagggtggtatgatgccggcgaccacgtgaagttcggtctgccgatggcttattctgccgcaatcctgtcatggtcggtctatgagtaccgagatgcctacaaagaatcgggtcagcttgatgcggcgctggacaatattaaatgggcgacagactactttcttaaagcccatacggctccttatgaattgtggggccaagtcggaaatggcgctctagaccacgcatggtgggggccggccgaagtaatgccgatgaagcgccctgcctataagatcgatgccggctgtccggggtcagaccttgctggtggtacagccgcagcgctagcatcagcatcaattattttcaagccgacagattcttcttactctgaaaaattactggctcatgccaagcaattgtatgattttgccgaccgctaccgcggcaaatattcagactgcattacagacgcacagcaatattataattcgtggagcgggtataaagatgaactgacatggggagctgtctggctctacttggcaacagaagaacaacaatatttggataaagcccttgcttcggtctcagattggggcgatcccgcaaactggccttaccgctggacgctttcctgggatgacgtcacttacggagcacagctgctgctcgctcgtctgacaaacgattcccgttttgtcaaatctgtcgaacgcaatcttgattattggtcgacaggctacagtcataatggaagcatagaacggatcacgtatacgccgggcggtttggcctggcttgagcagtggggatcattgcgatacgcttcgaatgccgcttttctcgctttcgtttattccgattgggtggatacagaaaaagcgaaaagatatcgggattttgctgttcggcaaacggagtatatgctaggagataatccgcagcagcgaagctttgtcgttggatacggtaaaaatccgccgaaacatccgcatcaccgtacagcacacggttcatgggccaatcagatgaatgtgcctgaaaaccatcgccataccctatacggcgcattagtcggcggtccgggaagggacgattcgtaccgagatgacataacagattatgcgtcaaacgaagttgcgatcgattataatgccgcttttaccggcaacgtagcgaaaatgtttcagctgttcgggaaaggccatgttccgctgcctgattttccggagaaggaaacacctgaggacgaatattttgcagaggcatcaatcaacagctccggaaacagctatactgaaatccgggcgcagctcaataaccgttcgggatggccggcaaagaaaaccgatcaattgtctttccgctactacgttgacttgacggaagctgtagaagcgggatattccgccgaagatataaaagtcacagccggctataacgaaggggcctcggtatcagagctgaagccgcatgacgcttcaaagcacatttactatacagaagtcagcttcagcggggttttgatttatccaggcggtcaatccgcccataaaaaagaagtgcagttccgcctttcggcaccagacggaacgtctttttggaacccggaaaatgaccactcttatcagggtctgtcacatgcgcttctgaagacgcggtatattcctgtttatgatgatggacggctcgttttcggacatgagcccggttactagatattgaacttcaagaggaggaacatcatggataataaaacacgttttatgcagctgtatgagcaaattaaaaatccgaacaacggttatttctcacccgaaggaattccctatcactcggttgaaacgctcatatgtgaggcgcccgactacggtcatatgacgacatctgaagcgtacagctattggctgtggcttgaagcgatgtatggccggtacacacaggactggtcaaagctagaagccgcctgggacaatatggagaaatatattatcccggtcaatgaaggagacggaaacgaagaacagccgaccatgaactactacaacccctcaagtccagccacttatgctgcagaacacccctacccagatctgtacccttcagcgctgaccggacagtatccggcaggaaatgacccgctcgatgccgagcttaaagcgacatatggaagcaacgaaacgtatttaatgcattggctgttagatgttgacaactggtatggcttcggaaatcttctgaacccttcgcacactgccgtttatgtgaacacttaccagcggggcgaacaggaatccgtttgggaaacggttccgcatccgtctcaggataatcagacgttcggaaaaccgaatgaaggtttcatgagcctttttacaaaagaaaatcaggctccagcaccgcaatggcgctacaccaatgcaacggatgcagatgcgcgcgccgttcaggcgatgttctgggccaggcaatggggctacagcaatactaattatttagaaaaagctaaaaaaatgggggactttctccgttacggcatgtatgacaaatactttcaagagattggaagtgccgctgacggctcgccttcccgcggtgctggaaaaaatgcatgtcattatttaatggcgtggtacaccgcttggggaggcggattgggacagtatgcaaactgggcgtggcggatcggtgcgagccatgtgcatcaaggttatcaaaaccctgttgcctcttatgcactgtcaacggctgaaggcggattgattccaaattcatccacagcgcgaagcgattgggaaaaggcgctgaaaaggcagctagaactttacacatggctgctttcttcagaaggagccgttgccggcggcgccacgaacagctggaacggcaactacagcgcatatccgcagaatgtcagcacattttacgaaatggcctacacagaagcgcctgtatatcacgatcccccttctaacaattggttcgggatgcaagtctggccgctggaaagggtggcggaactgtattatattttcgcagagaaaggtgacaaatcgtctgaaagcttccacatggcaaagcatgtgattgaaaaatggatcgcatattcacttgattatgtgtttgtgggcgaacggccggttactgacgaagaaggctattatttaaatgatgcgggagaacgcgtccttggcggccaaaacccgcagatcgccgtacaatccgacccaggcgagttttggattccggcaaaccttgaatggagcggccagcctgatccgtggaagggatttgattcatttaccggaaatccgggactgcatgtcacgacgaagaatccttctcaagatgtcggcgttctcggcagctatattaaaacgctcgtcttctttgcggccggaacaaaagccgaaaccggcggctttaccgctcttggaaacaaagccaaaaatctggcaaaagaactgcttgatgcagcatggagtaaaaatgacggaatcggtatcgcagcagaggaagaacatgaagattatatccgctactttacgaaggaaatctactttccgaatggctggagcggcagaaacgggcagggcaataccatccctggccccaacactgtgccgtctgatccggcaaaaggcggtaacggcgtctatatcagtcatgcggagctccggccgaaaattaaaaatgatccgatgtggccttatttggaaaacaaatatcagacctcgtggaatccgaatacgggcaaatgggaaaacggactgccgacctttgtatatcaccgtttctggtctcaggtcgatatggcgacagcttatgctgagtatgaccgtttaatcggaaatgcataacaatcaataggagaatattagatgcgcttggccgtttgggcaaaggcggcgttcagccgccttcttttttaaaggcaggatttaggattttagcgagtgttttacacgattatctaaaaaggagatcaaaagtttgagagaaaaatggttagccttatgtttaaagtcgatcattctgttcgttttgatcatgggaaccgttcttttatccgcagttccgaaagcttcgggaacaagcgggccagcaaagcaagaaaagcagagcatcatcaccccggctgatcttttggaaaacatgagccctggatggaaccttggcaacacgctggatgctgttccgacagaaggctcttggaacaatccgccggttcgcgagcatacttttgatgatattcgcgatgcggggtttaaaagcgtccggattccggtgacatgggattcccacatcggcagcgctccagagtatccgatcgataccgattggatgaaccgggtagaagaagtgacagattgggctttggaaagagagttttacgtcgtgttaaatattcaccacgattcttggctatggatcagccggatgggaaacagccagcaggagacattagataagctggggaaagtctggaagcagattgccgagcgcttcaaaaacaaaagtgaacgcctcctgtttgaaattgtcaatgagccgaccggaatgagcgcatatcaaatgaatctgcttaaccgagagatgctgaacatcatccgttcgaccggcggcaaaaacggccagcggctcgtaatcgtcggggggcttgaagataacaaagatgaattgcttcattcatttgaaccgcctgatgatgaccggattgtcctcacatatcactactattctccttgggattacgtatcaaactggtggggccggacgacttggggatcggcagccgaaatctccgagatggaggaggatatcaaaccggtttatgaaaaatttgtaagggaaggatacccggttatcatcggtgaatacggtaccctcggcgccaatgaaaagcattcaaaatggctctatcatgatacgtttgtccgccttgcccacaaatatcaaatggtcccgatgtggtgggacaacgggaatgaccagtttgaccgggctgagagacagtggcgtgatcctgttgttaaagagattgtcattcaggcgggacgcggcgttcccaatgcgatcatcaaaccggcagatctttttatcaaaaaaggtcaaagcatcagcgatcagacggtggacattcagctgaacggcaatgtgctgactggcatttatcagaaatctgaaccattaaaggaaggcagtgattatacagttgacaatgccggaaaaacggtctctattaaggcatcctgcttggcaaagctgctgaacggggcggggcagcctggggtaaaagcgcagctcacttttacgtttcataaaggagccagccaggttatggatatcattctttatgatgacccgaagcttgaaaaaagcgaattcaccatcagtcaatcggcaatcagcggtgatctcaaaatcccggcgtcactgaacggaacgaagctggccacggttaaaggagtcgtcgattctacaggaaggccggttcttgaagaagtatggtcatggacgccctacttgaactatgacgaagatttttacgaaaaagacggggatttgtatttgaaagagcgggttttaaagtatttgaaaagcgattccacctttacatttgaactgtggccgaaaggcgtggaggcggtcgtgaaggtgaaaatcacgccttgaacggccggctatcctctcaatgacgccgtccatgcatcctctttatgaaagcagggaaaaataatgatgacgaaaaagggtttattgacagtgctgatgccgtttttgcttgcactttccgccattcagtttggcaatccccggcctgcactagccgcgtctccttttgttgagacagccggaacatcgttcactttaaatgggaaagaattttattttgccgggacgaataactattattttcattataaatctaaaaaaatggtcgatgatgtgttcgaagatatgaaagcgatgaatttgaaagtgatccgcatctggggatttcttgacggccagccgcaggaaaatacagtcatgcagccaaggccgggcatatatgatgaatcaggcttttcaaagcttgactatgccatttataaagcggggcagacagggataaaactagtcatcccttttgtgaacaactgggatgatttcggcggaatgaatcaatatgtcaggtggtttcaggcggatggacatgacgccttttatactcatccggacattaaagaggcgtataaaaattatgtatcctatatgctgaaccgagtcaacacatataatggcgtcaaatataaagatgatcccgcgattatggcgtgggagcttgccaatgaaccgagggtccagtctgacaggaccggaaatacacttgtcgaatgggcggatgagatgagcgaatttattaaatccattgatcagaaccatcttgtagcggttggagatgaaggattttatcatatagaagggcaccctgattggcattacaacggcggagagggtgtggattggaaaaggctgaccgctctgaagcatattgattacggcacatatcacctctatccggatcattggggcaaaacggccgagtgggggaatcagtggatcacagaccatatttgcgatggaaaagaaatcggcaagccggtcgttttagaagagtacggctatcaggataagtccagaagggactacgtctacagaacctggcttgaactcatagaaaagcagagcggtgcgggcagccaattttggattttgaccggcattcaggatgacgggaccctttatccggactatgacggttttcggatcgtttatccgagctctgccgcttctgtcatttcagagcacgcggagcggatgaatgaaaaatcagccgcttccgaaatgcttcagactaaacgctgtcatgatttgcaataaaaatatggttatggtatagttttattggaaatgctaacgatagccgaggcgaagagtggggaaacccgctcttttgtattgaacaggcaattttgtctcgacatgttcatcgttttttctaaaatcccctgcttttgaagcagggtttttacgagggagctgatgaatgggagcctgcacaaggaggaaaagtatgagtaacaaagtgatcgataccgtcagcgaaatggtccagcctatactagacaatcttcagcttgagctcgttgacatcgaatttgtcaaggaaggccagagctggtttcttcgcgtgtttattgattcagatgacggcgtagacatcgaggaatgtgccaaggttagcgaagctcttagtgaaaagctcgatgaggctgatccgatcaagcaaaactattttcttgaagtatcgtccccgggagctgagaggcctttaaagaaagaagccgatttcatgaaggcgctcggaaaaaacgtatatattaaaacgtacgaacctattgaaggcaataaagagtttgaaggcgagctttccgcatttgacggtgaaaacgtggaggtcacggtgatgatcaaaacgcgccggaaaacgatcaatattccatatgacaaagtagccaaagcgaggctggctgtttcgttcaattaatttttgactgtttaagggggaaaccataaacatgagtagtgagttgttagatgccctgactgttcttgaaaaagaaaagggaatcagtaaggacattattattgaagcaattgaagctgcgctcatttccgcttataagcggaacttcaaccaggcgcagaacgtcagggtagatttaaaccgcgacaccggttcaatccgcgttttcgcccgcaaagatgtcgtggatgaagtgtatgatccgcgccttgaaatctcgattgaagatgccgtaaacatcaatccgaactacattgtcggagatgtcgtggaaatcgaagtgacgccgaaagatttcggccgcatcgctgcccagacggcaaagcaggtcgtgacccagcgcgtccgcgaagcggagcgcggcgtcatctattctgaattcatcgaccgcgaggaagatatcatgacaggcatcgtccagcggatcgacaataagttcatctatgtctctttaggaaaaatcgaggcgcttctcccggttgcagaacagatgccgaatgaagtctacaagcctcatgaccggatcaaggtgttcattacaaaagtcgaaaaaacgacgaagggtccgcagatttacgtttcaagaactcatccaggtttattaaagcgtctctttgaaatcgaagtgccggaaatttacgatggaacggtcgagctcaaatccgtggcgagagaagcgggagaccgctcgaagatttccgtccgcacggataatcccgacatcgatcccgtcggcgcctgcgtcggaccgaagggtcagcgcgttcaggcgatcgtcaatgaattgaaaggcgagaaaattgatattgttcactggtcaaacgacccggttgaatttgtcgccaatgcgctgagcccttcaaaagtgctcgacgtcatcgtcaatgaagaggataaagcgacaacggttgtcgttcctgactatcagctgtcgctcgccatcggaaaaagaggtcaaaacgcccgcctggcagccaagctgacaagctggaagatcgatattaaaagcgaaacagatgcaagagagcttggaatttatccaagggagcttgaagaagaggagccggaagagcttttcttggaaagcgaaactccagaatcggatgaataagaggtgacctttggtgaaaagccgaaagaagatcccgcttagaaaatgcgtcgtaacaggggaaatgaagcctaaaaaagagctcatccgcgtcgtccgttcgaaggaaggcgaagtttccgttgacccgaccggcaagaagaacggccggggagcctaccttacacttgataaagacgtcattttaactgcaaaaaagagaaacagcttagcaaatcagcttcaagcacagattgatgatcagatttttgatgaactgctggaactggcggaaaaggagaatagataaatgtcggaatcagaatggttttccttgctgggtctggcgaatcgagctcgaaaggtcgtgtccggagaagacctggttgtgaaagaaatcaggcattcgcgcgcaaagcttgttttgcttgcagacgacgcatcggctaacacggagaaaaaagtaaccgacaaatgcaggcactacgatgtaccggtgaaaaaagtcggtgatcgtgtgcttctgggccgttcaatcggcaaagaatcccgtgtggttgttgctgtcactgatcaaggttttgcgaatacgttgctccgaaagctcgattaattttttttgggggtgaacgaatggctaaaatgagagtttatgaatatgcaaaagccataaatgtttcaagtaaggatattatcgcggcattgaaagatatgaatatcgaagtcaataaccatatggcgatgatcgaagaaaatgcgatcaaacagctcgatcaaaaattcaagaagagcgctaaacctgcgggaaataaaaaggatgccggtacaggcggacaaaagccgcagcaagaagccgcaaaactgaatgccggaagtaagccaaacaaaaatcgagacggaaagaagaataacgtgcagaatactcaatttaacaataaaaacaagaagaaaaacaacaacaacaaaaagaacaaacgcggtaaaaatcatcaatctcctcaggagaagcagttcaagccgaaaaaagaactgcctgaaaaaatcgaatttaccaactcaatgtcggtcggcgcgcttgccgaagagctcggaaaagaaccgtcagaaatcattaaaaaattaatgcttctcggcatcatggcgacgatcaaccaagatcttgacaaagataccgttgagctgatcgcttcagaatacggcgtcgaagtcgaagaagtgatcgtccatgaagaaaccgaattcgaaaaatacgaagagccggataacgaagaagacctcgaaatccgtcctcctgtcgtaacgatcatgggtcacgtcgaccacggaaaaacaacgcttctcgacagcatcagaaaaacgaaggtcgttgaaggcgaagccggaggcatcactcagcatatcggcgcttatcagatcgaggaaaacggcaagaagattaccttcctcgacactccgggccacgccgcgtttacaacgatgcgcgcacgcggtgcggaagttacggacattacgattctcgtcgtagctgcagatgacggggtcatgccgcagacggttgaagcgatcaaccatgcgaaagcggctgaagtgccgatcatcgtcgctgtcaacaaaatcgacaaaccgacggcaaaccctgaccgcgtgatgcaggagctgactgaacacggtcttgttcctgaagcatggggaggcgagacgatttttgttcctctttccgcactttcaggagagggaatcgatgagctgatcgaaatgatcctgctcgtcagcgaagtcgaggagctcaaagcaaatccgaaccgcagggcaaaaggaacggtcatcgaagccgagcttgataaaggtaaaggttctgtcgcaacgttgctcgttcaaaacggaacgcttcacgtcggagatccgatcgtcgtcgggaacactttcggacgcgttcgtgcgatggtcaatgatgtcggcagacgcgtgaaatcggcgggaccgtcaactcctgttgagatcaccgggttgaacgaagttccgaacgcaggggatcagttccttgtgttcaaagacgaaaaaacagcccgttccgtcggcgaagcgcgcgctaccaaacagcttgaagaacagcgcagcgataaagcgaagctcagccttgatgacttgtttgaacagattaaacaaggcgatgtcaaagaaattaacctcgtcgtaaaagccgatgttcaaggctctgttgaagcgctggccgcagctttgcaaaaaattgaggtcgaaggcgtcagagtcaaaatcatccacacaggcgtaggtgcgattaccgaatcagacattattttagcttctgcatcaaatgcaatcgtgatcgggtttaatgtcagacctgacggaaatgctaagagtaccgccgaagccgaaaatgtggatatccgcctccaccgcatcatttataaagtcatcgatgagatcgaagcagccatgaaaggcatgcttgatcctgagtatgaagaaaaagtgatcggcatggttgaagtccgtcaaacattcaaagtctctaaaatcggaacgattgccggaggctatgtaacggaaggtacgatcacgcgcgacagcggaatccgcttgatccgcgacggcgtcgtcatctttgaaggggaagtcgatgtgctgaaacgctttaaagatgatgtcaaagaagtttcacaaggctatgaatgtggtatcaccattaagaaatacaacgacatacgcgaaggcgatatgatcgaagcgtatgtcatgcaagaaattgaaagaaagtgatcggtttcgttgaatgcgaatgcatcatttacgatgcatcatcactcaaggaaaagcgggcggtgctgaagcggatcatcacaagaatccgcgccaagttcaacgtttctgtttcagaaattgactatcaggacacttggcagcgcacaagctttggtatcgccgccgtttcttcctctcgcgtgcaaacggaaaaagagctgcagcgggtcctcgcctttattgactcttttccggaaattgaacggacgatcacgagaacagagtggttttaacgtagaggtggtatggtcatgacgatgagagctacccgtgtgggagagcagatgaaaaaagaacttggtgacattatcggcagaaagctgaaagatccgcgaatcggatttttaacagtcaccgacgtcagggtctcaggtgatttgcaaattgccaaagtgtatatttccgttttaggcgatgaaaagaaacgggaagaaacgctcaaaggcctggcaaaagcaaagggctttattcgttccgaacttggaaaccgaatcaggcttcgcaaaacacctgaaatccattttgagttcgatgaatcgatcgattacggaaaccgtatcgaaacattgattcacgagctgaacgcaaacaaagaagaatcataagctgaaaaaggataggcgggcgactgcctgtcctttttagctccaaatgagaaaggggcgaagaagcacgaatgtataacggagtccttctattacataaaccggtcggcatgacctcgcacgactgcgtcatgaagatccgcaaactgctgaaaacaaaaaaggtcggccataccggtacactggatcccgaggtgtcgggcgttctcccgatctgcgtcgggagggcaaccaaaatcgtcgagtatttgaccgaaaagtccaaaacatatgatgcagaggtcacgcttggctgttccacggagacagaggatcagacgggggaagtcacagaaaagaaacccgtcttagcgccgcctgatgaacagaccgtgcagagcgtcctgagatctcttgaaggaacgattgagcaggttccgccgatgtattcagctgtcaaggtaggcggcaaaaagctgtatgaatacgcgcgggctggaatcgaggttgaacggccgaagcggaccatcaccatccatcatatcgaactgacatccgagatccgccatgagggggataaagcccgcttccggtttgttgtgacatgttcaaaaggcacatatgtcaggaccttggcggtaaccatcggggagaagctcggatatcccgcgcatatgtccaatctggtcaggaccgcgtcaggccctttcacccttgacgaatgcttgacctttgaagacgtcgaaggcttgatcgctgacggaacattgtctgaaaagctcgtccccatcgaacgtgcgcttgatcatttgccgaaatggataattagtgatacattagctaagaaagtggaaaatggagcggtgcttgaaacgcccggcagcttttctcatttgacgagcgaagaccgcattgcggtctttacggaagcaggccggtgcacagccgtctattatccgcatccgaccaaaaccggtttgttgaagccggcaaaagtacacgtgcaaaaaagcgaacaatagaattaggtgaccgttcttgaagacgatacatatttcccacccacacgacttgaagcgtgaggattttccgacatcagttatggcattaggttattttgacggtgttcacctgggacatcagcaagtgattcttacagcaaaaaacaccgcggcaagagaaggggtcaaaacgtccgtgatgacctttcatccccacccttctgccgtgctcaaaaaaggccgggagccgaaggatttaatcacgcctttgcaagacaaaatcagcatcattgaagatttaggggtcgattttttatacgttgtcacatttacccctgaattcgcttctctatcacctgaggaatttatcgatcaatatatactcggctttcatgtcactcatgttgtagccggatttgactttaccttcgggaaattcggcaaaggcactatggaaaacttccaggagtatgcgaaaggccgtgttaaaagcacgtctgtcgcaaaatattccaatcaggatcaaaaggtaagctccacgaggatccgcagcgttctgggagccggtgacgtcgagtacgctgctgaactgctcggcaggccgtaccatgtgaaaggctttgtgatccacggcgataaaagaggccgcacgatcggatttccgaccgcgaatatcggccttaaagacacatacatcgtcccgccgacaggtgtgtacgccgttaaagccgaaatcggcggcgctgtctacaacggcgtctgcaatgtcggatacaagccgacgttttacgaaaaacggccgggtcagccttcaatcgaagtcaacttattcgattttgaccgtgacatatacggctccgaaatcaaggttgaatggtataagcggctgaggagcgaaaaaaaattcggcagcgttgacgagcttgtcgaacagatttctagagacaaagaagaagcgatccgcttcttcagagagcggaagccggccggaatctagatgtatggaaacggcaatacgcgtcaacaatggtgataaaaaggtaaacttcatcataaatggttgcattagacccgaacttttagtatcatattgtctgtagctttaaaaccgttcacttggcaaatcgaatcaccggcgtttgctaggtaatcggggctaatattatatggaggtgaaacaggatggcaattactcaagagcgtaaaacacaactcatcaatgagttcaaaacccacgaatctgacacgggatcaccggaagttcagatcgctatcctaacagatcaaatcaacaacttgaacgagcatttacgcactcacaagaaagaccatcactcacgtcgcggtcttcttaaaatggtaggtaaacgtcgtaatcttcttacgtatcttcgtaacaaagacgtaactcgttaccgtgagttgatcaacaaacttggattacgtcgataatcgtaaaaagcgggaggattcccgcttttttatcgtataagaacgaatatccggcaactctaaaacgcgttgttcatataaatgattttaaatgacaccgattcattctttacatagcactttgccattgatatgttcaattcatttcgttcataataggagtaacctaaaaactatccgaagagaggagttcatataagaatgggacaagagaaacatgtcttttccatagattgggccggccgcaagctcacagtagaaaccggccagcttgcaaaacaagcaaacggagctgtcatggtgcgttatggagacactgcagtgctcagcaccgcaacggcttcaaaagaacctaaaaccgtagactttttcccgttaaccgtaaattacgaagaaagactttacgccgtcggaaagattccgggcgggtttattaaaagagagggaagaccgagcgaaaaagcgattctcgccagccggttaatcgacaggccgatccgcccgctgttcgcagacggcttccggaatgaagttcaagtcgtcagcatcgtcatgagcgttgaccaggattgttcgtcagaaatggcggcaatgtttggatcatctcttgcgctgtgcgtatccgacatcccgtttgaagggccgatcgccggagtgacggtaggccgggttgacaacaaattcatcatcaatccgacacttgaacagcttgaaaaaagcgacattcatctcgtcgtagcgggaacgaaggacgcgatcaacatggttgaagcgggagcagacgaagttccggaagagatcatgcttgaagcgatcatgttcggtcacgaggagatcaaacggctgattgccttccaggaggaaatcgtcgccgctgtcgggaaagaaaaatcagaaatcaccctgtatgagatcgattccgatctgaaagaaaaagtgcggggaatggccgaatcgaacctcttaaaagccattcaggttcatgaaaagcatgcgcgcgaggacgcgatcagcgaagtgaaaaacgaggttttggccaagtttgaagaagaggaacacgatgaagaaacgctgaaacaagtgaaagacattttgtcccagcttgttaaaaatgaagtgcgccgtctgattacggaggaaaaagttcgtcctgacggcagggctgtcgatgagatccgcccgctttcttcagaagtcggactgcttccgagaacacacggttcaggactttttacaaggggacagactcaggcgctcagcatttgtacgctcggtgcgcttggcgatgtgcagattttagacggtctcggcgtcgaagaatccaaacgctttatgcaccattacaacttcccgcagttcagcgtcggggaaacagggccgatgcgcgggccgggacgccgcgaaatcgggcacggagccctcggggaacgagcgcttgagccgattgttccgtctgaaaaagacttcccgtacaccatccgcctcgtctctgaagtgcttgaatcaaacggttccacttcccaggcgagcatttgtgcaagcacgctagcgatgatggatgcaggggtgccgattaaagccccggttgccggaatcgcgatgggtcttgtcaaatcaggtgacaactataccgtcttaaccgatattcaaggtatggaagaccatctcggggatatggactttaaagtggcgggaacgtccaaaggcgtcacagctctgcaaatggatattaagatcgaaggcttatcgagagagattttggaagaggctcttcagcaggcgaaaaaaggcagaatggagatccttgaaagcatgctgagcacattggctgaatcaagaaaagagctttctccttatgcgccgaaaatcttgacgatgtcgatcaatccggataaaatccgcgacgtcatcggaccaagcggaaaacaaatcaataagatcattgaagatacaggcgttaaaatcgatattgaacaagacggcacaatcttcatttcttctaccgatgaaagcatgaaccaaaaagcgaagaaaatcatcgaagaccttgtcagagaagttgaagtcggacagctttacttaggtaaagtgaagcggattgaaaaattcggagctttcgttgaactgttcagcggaaaagacggtcttgtccatatttcagagcttgcgctcgaacgggtaggaaaagtcgaagatgtcgtcaaaatcggcgacgagctccttgtaaaggttactgaaatcgataaacaaggacgcgtcaacttatcaagaaaagctgtactgcgtgaacagaaggaaaaagaagaacaaaaatcgtaaaaaaaacggtgtctatcttgcttctgtcttcgtcttcaagcaacaggaagcctgggtaacccggcttctttgttttaagccgtgaaaacggtccggttctatcttgtccttttctcacatattttgtggggaagggaggaatacaattgaaaggaacgattgttcggatttccgtttttttctttcttttgctgatgtcctatcagatgatgaaccgtccgtattcacaacattacatagatgcgatgaaaaaagacgcggtcacggttgccgctcaaaaggacgatttgtaccaggagcttttgcaaaaagcgcctgaatatgaagtgaaggcccagaatgcgaaaattgatcacatatggaaagcgatgcccggctacaacggcttaaaagtaaacatcgaaaaatcgtacaaaaaaatgaaacaggccggtgaatttgatgagaaactgctcgtttatgaccaagtgaagcctgacgttcatttagaatccttaaagcctgagccgatctaccgcggacacccggataaaccgatggtatcgtttattatcaatgtcgcttggggtaatgaatatttagaagagatgcttcccgtcttacaacagcatcgtatcaaagccaccttttttctggagggcagatgggtgaagcatcaccccgagctggccaaagccatacaaaacggcgggcatgaaatcggaaaccattcatacaatcatccggatatgagcaaactgacgagagaacgtatttcagaacagctgcggatgacaaatgaacaaatacaggaaacgcttggcgtcaagccgaagtggttcgccccgccgagcggcagcttccgcaaagaggttgtggatcaggctcacaagatggggatgggaacgatcatgtggacagttgatacgatcgattggcagaaaccgcagccggccgtcttacagcaacgggtattaagcaaagtacataacggcgccatgatattaatgcatccgacagatccaactgcaaaaagtcttgccgttttgatacagaacctgcatgaaaaaggctatcaaatcggaactgtttcacagctgatgaatgaaaaaaggcttgttgaagaataggatgtgcggcccgttctttgaataggaggaacaaatttgattaaacggtatacttgtcaaaatggggtaagaatcgtattcgaaaacaatcccaccgtccggtctgtggccatcggagtttggattggaaccggatcaagacatgaaacacccgaaattaacggcatttcgcactttcttgagcacatgtttttcaaggggacaaaaacgcgcactgcaagggacatcgcagagtctttcgatagaatcggcggacaggtcaacgcgtttacctcaaaggaatatacgtgctattacgccaaagtgctcgatgagcatgcaagctatgctctggaagtgctttctgacatgttctttcattcatcatttgacgaagaagaattaaaaaaagaaaaaaacgtcgtctatgaagagattaaaatgtatgaggacacacctgatgacatcgtccacgatctcttgagcaaggcgtcatacggcagccattccctcggctatccgatcctcggcacagaggaaacacttgccgaatttgacggagattcgctcagaaaatatatgaacgaatattacacgcctgaccgagtcgtcatttccatagccggaaatgtgccggaaacttttataaaagaagctgaaaagcatttcggttcatatgaagccaaaggcaaaagaaccggcatgacaaaaccggattttcaccatgagaaaatgacgcgcaaaaaggaaaccgaacaggctcacctctgcctcggcttcaacgggctggaagcaggccatccggaaatctacgatttgatcgttctcaataatattttgggaggaagcatgagcagccgcctctttcaggatgtccgcgaagataaaggtcttgcatattccgtgttcagctaccacacttcctatgaagacagcggcatgatgaccatctacgcgggaaccggcgcaaatcagcttcagctcctgtcagaaacgattcatgaaacactgcgtgcgctgaaaagcgacggtattacaccgaaagagcttgaaaacagcaaagagcaaatgaaaggcagcctgatgctcagtctcgaaagcacaaacagcaaaatgagccgcaacggcaaaaatgagcttttgctcggtaaacaccggacgcttgatgaaatcatcgaaaagttgaatgccgtcagcctcgagcgtgtgaacaatcttgccaaccggattttcaccgatgattactcatctgcattaatcagcccgtcgggtgagctgccgaaataatgcctccttaaaacatgcttgtctttttaggcaggcatgttttttgttatcggttcatacatcataacaaaagggggtttttttcatgaggctgagtgaactttcgggaaaagaaatcgttgatgttaagcgggccgaacggctcggcgtactggggcagacggaccttgagatcaatgagcaggacggtcagattaccgctcttatcatcccttctgttaaatggttcggactaggaagaaaacaggggaatgacattaaggtgccctggtcgcaaattcaaaaaatcggctcggatatgatcattttggatgttccggaaagcagcgtgacaaaagaggagtaagcaaggtggaaacccgcccgtcccatgggggcgggctttttgtttttctggatttcaattcaccgctatttcctttttgtcatatgatgaaattagcttatgaattagatccttgtcaaaaaagaaggtgaatgttagagccatgttaaccggattgacgattgcaatcatcggcggcgatgcaaggcagctcgagatcatccgcaagctgacggaacaggatgcaaaggtctttttaatcggttttgatcagcttgatcacgggtttaccggagctacaaaactaaagctgaacgaacttgattttggcacaatagacagcattattctgcctgtatcgggcacatcgatggaaggaacggttgcgactgttttttccaatgaaaaagtggtgttaaaacaggaacatttagaaaaaaccaagccgcactgcgcgatttattcagggatttcaaaccaatatttagacggcatggccaaaggggcgaaccgtcgtcttatcaagctctttgaaagagacgatattgcgatttacaactcgatacctacagtcgaaggtgccattatgatggccatacagcatacagactttacgattcacggctcgaatgtaatggttctcgggctggggcggacgggaatgagcatcagccggacgttctcggcgctcggcgcacgcgtaaaagtcggagctcgcgactccgcccacctcgccagaatcatggagatgggcctcactcctttccacacaaacgaacttgcagagcatgttgaaaatatcgacatatgcatcaataccattccaagcctgattctcgataaacatgtcctctcacgaatgacacccagaacattaattctcgatttagcaacccgtcccggaggcacagattttgattttgccgaaaagcaaggcattaaagcgctgcttgctccaggacttcccgggatcgtcgcgcctaaaacggcgggacagatcattgccaatgttttgtgcaaccttttgtctgaattaacaactgaccgaaaggggctgtcataatgtcgatcaaaggaaaaagaatcggatttggcctaacgggttcacattgtacgtatgatgccgtttttccgcagattgaagcgctgatcaacaaaggggctgaagtcagaccggtcgtgacgcatactgtcaagtcgacggatacacgctttggagaaggggaagaatgggtcagaagaatagaagagctgactggatttgaagtcattgattccattccgaaagctgagcctctcgggccgaaaacaccgctggactgcatggttgttgcgccattgacgggaaattcgatgagcaagcttgcaaacgcccagacggacagtccggttctcatggcggccaaagcgacgatgagaaactcccgtcccgtcgtcctcggcatttcaacgaatgacgcgctcggcttgaacggcgtcaacttgatgaggctgatggcggcaaaaaatgtttactttattccgttcggccaggatgacccttacaaaaagccgaattcgctcgtcgccaaaatggatcttttagtgccggcggtcgaagaagcgctctcccataaacaaatacagcctatcctggtccataatgatcaataaatcttttgaaaataaagatgtaacaaaaaatatcaatcaccacggcacacatctatgttaaaataaaatgtaaaatgcatagtcaaccaatcgtttacgacgattaaggtggaaggagttttacaattgggcagaggattacatgtagcagtagttggtgcgacaggcgctgtaggacagcaaatgttaaaaacactagaagacaggaattttgaactggataaactgactttattatcctcaaaacgttcagcaggtacgaaactgactttcaaaggcgaagagtacacagtagaagaagctcgtcctgagagctttgaaggcgtcaacatcgcgcttttcagcgccgggggaagcgtttcgcaggcgcttgctcacgaggctgtcaaacgcggggcgatcgtcattgataatacgagcgcgttccggatggaccaaaacactccgctcgtcgtacctgaggtcaatgaggaagatttgcacaagcacaacgggattattgcaaatccgaactgttcaaccatccagatggttgttgcgctcgaaccgatccgcaaggctttcggtttaaacaaaatcatcgtatcgacttatcaggcggtgtctggagccggaaacgaagctgtaaaagagctctacgggcaaaccgaagccattttgaacgacaaaccgttcgagcctgagatcatgccggtgaagagtgatgaaaaacactaccaaatcgcatttaacgctattcctcaaatcgataaattccaggaaaacggctttacgtttgaggaaatgaaaatgataaatgaaacgaaaaaaatcatgcacatgcctgagcttcaagtttcagccacatgtgtcagactgccgattgcaacagggcattcagaatccgtctacatcgaaacagaccgtgatgatgtgacagcagaggatattaaaaatctgttaaaagaagctccaggcgtcgttctgcaggatgatccagctaaacaggtctatccgatgcctgcagatgcagtagggaaaagagacgtatttgtcggccgggtgagaaaagaccttgaccgcccgaacggtttccatctgtggatcgtttccgacaacctgctgaaaggcgcggcatggaattccgtacaaatcgcagaaagcctaaaagctttaaatttagtttaagatttctaacgggatgtgagaagagagtgaggcaaaaatgaaggcctgctctcttctgttacgtccgaaatcaacttggagtgaaataaagtgaaaatcatcgttcaaaaattcggcggaacgtctgtaaaagatgaccgcggcagaaagcttgccttaaaccatattaaggaagcggtcaatgaaggatacaaagcggttgtcgtcgtatcggccatgggccggaaaggcgatccgtatgcgactgattcattgcttgatctgctttacggcggacaggatacaattaccgagcgtgagcaggatatgcttttatcatgcggggaaacgatttcctctgttgtgttcgccagcatgcttttggaaaacgggattaaagctgctgctttaaccggtgcgcaagcgggctttttaacagacaacaaccatacgaatgcaaagattctcgaaatgaagccggagcggcttgtcagcatgctggccgaccatgatgcggtcgtcgtcgcaggcttccaaggcgcgactgcaaaaggggatatcacaacgatcggccgcggcggaagcgatacatcggccgctgcgcttggcgcggctctggacgcggaatttatcgatatttatacagatgtcgaaggcgtcatgacagctgatccgcgcatcgttgaaaaagcgaagccgctgcctgtgattacctatacggaaatctgtaatttagcctatcagggggccaaggtgatccacccgagagccgttgaaatcgcaatgcaggcgaaagtgccgatccgcgtgcgttcaacctattcaaacgaaaccggtacgctcgtcacaagccatcacaactcgaaagccggaagcgacgtttttgagcggctcatcacaggcatcgcccatgtgaaagacgtgacacagtttaaagtcccggcaaaagaaggacaatataacgtacagactgaagtgtttaaagcgatggcgaatgcgggcatcagcgtcgatttcttcaatattacaccaagtgaaattgtctacacggtggctggaaacatgacagaccgcgcccacagcatcctgaaggaattgggctatgaaccggccgtgacgagaaattgcgcgaaagtgtcagcggttggcgcggggattatgggcgttccaggcgtcacctcaaaaatcgttaccgctttgtcagaaaaaggcattccgatcctgcagtctgctgacagccatacgacgatatgggtgctcgtgcacgagaaaaatatggcgacggccgtaaatgcgctgcatgaagtgtttgaactgtcaaaataaatatgattgaatcatgatgaggtgaaaaaaatgaacttcggaaatatcgcaaccgcgatggttacgccctttgacaaaaatgaaaatatcgattttcaaaaactgtcaaagctgatcgattatttactaaacaatgggacggattccctggtcgttgccggaacaaccggagaatcgccgacgctttccgaagaagaaaaggtagcgctcattcaatactctgtcaaggaagcggcaggccgtgccccaatcatcgccggcacgggaagcaacaacacgaaggcgtcgatcaagctgacgaaaaaagctgaagaagccggcgctgacgctgtcatgctcgtcactccgtactacaacaagccttctcaggaaggcatgtaccgccatttcagagcgattgcggaggaaacatcgctgcctgtcatgctttataatgtgccgggaagaacggctgcttcgctcgcaccagagacgacaatccgccttgcggagatcccgaatattatcgccattaaagaagcgagcggcgacctagatgcgataacaaaaatcgtagccgaaacccctgaggactttgcagtttattcaggagatgacagcctgacactgccggcgctgtccgtgggagcgagaggaatcgtttccgttgcatcacacatcatcggaccggaaatgcaggaaatgatcaaacattataccgaggggaacacggctcaggctgctttgatccatcaaaagctgcttccgctgatgaaagggctttttgccgcaccgaacccgtctccattaaagacggctcttcagctgaagggtcttgacgtcgggtccgtccggctccctttgattccgctaaatgaagatgaacgactccgtttaagcagcctgatgaacggcctgtaaaaaacaatacggacgaaaacggtcattctcttttggaggggatgaccgtttgtcatatacataatggttcttgttttctaaatttagattcaggtataatagggacaagtgatgatggacgggtacttagattaggaggattacaatttgaaaaaaaatacagaaaatattagaatcatcgccttaggaggcgtcggagagatcggaaaaaacctctatgtcattgaaatcgattcagacatattcgtggttgacgccggcctcatgcatccagaaaatgaaatgctgggtatcgatgtggtcatccctgacatttcttatttaattgaacgatctgaccgcgtaaaggcgatttttctcacacacgggcatgaagaaaacatcggcggcgtattttactgcctgaacaagctttctgtgcctgtttacggaacgaagctgacgcttgcccttttaaaggaaacgctgaagcagtacggtgtaaacaaaaagcccgatttaagagaaattcattcaaaatccgttattacatttgaatcgacaaaggtgtcattcttcaaaacaaatcacagcatcccggattccgtcggtgtcagctttaaaacatccctcggatccatcgtgtgcacaggcgattttaaatttgaccagacacctgtgttaaaccagacaagcgacatcggcgaaattgccaaaatcggcaacagcggtgtgctgtgcctgctttccgacagcgccaatgccgagaagccgggctatacgccttcagaagcactcgttggcggagagatatccgatgtgatgtacaacgccgaaaaccgcgtgattattgccgtgttcgcgtctaactttaaccggattcagcaggtgattgatgccgcgctgcaaaacggcaggaagcttgcagtttcagggaaaaatatttcggcgatactccagctggcgatgaaactcgggtatgtcacggcagatgaagatatgttcatccctgtccaagaagtcaaaaagtatccaaaaagagaagtcgcgattttgacaggggacaaccatggagagccgctcgccgcattgaccaggatcgcaaaacaagggcataagcagcttgacattgaggaaggggataccgtcctgatcgcatcctcccctatcccgggtcaggagcttgtttactccaaagcggtcgatctcttaacgagagcgggcgcccaggtcgtattcgcacaaaaacgcgtccatgtatcaggccatggctgtcaagaagagctgaagctgatgctcaacttgctgaagccgaagtatttaatccccgtaaacggtgaatacagaatgcaaaaagcgcattccaagcttgccgaagaaatcggcatgaaacggagcgacattttcctgattgaaaaaggagatgtcgtggaattccgcggacaaaacgttaaaatcggcgataaagtacactcaggcaatatattgatcgacggactcggcgtcggcgatatcggcaacatcgtgctcagagaccgccgtctgctatcccaggacggaatcttaattgttgtgattacccttgataaaaagaaaaaacatctagtttcaggacccgaaattatcacgagaggttttgtctatgtcagagaatctgaacagctgatcgttgaagcgacagagcttgtcagggaactcgtcaacgaaagcacagaaaacgccgtcgtcgaatggtccgccttaaaacagacgatgcgtgaggcattaaaccagttcctatacgaaaaaacgaaacgaaaaccaatgatcattccaatcatcatggaagtataaaaaaccaagagactcctcttggttttttttcatgccttttgcgttgaatgaaaaaaacgccattgtccataatacaaaagaaactcgagaaagaggtgagccagatggattcaaaccggatacaaaacggggacagccaaggggagcagccggctaagcaggacgcaaaagacagtctcgtcaacaaaatccagcagctcggcgaaacgacactcccgcagatggggcaggacaccaacattcactgcctgaccattatcggacaaattgaaggtcacgtccagcttcctccccaaaacaaaacaacaaagtatgaacatgtgattccccagatcgttgcagtagagcagaatcctaaaatcgaaggtctgctcatcatcttaaacacggtcggaggagacgtagaagcgggccttgcgattgcggaaatgctggcgtccctgtcaaagccgacggtctctatcgtactgggcggcggacattcaatcggagttccaatcgcagtgtcctgcgaccacagctatatcgctgaaacagctacgatgacgatccatccggtcaggctgacagggcttgtcatcggtgtgccgcagacatttgagtatctcgacaaaatgcaggaaagggtcatcaatttcgtgacaagccattccaacatatcggaagaaaaatttaaagaactgatgttttcaaaaggcaatttaacccgtgacatcgggacgaatgtcgtaggaaacgatgcggttaaatacggattaatcgatgaaaccggcggagtcggacaggcgattcaaaagctgaatgaattaatcgaacaaaacaagggcgcccaggaagggatgatccaatgattctgtataaaaaaatgccgcaggaaatcgtgttcgcagggcaggcggaaaactcgaacttaaaacagatcgatgtaaacggcgtgccccttttagtcgagatgaacggagaggaagcaagggtcgttcaggttctcagcacgaacccgatggattttttaaaacaagaaacggcccctgggcagacgcttaaactgacattttataaatagctggagtgtctcaaggataaatatgctataataggggaatccagaggaaaatcgcagccgaaaaaaggctgctttctctttgtttttacattttttaacacgcagtaaggtgatggaacatggcaaaaagaaaacgaaaatcaacaaagaaacaaaaacaaggaaaaaaacggatccatcttaaatttgaattgtacggattaatctgtatcgccatctcgattattgcggttttgcagcttggcgtagcagggcaaacgttcatttacatgttccgctttttcgccggtgaatggttcatcctttgccttctcggcctctttttaacgggcttgtctttattttggaaaaagaaaacacccagttttttgacgaggagaaaagcgggcctttactgcatcattgcaagcatgctgcttctttcacatgtccagctgtttcagcatttgaccgaaaggggaatggttcagtctccgagcgtgatccaaaatacgtgggagctgtttctgatggatgtaaaaggcgagacaggatcgcctgatcttggaggcggaatgattggagcccttttattcgcggcgtcatattttctgtttgcatctgcaggatctaaaatcatcgccgtcttcctgatcttgatcggccttcttttgattacggatcggtcgcttcaggagacgctgatcaaatggatgaccccggtcgcctccttcatgaaaaaccagtggcaggcctttttagcagatcttaaacaattgaaaaacagctcgccgaaaaagaaatccggaaaaaaacaaaagacgcagagaaaaccgaaagtgtctgaagagcctgtacaagaagcggaccttgatccagatccggttattcaatcagaaccgattatttcaagcttttccgaccgtgatgaaaagcccgaagttcaagcttacgaagctccggcggctcctgctgaacctcctgctgagcccgaaatcggtgaggaaatgcaggcctccggcgcgcccgaaatcacgtttacagagctagaaaacaaggattaccagcttccgtcgattcaattgctggatgatccgaagcacacagggcagcaggcggataaaaagaatatttacgacaatgccaggaagctggaaaggacgtttcaaagcttcggagttaaggcgaaagtcacccaggttcatctcggcccggccgtcacgaaatatgaagtctatcctgatgtgggcgtcaaagtcagcaaaattgtcaacttaagtgacgacttggctttagcgctcgcggccaaggatatccgcatcgaagccccgatccccggaaaatcggcgattggaatcgaagtgccgaatgcggaagtggcgatggtttccttgaaagaagtgcttgaatcgaaactgaatgaccggccggatgcaaagctgatgatcggcctcggccggaacatttccggagaagcggtattggcagagctgaacaaaatgccccaccttcttgttgcaggagcgaccggaagcgggaaaagcgtctgtgtcaacgggatcattacaagcattttgatgagggcaaagccccacgaagtgaagatgatgatgattgatccgaaaatggtcgagctcaatgtctacaacgggattccgcatttgctcgctcccgtcgtgacagacccgaaaaaagcatcgcaggctttgaagaaagtcgtcaacgaaatggagcggcgctacgaattgttttctcacacgggaacgagaaatatcgaagggtataacgactatattaaacggatgaatgccgcagaagaagcaaagcagccggagcttccatacatcattgtgattgtggacgagcttgccgacctgatgatggtcgcttcctctgatgttgaagactcgatcacaaggctttcgcaaatggccagggcggcgggcatccacctgatcattgcgacgcagaggccttcggtcgatgttatcacaggggtcattaaagccaacattccgtcaaggatcgctttcagcgtatcgtctcagaccgactccaggacgattcttgatatgggaggcgctgaaaaacttctcggcagaggggacatgctgtttctccctgtcggcgccaataaaccgctccgcgttcaaggtgcctttctgtcagacgaagaagttgaaaaagttgtcgatcacgtcatcagccagcaaaaagcccaataccaagaagaaatgattccagaagagacgcaggaaacggtcagcgaagtgacagacgacctttatgacgaagcggtcgcacttgtggtcagcatgcagacggcttctgtatccatgctgcaaaggagattccgcatcggctatacaagagcggcgcggcttatcgatgccatggaagagcggggaatcgtcggcccatatgaaggatcaaaaccccgtgaagttctcttgtcaaaagagcaatacgaagaactctcttcttgagaagagagttcttgtttaacataatttcattatgtaaactaaaaaacatctatttatttatttgacaaaacatgatatagttatcctcaattaaagataatttgaatctgatctgtcagacggagggaaaacatgtcgataaaagctgacaatcaacggttatgtttaaaggtgattgatcggataaaagatgatattcaaaatggggtcttttgcgaaaatgaacggctcccgagtgaatttgagctgtcaaagatgcttggtgtgagcagaacggctttgcgtgaggcgcttagaatactggaagaagaaaacgtcatcatcagaaggcatggagtcggacattttgtaaatgccagaccgttatttctatcaggtattgagcagctgaacagcgtcacaaaaatgatcgagcaggcaagcatgacgccgggaaccatttttatgtcctcacaggttaccgctcccactgaagaagatatgctccggtttcaatatgcggaagaaaccgagatctttttgcttgagcgggtgagaacggcaaatggaatgccggttgtctactgtcttgataaaatacctgtggacattctcccggaaggcttttcacacgagcaggagtcgatgtttgaatggcttgagaacaaatccggcgccgtgatcagctacgctgttgccgatattgtgccaatcggatatcatgacaccatttcccaaattcttgaatgcgatcctgaaacgtctttgctgctgctcaaacagactcattatgaccaaaacgataagcccgttttatattctttaaactattttagggccgataaattcagatttcatgtcgtcagaaaacgtttttgatatgcgggcgctctattaggagcgtgttttttttgcccgcttgagcgcctatacataaataagcccgcatcatggaacaataacagatggaaatactgatgaattgggtgaaaaaagttgagcagaaaaaaagacatgaaaagcatttttgcgctgtcttcggtcccgctcgtgatgacgctcggcaattcgatgctgattccggttttgccggtgatcgaaaaaaaattaaacatttcttcgtttcaggtgtcgttgatcatcacggtttattcaattgtggcgattgtatgcatcccgattaccggctatatgtcggaccggttcggaagaaaaaagatcatgctcccatgccttctgattgcgggagctggaggagcgttagcaggtttggcttcaacttttttcaatgatccgtttgcgatgattttagcaggtcgcgtccttcaaggaatcggctcagccggcgcagcgccgatcgtcatgccgtttatcggcgacttgttccaaaatgatgaagaaatcagcgcgggactcggagatatagagacggcaaatactgccggcaaagtattaagcccgatattaggggcttttttagcatcttgggtttggtacatgccgttttggtttatcccggtcgtgtctcttgccagcttttttctcgtcttgttttttgttcccaaaccgaaggacaaagatgatgaaaagcaaacgttaaaaaactttgcaaaaagcgtacaggaaattttcaaacgggaaggtcggtggcttgtttccacttttgtcatcggcggaattattatgtttcttttattcggagtgctcttctacctgtcggatactttggagaagaagcatcaaattgacgggattgcgaaaggagcgcttctcagcattccgctgctttttctttccgtcagttcctaccttgccggaaagctgatcggaaacgataagatcagaatgaggatctgcgtgctgatcggcatgatcctgctggctttgtcgtttgccggtttgtggtggaaccacagcttttacccgttatttttgtttatgtccatcggcggcatcggcatcggaattgcgctcccttctttggatgcgctgattaccgagggaattgaaaaagaagagcgcggcacgatatcttcgttttacaacagcatgaggtttatcggtgttgcgctcggaccgccggttttcgcctatatgatgacaaatgcggggtggctgattttcatcgtatcgcttttgtgcagtttagctgcactagcgcttgtgctgtttaatattgacccgaaagaagacgaaagtgaagcggcaaagacggtgtagatctgcaccgtctttttcataaggttttttagtttccttaaatctcctccagttgatataattacaaccatacagtccaagcgcatatgctgaaatgtggtcataatacataatataaacaaggacgaaggaggttctagtatgacataccttaacgaaataaaaggaaagcaccgcggattgacaagccacattgtcaaaacggaaaaattcaaaaccgtctcgattatttttaaaatgcttgctcctttaacaaaagaggatgtgacaaagagggcgctttttccgcatgtgcttttgcggggaacgagcacccgccccaaaacggccgaactcagatcgtatcttgatgaactttacggcacttccgtatcatgcgatctctccaaaaaaggggaaatgcatgtcatcacattcaggctcgatatcgctaacgaaaaatttttaaaggatcagacaccgcttctggaaaaagggcttgagcttttgtcagagatcattttttcgccggcgcttgaagacggggcctttctgccgctgtacgtgtctcaggaaaaacgcacactaaagcaaagaatacaggcggtctataacgacaaaatgcgctattcaaatttgaggctgattcaggagatgtgcaaagatgagccatacgcgcttcacgtcaacggagagcttgatgatgtggacggcatcacgcctcaaagcctgtatgaagcttatcaaaaagcggtcagcgaagaccagctcgacatttacgtcgttggggatgtggatgagcagcaggtggattcgtacatttccaaatactttgaagcaaacgagcgggagctgagacctgttcccgagcttgagcaaacccgcacaagggagcctcaggaagtcatcgaggatgctgatgtcaagcaagggaagctgaacatgggatttcggacgggaacgcattttacggatgacgattatccggcgcttcagctgtttaacggcttgtttggcggattttcacattccaagctgtttattaatgtcagggaaaaggccagccttgcctattatgcggcttccagaatcgaaagctttaaagggctgttgatggtgatgtcggggattgaagtcggcaattatcaaaaagccgtcgacatcatcaaggagcagtttcaggaaatgaaaaaaggcagctttacagaagaggcaatcgaccagacgaaagccgtcattaaaaaccagattcttgaaacgcttgatacaccgtacggtttagtcgaatttatttatcagcaggctgccgcccaaaccgaattttccttggaagactggctgggacgaatcgacaatgtcacaaaagaagacatcatcgaagtcggaaagaaaatcgatttggatacaacgtactttctcaaagggacggagggagcatcttgacgaaaacgatcgaatttgaacagctgaaggaaacactatattacgaaaaaatgcctggcggcctcgatgtctatgttcttccgaaagaaggatttaacaagacatatgcggtctttaccacaaaatacgggtcgattgacaatcagtttgtcccgctcggaaaagatgaaatggtccgcgtgcctgatggaatcgcacactttctcgaacataagctctttgaaaaagaagacggcgacgtttttcagcaattcagcaggcagggagcttcggcaaatgcgtttacctccttcacaagaacggcctacctgttttcaagcacgtcaaatgtggaagaaaacctggaaacgctcgtcgactttgtgcaggacccttactttacagaaaaaacggttgagaaggaaaaaggcatcatcggacaggaaatcaacatgtatgacgacaaccccgactggcgcctgtttttcggcctgatcgaaaacatgtatcaagagcaccctgtccggatcgatatcgcaggcacgatcgaaagcatctctcatattacaaaagaccttttgtacgaatgctatgagacgttctatcatccgagcaatatgctgctgtttgtcgtcggtccggccgatcccgaagcgatcattcgccaggtccgcgaaaaccagcagaaaaaaccgtatacagaccagcctgaaatcgtccggaaagaagttaaagagcctggggccgtatttaaaaaagaacaggaaattaaaatgaatgttcaaagctcaaaatgcctcgtcggtttaaaaagcgctcatccgatgaatacgggagaagccctgctgaagcatgagctgaccatcaacctcatcctcgagtgtctgtttggcaaaagctcaagcgattacgaaagaatttatgaaaaagggtatatcgatgagacattcagctatgactatactgaagaacacggatttggcttcgtctctgtcggcggagatacgcctgagcctgacaagctggccgaagagctcaaacaagtgctgttcaaagcgaaagaaacgatcacagccgaaaagctggaactggccagaaagaaaaaaatcggcaatttcctgaaatcgatgaattcgcctgagtacatcgccaaccagtttacacggtacgcttttctggagacgagtctgtttgatatcgtcaccgtactcgaatcgattacgcttgatgacgttcaccgcgtcattgaggaagaagttgaggaagacaggatcaccgtctgcaaagtcgttccaaaatcataaagcaaggtctgaaagttcagcgtgcagggatatttccgatgcacgctgaacctttcttcttttttaacggaaaggtggaaatatggtatgacaaaactcgctctcatcaccggcgcaagcggcggaatcgggcaaagcatcagcgaaaagcttgcgcaaaacgggtatgatcttctcctccattatcatacaaatgagaaggcggccgcttcacttgcagaaaggctgtcacatacatacggcattcacgctgaaatcattcacggcgacctgtccgaccccggaggtgcaaaaaccgtttccgcttccatcggcggacgggcgctagacggcatcgtcttttaacagcggacaaagcttccgggggcttggtgacagataatgaccgatgaaactgttacaggaacatggtgcagctccatgtctcaagcccgtttctattaacgagggaatctgcttccggcgatgatcaggaaaaagtccggcgctattgtagccgtcagctctatttggggtgagacaggggcgtcgtgcgaagttttatacagcatgacaaaaagcgcgcaaaatgtgtttgtcaaagcccttgcaaaagagcttgcgccgagcggcatcagagtcaacgctgtttctccgggcgctgtaaaaacaaagatgaatgagctcattttcaaaagaggaagaagagatgatcgccgatgagattccgatgggaaggctcgccgaagccgaagaggttgcagacgccgtcttgtttctgctctcggcgaaagcatcttatatcacgggtcaaattttgtcagttaatggcggctggcattgttaaaaacatgtatagtttacgattcccaagagaataataaggctgtaacttcaagagaatggaggggcctgatatgtccgtactggataattgggatcagtggaaaaactttttgggcgaccgtttgaactatgcccaagaacaaggaatgtcaaaagaaaccatctcagatcttgcatatgagatcggcgattatttggccggtgaggttgattcaaaaaaccatcaagaacgagtgctcgcagacctttggagcgtggcttccgaagaagagcagcgcgccattgcgaacgtgatggttaagcttgttgaaaacaacagctcacattaaggagagagtgtgttcactctctcttttttataggcgcgattttgcctgcggcaccgcttttatcgtttgcttttcgccccgacagggtaaacagcattcaggcgccgatacagcaggtttttcccgattttgggaaacggacgtttttcttatttaatcacaacattctgctttctaattaagacaaaatgctttatgataaaggaaggtaaatttttgccacgatgatgggtagggaggttatcatttggcaaagctcgaatggtacttagaatatgaaatccaagtcaaccgtcccggacttctgggagatatatcctctttattggggatgctttcaattaatattgtgaccattaacggcgtcgatacacaaagaagaggcctcttgttaaaatgccgtcatatagatcagattaagcgattggaatcgattttgaacacgatggatacgattaaagtcacgaagctccgcgaaccgaagcttcgcgaccgtctcgctgtaaggcacggccgctatatccagcgggatgcagacgataaaaaaacgttccggtttgaacgcgacgagctcggcttgcttgtcgattttatggctgagctgtttaaaaaagacgggcacaagctgatcgggatcaggggaatgccccgcgtcggcaagacggaatcaattgttgcttcaagcgtctgtgcaagcaaaaggtggctttttgtttcttcgacgctgctgaagcaaacgatcagaagccagctgattgccgatgagtacagtccggaaaatgttttcattttggacggcattgtgtcgacgagaagaggatctgaacgccatttgcagctcgtcagtgagattatgcgtctgccggcgaccaaagttgtcgagcatccggacattttcgtgcaaaatacggaatatacgatggacgattttgactacatcatcgaattgcgtaacagccccgatgaggtgattacatatgagcacgctgaagaaccgcagatgtttgaccattcaggtttttccggctttgatttttaaaatggaaggtgtttgttgtgactgaactaggaaatcggctgaaagaagccagagaggaaaaagggatgtcattggacgaccttcaggcggccacaaagatccaaaaaaggtatttaacggcccttgaagaaggaaactatgatatcattccggggaaattttatgtgagggcttttatcaagcagtacgccgaagctgtcggcctcgactcggagcacttgtttgaagagtttaaaaaagatatccctaattcttacaatgatgaggtttctgagaagctttcttcaatcaagccgcagagggagcttcccaagtctgcctcaaaagcgcttgaacttttgcccaccttgcttgtggcagccggcgttatcgttgtgatcgcgatcatttacgtcattgttcaggctgtaaacggcggagggaatcagcaggctgaagggcctaaaacagaggaatcgcaaagcaagtacgacgtctcaaaagattccccgctgactaaggaaaatcaacagaacacggatgcgcagaaagacagcgctgaaggcgacaaagaaaaaaaggatcagcagtctgatgagaacgacaagctgaccattaaagcgaccgcaagcgaaggctcttccacaacctatgaagtatcaggatccgacaagctggagcttgaagtaaaggcaagcgaaaactcatgggtcagagtgcgcgacgagaaaggaagctctcttaaagaaggaatgatgaaaaaaggggaaacctttcaaaagaatataaccgatcaatcgcaaattgatttgcggatcggatatgcgccgggcgttgaaattaaaatcaacggagaagttctttcttacaagctcgatcctaagactgtgatgacacaaaacataacgattcaaaataaaaaggaggaaaagtcatcttaattgcacagatgactttttcttgcgttcatcatcattaggaaaacatacatatatggaggaacctttatgtttaatttaccgaataaaatcacgctttctagaatcgcattaattcctgtttttatggtcatcatgcttgtgccgtttcagtggggggctgtctccttcggcagcgagtcgattccggtcacccatttgatcggcgcactgctgtttattttcgcttcggtcaccgattgggttgacggctattatgcaagaaagctgaaccttgtaacaaactttgggaaattccttgacccgcttgcagacaagctgctcgtgtcttccgctttgattattctggtgcattaccatcttgctccggcctggatggccattgtcattatcagccgggaatttgccgtaacgggactgcggctcgtccttgcgggaacgggggaagtcgtcgcagccaacatgcttggaaaagtgaaaacatgggcccagatcatcgcgatctctgcccttttgcttcacaatctcccatttgagcttgtatccttcccgttcggctctcttgctttatgggtggctgtctttttcacagtcgtatccggctgggattatttcgctaaaaactgggatgctttaaaaacatcgaactaaacgtagggaagtggaaacaatgaagttggaaagaaaagcggaaattatcgctgtcggctctgagcttctgctcggacaaatcgttaatacaaatgctcagtttatcagcaggcatttggccgaaatcggcattaacgtcttttatcacacggcggtgggagacaatccggagcgccttaaacaagtcattcagacagcgcagcaaaggtctgacttcatcattttttcgggaggcctcggaccgacgaaagacgatctgacaaaagaaacgatcgccgaagttgtcgggcgccctcttaagctcgacgatgaagccttcgaatcgattcaggattacttcaaaaaaacgaaccgggagatgtcgccgaacaaccgcaaacaggcgctgatcctcgaaggatccgatgttctgccgaaccgctttgggatggctccgggaatgctgcttgagcatgaatcgcgcttttatatgcttctgccgggacctccgaaagagctggagccgatgtttgaaaacgaagcgaagccgctgattttggaaaagctcggctcgagggaaaagatcgtgtcaagggtgctgcgcttcttcggcatcggtgaatcccagcttgaaaccgatttggaagatctcatcgatgcgcagactaatccgacaatcgctccgcttgcggcagacggggaagtcacgctcaggcttacggcaaagcatgcggatccggaggagacaaaccgcttgttaaaagaaacggaagaccgcattttggagcgggtcggagaattcttttacgggtatgatgatacatccctcgcagaagagcttgcgaaagcatgccggagcaagggtatgactctggctgctgcggaaagctttacaggcgggcttttttccagctggctgacggaaatgagcggcgcttccgaatatttcaaaggcggcgccgtctgctacacaaacgaattgaaagtgtcagcggccggcgtttcggaagacacgctgcagcgctatggtgcggtcagcgcgcaatgcgctaaagagctcgccgcaggcatcagagtcaagacaggaagcgatatcggcatcagcttcactggagtagccgggccgaatacgcaagaaggccatccggctggaaaggtgtttatcggcatctccgtgaaggaccaggctgaggaagcgttcgaatttcagttcgccggatccaggtctgcggtgcggaagcgttctgccaaatacggctgccatctgttgctgaaaatgatggaaaaataagcggaaaccggattttcggaatatctttctttcgaaaaaggccattccattttaggagatcgatttttcctcttaaaaaatcgaatatgcgttcgcttttttcttggcaaatccgcataaacaaggtatagtagatatagcggaagtgataaaggaggaaaatagaatgagtgatcgtcaggcagccttagatatggcgcttaaacaaatagaaaagcagtttggtaaaggttcgattatgaaactcggcgaacaaactgaaacgagaatttcaacagttccgagcggttctttagcgctcgatgcggctcttggagtgggcggatacccgcgcggccggattattgaagtatacgggcctgaaagctccggtaaaacgacggtggcgcttcatgcgattgccgaagttcagcagcagggcggacaagcggcgttcatcgacgccgaacacgcgcttgatcccgtctatgcacaaaagctgggcgtcaacattgatgagcttttgctgtcacagcctgatacgggcgagcaggcgctcgaaatcgctgaagcccttgtcagaagcggagcggtggatatcgttgtcatcgactctgtagcagcgcttgtgccgaaagctgaaatcgaaggagatatgggggattcccacgtcggtttgcaggccagactgatgtctcaggcgcttcgcaagctttccggagcgatcaataaatcgaagaccatcgcgatctttatcaaccagattcgtgaaaaagtcggtgtcatgtttggaaatcctgagacgacgccaggcggaagagcgctgaaattctactcttctgtccgccttgaagtgcgccgcgcagagcagctgaaacaaggcaacgacgtcatggggaacaagacgaaaatcaaagtcgtgaaaaacaaagtggcacctccattccggacagccgaagtggacattatgtacggggaaggaatttcaaaagaaggggaaatcatcgacctcggaacagagcttgacatcgttcaaaagagcggtgcatggtactcttatcaggaggaacgccttggacaaggccgtgaaaacgccaaacagttcctgaaagaaaacaaggatatccttttgatgattcaagagcagatccgggagcactacggtttggatactggaggcgctgctcctgcacaggaagacgaggcccaagctcaggaagaactcgagttttaatcatgaaacgtgtgaaaggctgccggcccgatcggcagccttttactttattcttcgctttcaggcgcttctcttccatccatcctcttcatgagggcagtttgaaaggcgtttaatccagaaacgttaagaccgtaagcttgacaagtatttcccacacaattacaatgaaattgtatcacttgtttttcttaacatgattgataaacatttaaacttgacaagggctgtgaatccgcttcactccctgtgaaggttctgtatgttgagaagaagtacaatgtacatgccgacacttacttttagcaagacaagttcatagcaagaggaggtgaaagttatgagtcctttagcaattctcatctccattttgctgagcctattctgtttagttgttggctactatgttcgtaaaatcattgccgaagcaaaaatttcaggtgcgcgaaatgcagccgaacaaattcttggagacgcaaagcgggatgctgaagcgttgaaaaaagaagcccttcttgaagcaaaggacgagattcatacgcttcggatagaagctgaacaagaagttcgtgaaagacgaaatgagcttcaaaaacaagaaaaccgtttacttcaaaaggaagagaaccttgaccgaaaagatgaatcattagataaacgggaagcgatgttggagaagaaagatcattctctgaatgaacgacaacaacatattgaagagatggaaagcaaagtggatgaaatgattcgtatgcagcagtcagagttggagcgtatttcaagtctgacgcgagatgaagcgaagcaaatcattctggaacgggttgaaaacgagctttcccatgacatcgcgatcatgatgaaagaaagtgaaaatcgagcgaaagaagaggctgataaaaaggcgaaaaatattctttcattggctttacagcgctgtgcggcagatcatgtggccgagacaacggtttcagttgtcaaccttccaaatgatgagatgaaaggccgcattatcggacgtgaaggacgtaatatccgtacattggaaacattgacggggatcgatctgatcatcgacgatacgccggaagccgttatcctttcaggatttgatccgatcaggcgtgaaacagccaggatcgctcttgataaactcgttcaggatggccgcattcatcctgccagaatcgaagaaatggttgagaaatcccgccgtgaagtggatgattacatccgcgaaatgggtgaacagacgacgtttgaagttggagttcacggtcttcatcccgatttaatcaaaatcctcggccgcttgaagttcagaacgagctacggacagaatgtactgaaacattcaatggaagtggcgtttctgacaggcttgatggcttcagagctcggagaagacgtaacgctcgcaaaaagggcaggacttcttcatgatatcgggaaagcgattgaccatgaggtggaaggaagccacgttgaaatcggtgtggaactggccaccaagtataaagagcatccagttgtcatcaacagtatcgcatctcaccacggagatcaggagccgacttccatcatcgccgtgctcgtggccgcagccgatgcgctgtctgccgcaagaccaggcgcaagaagcgaaacgctcgaaaactatattcgcaggcttgaaaaactggaagaaatctccgaatcatacgaaggtgttgaaaaatcattcgcgatacaagcgggacgagaggtgcggatcatggtcaaacctgactcaatcaatgatcttgaagcccatcgtttggcgcgtgatattcgaaaacgaattgaggacgagcttgactaccctggacacatcaaggtaaccgtaatcagggaaacgagagccgttgaatacgcaaaataaagtggtgcgaatgcgccactttatttttttgtttccttgtgtaacactataattaaaacctatttaaaaaaagaaagggtcaaattatgagaattttatttattggagatgtcgtcggttcgcccggcagagacatgatcaaaacctatttgccgaagctgaagctcaaatataaaccgaatgccgtcatcgtcaacggagaaaacgccgcacacggaaaaggcattaccgaaaaaatatatcaccagctcattcaagctggagccgacgttctcacgatgggaaaccacacatgggataaaagggaaatatttgattttattgatgatgcgccgcagatcgtcagacccgccaattttcccgagggcacgcctggaaaaggcatcacatacataaaaacaaacggttcgaaggaactggctgtgatcaatttgcaaggccgcacttttctgcctgcgatcgattgcccatttcgaaaagctgatgaattaatagaagaagcgtcaaaaagaacgccgttcatctttatcgattttcatgccgaagcgacaagcgaaaagcaggcgatcggctggtatacggacggccgcgtttcagcggttgtcggaacgcacacgcatgttcagacagcggacaaccgcattcttccgaaaggcacggcatatataacagacgtggggatgactgggccttacgacggtattctcggcgtcgaccgcgagacgattatcaagcgttttaaaacgagcctgcccgtccgttttgagattgccgaaggccgcacaactctgagcggagttgtcatcgacatcgacgaacagagcaagaaagccgttaaaattgaccggatattaattaatgacgaccacatgttttttgaataactaaacagaaaatcattttagaaaaatattaaaaggaaagcaggaatatcccggtcctatcgtgaatatagtaaaaatggaaggtaccctgctatttttgaaaagcaattaaaaggggatggctttgaaaatagcaacatctaataatgattgttctaatgaacactcacttatccattgtaaacttaagggggagcaggaatggaaatattaaaggtttcagcaaaatcaaatccaaactcggtcgcaggtgcgctcgcaggagtcttgagggaacgaggggctgcagaaattcaagcaatcggagctggggcattaaatcaggctgttaaagcggtagcgattgcacggggatttgtagcgccgagcggagtcgatctgatttgcattccggcgtttacggacattcaaattgacggtgaagaacgaacagcgattaagctaatcgtagagcctcgctgatagaaagatcactctttttcaaatgcttcaacctgcttacttttacgtaagcgggttgtttttggtttgtccgtttttgaaaaatcagccgggagaggatcaacatgaagatttttgatgcccactctgatttgctgctgaagctctggaaaaatccgaagctcaatgaatacagcgacccgtcgcttcaaacgccggtccaagcgcttttaaacggaaaggcgaaagtgcagtgtctggcgatttttctgcctgaaaccgtgccagacacaataaggcttgaaatggcgcttatgcagatccagctgtttcacgaaaaaattgcaaagtacaagcggatcaactgatcaaaaataagccgatatcgacaagctcaaaagcgatgaaaccggcatcattttaacgatggaaggtgtgagccgatcgcaaaaaacttaaggctgtttgacatcttttttcagctcggagtcagaagtttcggcctgacatggaactgggccaatacgttcgcagacggcgctttagaagaaagaaacgccggcttgacttcttacggggaaagactgattcgcaaggcgaacaaaaaccgggcatggacagatctctcccatttatccgaaaaaagcttttggggtgcgattgaaacggcggcgtatccgatcgcctctcattcgaatgcccgcagcctttgccctcatccgagaaatttaaaagacgatcaaatcaaagcgcttattgataagaacggcgtcatcggcttgacatttgtccctgaattcgtgagaaacggaaaaacgcctgtgatcaaagatatcctctcgcatattgaccatgtctgctctttaggaggcgagcggcatatcggattcgggtctgattttgacggcatcgaccgtgtcattccgaatcttgaagcccacaaagattacgggaatctgatcgaagcgctgcagcgctcatatacaccaagtcaagtcgacggatttctctttcaaaatttcatcagccgcatcccattttaaaaaaatatcatacatttttcagagggtgttcatctgttttctccagaaggacactggtgtttaccaagactgattatcgtgctacaatccttttgtaaagcgattttacaaagggggtctgttcatcttggacggaaatatgaaagcgcttatcaagaagccgggggagccgggcgccagcttcgagctcgtcccgattccgaagatcgacaaacacgaggtcctgatcaaagtcaaagccgcatcgatttgcggaaccgatgtccatatttataattgggatgaatgggcgaaaagcagggttaaaccgccttatgtgttcggccacgaattttccggcgaagttgttcaagtgggggaaaatgtgactacggtaaaagaaggggagtatgtttcggcagaaacgcacatcgtttgcggaaagtgcctgccgtgtttgaccggaaaagagcatgtctgcaaaaaaacgctgattctcggtgtcgatacagacggctgttttgctgaatatgtcaaaatgcccgccgcaaacatttggaaaaacccggccggcatgcctgaggatctcgcttctattcaagaaccgctcggaaatgccgtgcatacggttctgacgggaatgacggctggagtgaaagtcgctgtcgtcggctgcggaccgatcggactgatggccgtggcagttgcaaaagcgtctggggcggcgcaggtgatcgccatcgataaaaatgaatacaggctcgaccttgcattgcaaatgggggcaaccgatatcatctccgttgaaaaagaagatccgctcaaaaatgtaagcgctttaacaaatggtgaaggggcggacttggtttgcgaaatgtcaggccatccgacggcaatccgccaaagtttaaaaatggcggcaaacggaggacgggttcatgtcttaagcttgcctgagcatcccgtatgcatcgacatgacaaatgatatcgtctttaaaggattgacggtccaaggaattaccggccgcaaaatgtttgaaacgtggagacaggtcagcggtctcctccaatccggcacgattcaaatcaagcctgtcatcactcaccgtttcccgatggaagagtttgaaaaaggctttgaactgatgagaaaagggcaatgcggcaaagtcgtactgataccgtagaaaggagagattaatatgaaagaattcaattttttagcttccgagcttaatacaatgaaagaaaacggaacttttcaagagctgccgatcatcgaatcaatgcaaggatcaaccgtcaaaatgaaaggaaaagacattatacagctttcatccaataactatctcgggctgacgtctcatccgcgcctccaaaaagcggccgaagaggcggtcaaacggtacggagctggaaccggatcggtccgtacaatagccggaacattcaccatgcatgatgagctcgaaaagaagcttgcttcatttaaaaacactgaagcggcactcgtattccagtccggatttaccgcaaatcaaggcattctttcaagcattctcaccaaagatgatcttgttatctcagacgaattaaaccatgcttccatcattgacggcatcagactcaccaaagcgggcaaaaaagtatatcagcatgcggacatggaagatttagaaaagattttgaaaaagtcgatgaactacagaatgcgccttatcgttacagacggcgtgttttcgatggacggagacatcgcgccgctgcccgaaatcgtccggctcgctgaacagtatgacgcatttgtcatggtcgacgacgcgcacgcgtccggcgttctcggcgaaaacgggcgcggaacggttcaccatttcgggctggacgggaaggttcacattcaagtcggcacactcagcaaggcgatcggcgtattaggaggctatgcggccggatccaaggtgctgatcgactacttaaagcataaaggaagaccgtttctcttcagtacttcccatccgccggccgtcactgcggcatgcattgaagcggtcaatgtgctgatggaggaaccttcattgattaaaaagctttgggacaataccgcgtacttcaaaaaagagcttgaaaaaatcggccttccgctgattaagagcgaaacgccgattacgccgattttgatcggtgatgaagctgaggcatgccgcttctcaaacacgctttttgagctcggtttatttgcccaggccattgtatttccgaccgtcccgaaaggcaaagcgcggatcagaacgatcatgaccgcccagcattcgaaagaagagctcgataaagcgcttgaaatcattcaaaccggcgctaaaaaagcgggtctgctttaaactcatcgatttctttttgaacaaagcaaataaccattgataatcattttcagttagtgtacaatgatgggttctgggttgtgctgacaaccgagaacctttatactgaagagtggagctttgtttgaaaggagatcaaaaacatgaatgagaaacagcgcattgaaagcggacaggtcaatccatcggacaaaaaatccgagaaggattacagcaagtacttcgaagctgtttatgttccgccttcattaaaagatgcgaaaaaacgcggcaaagaagaggttaaataccataacgattttaaaatctcagagcagttcagaggcatgggcgaaggacggaagttttacatccgcacgtacggctgccagatgaatgagcacgataccgaagtgatggcagggattttcatggcgctcggctatgaaccgaccgactcgacggaagatgcaaacgtcattttgctcaacacgtgtgcgatccgggaaaacgcggaaaacaaagtgtttggcgaaatcggccatttaaaagctttgaaaaaagacaatccggatttgatcctcggagtctgcggatgtatgtcccaggaagaatcagtcgtcaaccggattttaaagaaacatccgttcgtcgatctgattttcggtacacacaatatccaccgcttgcccgaacttttgtcagaggcttatctgtcaaaagaaatggtcatcgaagtgtggtctaaagaaggcgatgtcattgaaaaccttccgaaagtccgcaccggcaaaattaaaggctgggtcaacatcatgtacggctgcgacaagttctgtacgtactgcatcgtgccgtacacaagaggaaaagaacgaagcagacgtcctgaagacatcatccaggaagtgagaaggcttgcggctgaaggctacaaagaaatcacgcttctcggacagaacgtcaacgcctacggcaaagattttgaggatatggaatacggactcggccacttgatggatgaactccgcaaaatcgacattccgcgaatccgcttcacgacaagccatccgcgcgattttgacgaccatctgatcgaggtgctcgcaaaaggcggaaaccttctggaccacatccatctgcctgtccagtccggaagctcggatgtcttgaaactgatggcgcgcaaatacgaccgggagcgctatcttgagcttgtcgccaaaattaaaaaagcgatgccgaacgcatccttaacaacggacattatcgtcggcttcccgaacgaaacagacgagcaatttgaagaaacgctctctttatacagagaggttgaatttgacagcgcctatacgttcatctactcgcctcgcgaaggaacgcctgctgccaaaatgaaagacaatgttccgatgcgcgtgaaaaaagaacggcttcagcggttaaatgaagtggtcaacgaaatttccgcgaagaaaatgaaggaatatgaggggcaggttgtcgaagtgttagtagagggtgaaagtaaaaacaaccctgatatccttgccggctatacacggaaaaacaagcttgtcaacttcaaaggaccaaaagaagcgatcggccagcttgtcaacgtgaaaatccaccaggcgaaaacttggtcgcttgacggggaaatggtaggagaagcaatcgaggtgaagtaaagtgacgctttatacgaaaaaagagattgttgcaaaagcgcgggagctcgcaaaaatgattgcagaaacggaagaagtcgactttttcaaaaaagcggaggcacagattaatgagaatgccaaaataacgggcataatcaaccaaatcaaagccctgcaaaagcaagccgtcaactttaaacattacgaaaagcacgaagcgcttaaacaaacggaagcaaagattgacgcgcttcaggaagagcttgacgagattccgatcattcaagagttcagagactcccaaatggaagtcaacgaccttcttcagcttgtcgcgcatacaatatcaaaccaagtgacaaacgagatcatcacatcgaccgggggagacctgctgaaaggcgagaccggttcaaaagtgaaaaattcatcaccgagctgttctctataatttggcggcgccttttaaggcgccgttttttttgaattcaatttcccgccgcgacggcttattgaaaagattcgtttttcggctgtctttttcttttctgatttaagtcaagtttatccttttacctgcatacacttaaacagattcattatatgggaatttattttgatttctcaaggaacgcacattagacgaatgcccagcataggataatacgaggaaaaacaaggaggcatgaccgaatgtctgaatacagggaaattatcactaaagcggtggtcgcgaaaggccggaaattcacccagtccactcatacaatctccccttcgcaaaagccaaccagtattttaggcggttggattatcaatcataagtatgacgctgaaaaaatcggaaaaaccgtggaaattgaagggacatatgatatcaacgtctggtattcatatgcggacaacaccaaaaccgaagttgtgacagaacgcgtttcctatgttgatgtcattaagctccggtatcgcgacaaaaattacttagatgatgaacacgaagtcattgcgaaagtgcttcagcagccgaactgccttgaagtgaccatttctccgaacggaaacaaagtggttgtacaggcggaaagagaatttttagcagaggtcgtcggcgagacgaaggtcgtcgttgaggtcaattctgattggacggaaagcgatgaagaagaagcgtgggaagaagagcttgatgaagaacttgaggatatcaatcccgagtttttggttggagatccagaagaataaaaggaagctagggaaacaccgccctagtttcttttttttcagcacgaatctttatggtataatgagtgttggaatcaatagaaacgtttatacatagtgagggattaaatatggcaggctacacgcctatgatacagcaatatttaaagattaaggcagagtatcaggatgcctttttattttttcgtcttggcgacttttatgagatgttttttgaagatgcaaaaaaggcgtctcaggagctcgaaatcacgctgacgagcagggacggaggatcaagcgaaagaattccgatgtgcggggttccttatcattcctgctcttcgtatatcgaacagctcattaaaaaaggctataaagtcgcgatctgtgaacaggtggaggaccctaaatcggccaaaggagtcgtcaaaagggaagtcgtgcagctgatcacacccggcaccgtgatggacggcaaagggattcatgaaaatgaaaacaactttatcgcctctgtcagtaaatttcagcatacatacgggctcgctttttctgatttgacgacaggcgagaatttagtaacggctatcgaaaggcttgatgatgtcgtttccgaaatttactctgtcggagcaagggaaatcgtcgtcagccgcaaccttgacgagaaagacgtcgcaatgctgaaagagcgctgcggcgccacgatctctttcgaggatgaacaagcggatgaagtgcctggcattgtgaacggactggggtccaaagagcttgtcgatacgtttatgaggctttacgtctacttgaagcggacgcagaaaagaagcctcgaccaccttcaaaacgttcaggcctacgagctcgaagaagcgatgaaaatcgatttgtactcgaaacgcaatcttgaactgacggaaacgatccgttcgaaaaacaaaaaaggctcgcttctttggcttttggatgaaacgaaaacggccatgggagggcggctgttaaagcaatggatcgacaggccgctgatcagaaagggacagatcgaagagcgccaggaaatcgttgaaacgctgatcgcccatctgtttgagcgggaagatttgcgcgaacggctgaaggaagtatacgacctcgagcggctcgccggaagggtcgcatacggcaacgtcaacgccagagatttgatccagctgaaggaatcgctgaaacaagtcccggccatcaaacagcttgtcggctccctcgaccatccgaaagcaaaagcgcgcgccgagaaaatcgatccgtgcggcgatcttttgaatcttttggaagacgcgctatacgagaatccgcctctttcattaaaagaggggaacttaatcaaagacggctaccacgcgaaactggatgaatacagggacgcaagcaagaacggaaaagactggatcgcaaggcttgagcagcaggaacgcgagtacacgggaatccgctctttaaaagtcggctttaacaaggtgttcggctattatattgaagtgacgaaagcgaacatccatctgcttgaagaaggccgctatgaacggaagcagacgctgaccaatgcagaacgctacatcacgccggagctgaaagaaaaagaagccctgattctcgaagcggaaaacaatatttgcgagctggagtatgagctgttttccgagcttcgcagcaaggtgaaggaatatatcccgcgcttgcagcagctgggaaaaatgatgagcgagcttgatgtgctccaatgttttgcgacgatcagcgaaaaccggcactatgttaagccggagttttccgatgatgtcgttcaggtgatcgacggacggcatccggtcgtagaaaaggtgatggacagccagtcttacgttccgaacagctgtgaaatgggcaaaggcaggcagatgcttttaatcaccgggccgaatatgtccgggaaaagcacgtatatgagacagatggcgctgatctccattttggcgcagatcggctgctttgttcctgcgaaaaaagcggtgctgccgatctttgatcagatctttacgagaattggcgcagcggatgatcttatatccggacagagcacgtttatggtggaaatgcttgaagccaaaaacgcgatcgtccatgcgacgaaaaacagcttgattttatttgacgaaatcggccggggtacgtccacttacgacggaatggcgcttgcacaagcgatcatcgagtacgttcacgagcacatcggcgcgaagactttattttccactcactaccacgagctgacgtcccttgaagaaaagctggacgatttgaagaatgtccacgttcgtgcggaagaatacgaaggaaaggtcgttttccttcaccagataaaagaaggagcagcagataaaagctacggtatccatgtcgcgcagctggctgaattgcccgacggtttgatcagcagggcgaaaacgatcctgaaagaacttgaatccggcgcaaaagaagccgctccatcaacggcaccgaatatggtaaaagaggcggcggaagaagccgcggcgactgttgcagatcaaccggcccagctgtcattttttgagacggacaagccaatagaaaaagagacgaagctctccaaaaaagagcaggctgttttagccgaatttaaagcgatggatctgctcgatatgacgcctatacaagtcatgaatgaactgtacaggctgcaaaaaaaattaaagtaacaaagaggtgagccaacttggcaaaaattgttcagctgcctgacgatttatcgaataaaatcgcggcgggtgaagtagtggaaaggccggcgtcggtcgtcaaagagcttgtcgaaaatgcaatcgatgcgaacagctccgtgattgaaatcgatgttgaagaagcgggtctcgcctcgattaaagtgcttgacgacggcgaagggatggacgcagaagactgcagaacggcttttttgcgtcatgccacaagcaaaatcaaagacgaaaacgacctgtttcgcgtcagaacgctcggatttcgcggagaagctttgccaagtatcgcgtctgtctcacacttaagcattaaaacgagcaccggagaaggggcaggcacccatttgacgctgcaggggggaagaatcatttccgagcaaaaagcgccaagccgcagaggaaccgaaattacggttaccaacctgtttttcaatacgccggcaaggctgaaatacatgaaaacgattcataccgagcttggcaacatcacagatgtggtcaacagaatcgcccttgcccatccggaagtttcgatcaggctgcgtcatcaagggaaaacgcttctgcagacaaacggaaacggcgatgtccgccacgtgcttgcggcgatttacggcacggcggttgccaaaaaaatgctcccgcttgaagcgagatctcttgactttgaagtgaagggctatatcgctcttcctgaaattacgcgcgcctcgcgaaattacatgtcatctgtcgtcaacggcagatacattaaaaacttcccgctcgtaaaagcgatccacgagggctaccatacgcttcttccgatcggccgccatccgatcacgttcattgaaatcaacatggacccgctccttgtggacgtcaacgtgcacccgtcaaagctggaggtcaggctgagcaaagagacggagcttcacgagctgattcgcgacgccatcaaagacgtctttaaacagcagcagctcattccaagcgtgcaggtcccgaaaaaaaccgcacctctgatcaataaaccagagcagcaaaagcttgatttcgaccaggtacgagaaccggcacctctttctgattctgatgttgaaagagagtataagccggagccttcgttttcggcgatgaaattaagctcgcttgtcaaagacccgccgccttccgctcccgtagagcgcgaagaaaacgtaatgcaggacaccgagcctgaatggcccggagctgaagagtatacgcctgaagccgcgccggccgtacaagcagaaccggaacaggcaggagagaacgtccaggacgaagagacgccaaaagaaagggtgccgatcatgtatccgatcggccaaatgcacggcacctacatacttgcccaaaatgaaaacgggctgtacatcatcgatcagcacgccgcacaggagcggatcaaatacgaatatttccgtgaaaaagtcggggaagtcgaatcggaagtccaggacctgcttgtgccgctgacattccattattcaaaaaatgaagcgctgacgatcgaccagcacttggacgatttagccaaagtcggcgtctttctcgaatcgttcggcgccggcagctatatcgtccgatgccacccgacatggtttccgaaaggggaagaaacgacgatcattgaagacatcattcagcaggtccttgatgaccgcacgatcgacatcaaaaaactgcgcgaagaagccgcaatcatgatgagctgcaaaggctccatcaaagccaatcatcacctgcgggacgacgaaatcaccgccctgctcgatgagctgcgcagaacatccgaccctttcacatgcccgcacggccggccgatcatcatccactactccacctatgagatggagaagatgtttaagcgggtaatgtaatttttaatcgctcacaacctttggtatatcaatggctgtgggcgattttgattttattgaccacattttgaccgcattaacactagacggcctgctttaaatcttgccgtctgtaagaagacaattaggaagcggcacgtatatcgtccgggtattctgttttatggatgattgtaagctataattctaagaaaatttggataaccaaaagagggcttctctttgagatcaggtctcataggcaaccattagtcagatttcgcagctgttttcatttttctagaaaatgttataatgaaaagccacgaaatgacttgaagagggggaattttgatgcattacataacggcatgcttaaacatcatcagcgataaagaccttaatgaaataatgaaggaattcaaaacacttgaggaaaaaacgaacaaagaagaagggtgtattcaattccatgcttatccgcttgaaccgtcggagcgcaaaataatgctctgggagatttgggaaaacgaagaagctgttaaagcccatttcacgaaaaaacacacaaaagatgttcaaaatcaacaattaacagaagtagaatggttaatcaaaagcaatgtgaatgattaaagcgcgaaacattcaatgacgaaaaattaacccccgtaatcgagtggaaaattgttggaggattgttgtccaacgctgccaacagtcatcattttcatttagaaatcatcagattattcatagcagtgattagaaaatttttttgtccgaggtactgtaatgatttgattcactgcatgatatgaagggatacaaaaagctcggttctgtcgatgtcaccgatgaaatcggtacaggcaaggacttcatcggcggttcgtacatgctttattcaaacggtcaaattgtccgaaaatacatatccggcggtgaagtgaaatacgaacttgtcagtcgcataccggaaagcagagtgaagaaaagcaacattgaaaaagctcttgattgggctaaagacacagttggggaattgtccggtggttatgatggttatagagcgataacaggtgttgaccctgtgactggtgaaaaactaaccgtcactgaccgtatcctgtccggtgtttctgtcatacccgctactaaagtagtcaaggtagggaaatatgctttcaaagccactaaaggtgcgaagacggcgaaaagggtttcgaatgccgagagaagtgctaatgctacgcctaaaattaatagaaaacaagctctcaatcaggcaaaagacttagctggcaacaacctacacgtcaatggcaggttggcgatgatataactaagaagggtgtagactataaaaactataaatatagttcaaatccaacccatcatggacgttactatgagtacgaaactcctgaaggattaagagtggttgttacccatactaacgataacagattacacgcacatgcaggtaagcctgacaaagaggcaaatcaattcaactatgactttaagaaagagagatatactaatatatacggtcctaatggagaccaccatatatactataaataaaaggtgaggaagttatgtcgtctcgtaatgaaattattaaacaaaaaaagcgataatgaatgcaaggaaatcgatgaaggaatttacttgcttagaactattagattttgaagagtttgattctccttggatagacttgttcgagccattactaaaacaatttcgaagaatagattccaaaccaacttattataaattaattggggattctaaagaaaacaatattttatggatagaaaattccctaagtttccttaaacaaaaaaaagagtggtttatcgttgttcccaaatgtttacaaccagtgtgggcaaatgttcgagttttagactattctaaagcaattcatgagctttgggaaatgtcagaacctgataatttcctaattgctgataaatctacaggaatgattgcaaaaatattttttgaagaacaacaatacgagatccatattggaaaatgtagtcttgataacattaaaaagaataactaagagaactatttaaacaccttgattggcaactgcctatcaaggttttttcatattcaaatccgacaaaaagggggataaaatgggggactttttctattccactttgtcatacgatagagacaagaaaaacgaacgtgaatatcgagtccaagaaggagagcctgcggacactgaccttttgcatatggatgttgtgcagctgattggtggccgcttttttattggccagaatgggagacgcacctttcccttatcaagtgtgaactcggatgtatcgaatgatgatgaaggtcgtcagcttcacaggaggaacggctggaggctggagtctatgcaggattgcgcgcgatagtcaggggacgcagggaagtccttataagaacaaaaagaaaagcaggcaaataacctgcttaaaaactgattttgcccttgaaatagactcgcaaaatcaaatctcgggtctttctgttaagcaaagagagagccaacaaagcgagaaagagttactttgcgatgcaatttttaaattgccgctccagttcctctttgtccaagtcctttccgatgaaaacaagttcgctttgttttttctcgttttcgttccacttccggtccggacgtcctgaaaacagcatatgaagcccttggaatacgattcgatattcttcgcctttaatataaaggatccctttataacgcaataaatcttctcctttttcccgtacgagataactcatccaatgatccacctttgccaaatcaagaggcttctcttcccgaaaagcgatagaagacactttatcatcgtgatggtggtgatgatgatcttctagaaaatgaggatcgatttcaatttttcgattgacgtcgaacgtattgatccccagtatatctcttaaattgaccttgcaatctctggcatacagcctcttagccgtaggattaatgttgacaagtctttgctccaaggatttcagctcgttattcgatactaaatctgttttattgaggatgatgacgtcagcaaatgcgatttgctcttgcgcttcatcctgatcatccagatgtctggtgacatgcttgctgtctactaccgtgacgatgctgtcaacttcaaatatttcggatagcagttcatccatgaaaaacgtctgggcaacgggggcaggatcagccagtcccgttgtttcgattaaaacgcgatcaaatgcaactttcccttgatccattgagaatacaagcgttctcagaatgcgaatcaaatctccgcggaccgtgcaacagatacagccgttgttcatttccaaaatttcttcttcagaatcaacgacaagctggttgtctatcccgacttctccgtactcattgacaataaccgcgatcttttgattgtgcttttctgtaagtattcgatttaaaagtgtggttttcccggcgcctaagtacccagtgagaatagcgacaggaattttctttttagttataggcatgatcattcgactccatttaaaattttttcgatactttgattactttttcttttggaactccggagatgacgccggatgaacgttcgaagcgttggccgtcatacaaatggcttgctttttctttataatcttcattggtacaaagcgagtcaatcaggagggggacatcctcaggttttaaatctctataccaagttcctctcgggtaatggatggccacgcacttatcttgacaccttccattacaccgcgtgcgcgttgtatgaatgaaatcatcaagctcccggtccgagatttcttgccgaatcacttgagtcagttcctcagctccggcccgattgcagctgctgccgttgcagataaaaatatgatgtttcatattacttaaatcccatgtcgccatatgtatcttccctccaaataaaacagaattattccgatttgtaagcgataaaatgataaagaactgagaatgaatatagaggcgccccggtcgatcactgtccgaaaggtgatactcataacggggagacggccccggcaacatccgcagtatttcactcctttcgaaaagctccatatatttcagccttcttttgcgcctttggttatttcaatactacaacaaaacgtaattattacgatttgaaaatcattttatctctttttcaagtcaaacgcaaatagaagaggttaaacggtgccaatgagatctgtgcagcttctttatccagccgcaccttggcgcaaaaaccccttgagcaatcaaggggttttttatctatagcaatttttccattgccattacatcgataaaacgtccatctaaaattccttgatttttaaagatgccaacttgcctgtagcccattttattgtataggttttgcccaagttcgttaaagggaaatgtaaagaggacgattttataaaaactattctctttagctgttttttctagagcttgaagaaggaggccgcctattccttttccgcggcatgcacgatcaacatagacagaaaggtcggcaacaccttgataagcacaacggtgggagtacgggttcaaagaagcccagcctacaatttctccttttgattcggccacaaggacagaatagcgcccttgatgttcctgaaaccatatttcgatatcgctcatttcctttaaatcttgctccagagtcgcaattcgatcttcaatgccctgattataaatagttaagataaatggcaaatcggcagaaatagcttttcgaatgtttatgttatgcatgagttcctccgtagaaggacttcgagtgcagcatcatatgataagttggtcactaaattgtccgcaagtttttgaaagcgcgttcgttattgtttgcttgacggatctaagcggaattggcaacagacagggtaaaagagagcaggcctaagctttgctctctatttttttgacacttcatctttgaataaatgtttctatttcccgttacttgatatcgatggccgaagctttattgtcccaatcagaagccatattagcagttttgccgtaccaatcggaatgtctaaacaaaacgcctttgccgtatccttgagttgaagtatgctcccacagcgtcgttgaatagcttgatgaaggagacgccgtacttaacgatgaaattctgtcattccagctggatggcaagtttttaaatccgtctctccagtaaatatactgcccgcctttatttttatattcatagaaatcggtacagcagggaccgctggcagaaggtttgaattgcttctcaagcctctgcttgtctttcgcgataaaggcttctaaagtaaccttgctcgtaaatccatacgcaagcaaatcgccgttcttattctgcttgggcagaaccatggttactttgacatctctgacggatttggcgttggcttgagccggcgaatccacattttttccgtcaacggttaagtagtggaaagatttgaccgtatattgattccgctgctgatcgtccagtttcactttaacatcgctttcattttgcgacgcagcgcttgccgtcgacgcggaaatcaaacaggcagcggcaacgagtccaatcccaattgttttcttgaacttagttttaaacatataacaacactccctctcttaattttcctatttattaataggatggaaaaataatagcattaatagaatgaaaatcatgtctctttttgaaaaaaacattaattttctattaacattcagcagcaggagaggttcggtatctgtattgcattaaaaaaaggctcttttttaaaaaagagcctttcatgatggagtcaacaacggtaagcaggaggagaacatgtaaaataaggagaaggtcataagttattgctgacttttaaaacgaactttttagtagcctccatatccaccgccgaaccagctggcgccgatgatgattaagagaatgaacagaacaacaattaaagcaaaaccgcttccgtgtccgtaacctccgctcatatgtttcacctccctaaagagacatagtttatcctatgtcactttataaatttggtataggatattgatttacatttttaaaaatagttgaaccaacttcaccctcatgcgagtctcagatgaagagccgactatcatgaggacttcgtgcagagaggatgaaaatggtgattggcgtcctttaaacggaatataatgcaataaatccaccgaaaagggcgctgaataaattgaattttcaattaactgaaaaagacatgcttcgtatcatcaggaatggtcttcaaacggcacagtaccctaagcatatgatgatcgttggtgccgggttgtccggacttatcgcagcgtctttattaaagaatgccgggcatagagtgacgattgtggaagcaaatgacagagcgggagggcgtgtttttacttcccgtgcgccctttagcgaagggttgtatttcaatgccgggccgatgcgcatccccgatatccatactttaacgatggaatatattaagaagtttaatctgcctgtcaatgtgtttatcaaccgaacccccatggatattctttacgtcaacggcgtgaaaacccgtcttcatgagtttgaaaaaaatccgggcgttttaaggttccctgttgctccccatgagtagggaaaaacggcagaacagctgatgctttctgctttgcagcctatcctcaattttatcagccaagatccggcgagaaattggcgtattgttgaaaaacaatacaggaacgaatcgttaggatcttttctcaacactcatttttcaagcggttccatcgatatgattggtgtgcttttggacatggaagcgtacatgggattgtcccttgtcgaagtattgcgggaatcgattttttttacatcgccgactcgcttctatgagattacatgcggcatggacctgttgacgcaagcttttcttccgcaattaaaggggaatattttattccgtcaaaaattgatgaaaatgtctcaaactaaaaacagtgtaacagcccattgcattcaccagcagtcggcagaacattcagcggtgacaggtgacttcgcgatcgtaacaatacctttttcagcattgcgatttgtggcatttgagccgtttgaatccttttcctaccaaaagcggagagcgattcgggagcttaactatattgcggcgacaaaaataggaatcgaatttaagagcaggttttgggaaagagtcggacagcgcggcggcagatcgattaccgatttgccgattcgcttttcatactaccctagcagcataggaggacacgggcatgctgtcattttagcgagctatacgtgggctgatgaagcgctaatatgggacagtcagcctgaagaagagcggatccgctatacgctgaaaaatttagcgaaaatatatggagatatcgtgtattctgagtttgtatcaggcgcttctttcagctggacgcaaaatcctttttcagccggagcatttacagctttcgaaccagggcaggaattagagttgtatccttatattccgatgcctgaaggaagggtgtatttcgccggggaacacgcttccctcactcatgggtggatgcagggagcgattgaatcgggaatacgggcggcgtatgaagtaaatcaggcctcccgcgtataacatgaactttgcaagtattttaatagaaagaaccgattttaagggatggggaagagtcgctgttaaaaagcggcttgttcgtttttattgagttaaacagacggatcttccaataaactccgccttctgaggggatgtaaatttgtttttgcttcctcaacagtaagaagtgtttccattcgtaaaaacaagtttttaagaacttcatttataaaaaattttaatgcttatgatacaattgaattgcagatgtaactcgacaagcaaaaaagtgttttgctgaggtgaatgatcggattgcccgcattttttcgttaagaaccctcctttttcttacaacaaaaaaagcccccaaaacgagttttcccttaggaaaggctcatgacataccggatggaatgacttaacattctgccgggcagaatagctaagaaaggattgaatcacattgaatgctgctcgtgatcgaaacatcatgcttttgcttctctgtttgacagcaggtattgtagatgtgattgggtacttaagtatcggtcacgtatttaccgctaatatgaccgggaacatcgtactgttaggattatcaatcggcaattctcttcatgcgaccgccgtgtactcgctgatcgcactgttcggatttatcatcggcgtgattatatcagcagccattgtcggaaaacaggaaaaatcgttctggccgacaggcgtcacgattgcacttgctgtggaagcagccgtattgcttctatttgcctgcctgactttctttgaaagttcgccgcaccttttaatcttgctgttaagcattgcgatggggcttcagactacggcagccagaaagctcggcattgcagggatttccactactgtcctaacggggacgctggcaaactttttcgaagatgtgacaaaacgattcctcagtaataacaaccaaaaggtcatccataaggacgcatggcttcgcgctttgacgattgtgctctattgcctgggggctgtcattgccgcacttgctgaacctgagcatccgtttgttgtgatttggattccgatcgttatcattatcggtattattgcggtgcaggcacaaggtttcacggaaagagtgagggatgaccagataaggacggttctatacaccggcattcgtgaaccatcgattgttacatatgttttatgaaggtgcaagtccgggtaataggacggggaaaagcaccagtatcggttaagattgggaggaggataaatggttggaacacattaatatggagcagtttattttattagcggccttattgctgattatcggtgtactgacaacgaaattttcgactaggctcggagtgcccgcccttgtattgttcttgattgtcgggatgatcatggggagcgatggtctcggaattatttattttaataatcccgagcttgcccagctgattggaattatcgcacttgtcgtcatcctttttgaaggcggtttgcaaacaaagtggtcttcggtcaaagcggtcgccgttccttcattgtcgctcgcgacgattggcgttttgctgaccacctgcgtggttgcggttgccgccaagctgatttttaatgtttcttggatggagggctttttattcggagcgattgtcggctctacagacgcagccgcgattttcgccgtattgaaaggccagaatattagagacagattgagctccactctagaagcagagtcgggtacaaatgatccgatggcgatgtttttgactttatcgctcatccagctgctgacggctgaccattcatcttatttcatgcttgttatttcatttttctggcagatgggaatgggacttttgctcggatatttactcgggcggttcgccagctttgccatcaataaaatcaacttggattcgagcggactttatccgatcttcgctcttgcttttgcgcttcttacctacagtcttacagatgtcatcggggcgagcggcttactggccgtctacattgccgcgcttgtcatcggaaatcaagatttgacttaccgacattccattttcaggtttaatgaaggctttgcctggatgatgcagattttgatgtttatcattctcggattattggtttttcctgcccaatttttatccttcgatattattttcaagggcttcttgctttccctgattttaatttttatcgcccggccggttgccgtttttctgtcgaccatcaaaatgggctttaattttaacgaaaaaatcttcttatcatgggccggattaaaaggggcagtcccgatcgttcttgcaacatttccgatgacgatggggcttgaaaacagccaattgatctttaatgtcgtattcttcgtcgttttaacatcggctttgatccaagggtcaaccatatcggtcttcgcagaaaaattgaaattgaacggaccgcagaaagtagaagcgccgcattcgctggagcttgtttccatcggcaaggcgaacgccgaaattatcgaatttgaagtcgatgaccaagcagccattaccaggcagatgctgaaagacatcagctttccaaaagatgccctgatcaatgcgatcatccgaaatggggatttggtcacgccgcatggagaaacgaaaattaaaccaggcgatattttatatatcctcgtatcgaaaaaacaaaagaaggaactgaaaaaatttttaaacagagaatttgattaagccgtcggaaaagcacagtacaaggcagacttgctcagtatgtcacgaataaaggtcaatgaagggtactgcaccggtattcttcattggcctttttttgccatgtggaagttcagctatatgataagtgacatttagacctttgttgatcaattgctcatatccatttataatttaaaaatcaaatattaggaggcgcatgaatgatgaagtgcaaaaaaataagtgggttaacattcgaggggaaagcgcatcattaaccctataaactgcgtgattcccctttaattttgggggtatcattcaattgaaaaacagtaaaatacaaacctttaaacatcaaaagaaggcattttggtggcttagctttgtcgctttcttcagcgtgatgaacgaaaccgtatttaatgttgcattgccggacataaaaaatcaattcggcgtgtcgcctgcggcggcaaattgggtgaatacgagtttcatcatttcctttgctgccggttcagttgtttacagcaggctttctgatatgtacggcgtcaggaagctgtttgtggccggactgctcatctatggcggaggctcatttatgggtttgttggctcaagcttatttcccggctgtgatctttgcgcgctttgttcaaggatccggggcttccgctgtacccgcgcttatcctggtcatcatcacgcgctatgtccgtccggagggccggggcaaagcattcggcattgtcggatcactggtggcaatgggcgagggaataggtccggccatcggcggaatgattgattgtacattatattcattggtcgtttctgtttattctgccgatggcagtgctgatggcgattcctttcttctttagaaatatgcctgatgaagccgctgcaaaagcaaacctggatatcattgggatcggactgctgacaatcagcattgtgatgttcgctgtatatatatcgctgtatcatgtcttttatttactggcgggcattttttgcttgattggagctgcagttcatacccgacatgcagaacatccgtttattgaccgttctttaataaagaatcgccgatatataggcgtcgttttggcaggatgtactgtattgggaagcgttgcgggcggagcccttacagatcgcttcggcagccggtttgtttttactcttggatggttattgatcttgtcaaccatggcagccgcgtcacaggtcggcgaccggacaccatggttgatgacgattatgctcgtgtttatatttggcggtctttcatttgtgaaaacggcaatttcaaacagtaccgcagaaagcttggaagaaaaggctgcaggcgctggaatggggatgctgaactttgcctgttttttatctgaaggaataggcgtcgcattagcaggaggcttgatggcagtgcacgggtttggctattctgcgcttccggcaatgaacgatgcctggagtgctgtattcagccgctcgtttgccatattcacagtttttgtattggctggcggattgctatatttattgacttgcaaacgcaaaaaatcttaggatattcgagtggttgggcgggaaagcccagccgttttttatgctgactcgattttctgaaacataatgaaaagaaaatcgtatttgatgtaaagcttcttgagaggatgaaaatgatgaaaagaagcatcggcacctttgaaattgacggactgacaattgaatattcgcgagtaggtgaagggaagccgattcttgtgatgcacggaggtcattcgaattgccgcgaggaatttgggtatcgagatctttatgagagccgattctctatcatcacgccttcccgtgcagggtatggccggacatcgaaagaaatcggggacagtttggaacttgcctgctattacatatgaaactgcttgatcatttaaatatcaagaaagttcatgtggttgcggtgtcagccggcgggccaagcggaatatgttttgcatccaaatactcggaaagagtagaatccttaattttgcaaagcgctgtcacaaagcagtggctgacagcgaaggatattgaatataaagttggtcagatcatctttcggccgcctgttgaaaaggccgtatggaagctgatatcggcgcttaacaatcgatttccggaatggatctttaagaaaatgctatcctcctttactacacttcctgctgatcaggcgatgctgaaagtcacggagggagatattgaagaaatgagaaaaatgaacaacagacagcgttcaagtcgagggttcttgcttgatttaaaaaatatagacgatttatctttccatcatttgaaggagatttcttgtccggtattaattatgcattgccgatatgatcgtgttgttccagccgagcatgcttttcatgcaaaaaaactgattcctttttcagaagtctatcaggcagacagctggggtcatctcatttggctgggaacagagggtaaatctgtctcacagaaggtcatcagctttttaaaaaccacatcatcttgatcataagatgaataaaattttaggatcgcagcctacccgcaaatgaagtagtgcaattttttaatcaagagcagaatgatctttccgaacagaactgatgaacgtcgtacaagacttgcaaataagatgaatgagaaatcctccctggccggttttcggagcacaagggaaacttatgtataagaatctattccgatagagggacaggtacgggatgaatcattgattaccgttgcctgcgatttcccaggggggagagagttggtaaacttgatatcatccgcgggtttgctttgcttggcattcttttagcccatagggaagtcgtctttggctgtggatatttcaatttgggcctgctgaatggatatggcgcagtttggcttgcggcaagcggcagcttcttcctaaactcgcgattgaaacgatgcggctatgcaatatggtgaaacgttgcatgaaaaacttaacattttaaaaatccagccgatatgatgaataaataactgcacgcttccggcaaatgtggtatggtaggtagtaagtttaggaaaagggaggatattgatgatcatcgtcacaacagatacaatcgcaaatcaaaacattgtcgaagtcaaagggcttgtcacaagcagcatcgttcagtcgcggaatatcggaaaagatattctgtcagggttgaagtcagtcattggcggagaattaaaaaattacacccaaatgcttgaggattcgaaaaaagctgtgagggaacggctcgtgaatcaagctgaagagcttggagcaaacgcgatcgtcggtctaaggttcgaactgtctgcaggccagggaacctccgaactcatcggatatggtacggctgttgtaatcggctagcttgcaatcgaaaacgaaggcggcggctctcgttgccgcctcagcgagtcaagaaggcttccctgtctgtttcgtctctttatgtttttgagtcagatggggatactttctgtagatgacaaacgctatgatcgccatatataagccgtagacgccgacagagagcagcttgttttcgctgaaattggcacctgcgatagagacgacgagaacgttggggacttttccaagcgtcgaagccgcaaaaaagacagcccatttcaccttgcttaaaccgcagacgatattcatgacaacggctgggataaccgggatcagcctgcccaatagtacggctgtaaaagcattttggttaaaatacgcttcatattcgctcattttcgggtatttcgttaagtgtctgcgagccatgtctctgaatccgtaacgtgagaggaaaaacaagagcatggtgccgagcatagaccccgtcagcgtgatcagcacgccgtttgcgattccgaacaaggcgccgtttaatccggcaatgagcgcaaacgggacgatcgggaaaaatacacaggccgccacaagcagcatgctgaataataccgaataaacgcctccgtccctgatgacgtcgagccaggaatctttgcagacgaatccgaccgcgatgatacttgccatgatgatgatagtgaatagttttctgatcataccgctcccgctgcctttctttgtctttagcttctacatttgcaataaagcttcttctaagtgtgccaaaatctcgtcagtttttgagaggttgcaattgctgagcataatcagcacttttttctcatccatgtatcggttaattgagctgataaaaccgtggatttctccatcatgccatattttatacttattttgatgattaataaaccatccgtatccgatcgaattgttttgaatgagcgccggagaagggccttcggctgcaaaagcctgctttttgacgcggctgtaaagggcttctttcaaagcatcttttgagacaagcttctcggtgtaaagcgccctgtcccataagtacaagtcttcaacggttgaatacagcccgctttccccgtagccgtatacgataggcgctttgatcatttcacgattcaggcataaatatccgactgtaggcgaaatatcttccggagaagagaaaaaaccggagtttttcatgcctaaagggtcaaagatcaattgttgaataacgtctccataagcttcatttgtgatcgtttcaatgatttttgtaagcagtatgtatcctgaattactgtaattgaacctttgtcccggccgaaattcaagcggcttgtcaataaaacgtctgataaattggtccaacggtgcgcgctccagctcaatatcgagcaattcttcctctagaaaatcaggaattccggacgtatggcttaataaatgtttgatggtaatgctgtcgccgttcggatagccttctaaatagttttgtaccgggtcatctgtacgaagcagccccttttcttgcagctgcatgaccgctatagctgtgaattgctttgtcagtgaggcaatttggtagcgtgtagacggttcattcttcaccttgtccttacaattggcataaccgtatcctttcgataacagtataccgtttgaatctgccagcaaaatgctgccgtgaaaatgattgttggatgcttgttccattaaataatcatcaagatgttccgctgtatataccaataacaacagtcctttcatatctaattatgataagaagaaaacaataaacgatagttttgaaaggaaatgaagcaggaagcgcgaccaaaataacattataaaaatttttttgtattttccatcatttgcagaataatttaagctaaatttaaaataaggcaatttcatgacatccgttaaaacgagtgctgttttgacggatgttttttattataaaacgattgaaatataagtcggcagtaacgaaaaggggaataaagtcgtacacagccttaaactaagggctaaagttctgtgtttttttgcaaggaaaaggactatattagtattttttaattttaatttaattttgaagggtttttcctttatgatctataatatgttatttaacatagtgaaagagatttttaaatctttggtgctgtcatgaagcaaaaataacaggaggttaagaaatgggacataaacatatcgcgatttttaatattccggctcacggccatattaatccaacgctagctttaacggcaagccttgtcaaacgcggttatcgggtaacatatccggtgacggatgagtttgtgaaggctgttgaggaaactggggcagagccgctcaactaccgctcaactttaaatatcgatccgcagcaaattcgggagctgatgaaaaataaaaaagatatgtcgcaggctccgctgatgtttatcaaagaaatggaggaggttcttcctcagcttgaagcgctctatgagaatgacaagccagaccttatcctttttgactttatggccatggcgggaaaactgctggctgagaagtttggaatagaggcggtccgcctttgttctacatatgcacagaacgaacattttacattcagatccatttctgaagagtttaagatcgagctgacgcctgagcaagaggatgctttgaaaaattcgaatcttccgtcatttaactttgaggatatgttcgagcctgcaaaattgaacattgtctttatgcctcgtgcttttcagccttacggcgaaacgtttgatgagcggttctcttttgttggtccttctcttgccaaacgcaagtttcaggaaaaagaaacgccgattatttcggacagcggccgtcctgtcatgctgatatctttagggacggcgttcaatgcctggccggaattttatcatatgtgcatagaagcattcagggacacgaagtggcaggttatcatggctgttggcacgacaatcgatcctgaaagctttgatgacatacctgagaacttttcgattcatcagcgcgttcctcagctggagatcctgaagaaagcggagctgttcatcacccatgggggtatgaacagtacgatggaagggttgaatgccggtgtaccgctcgttgccgttccgcaaatgcctgaacaggaaatcactgcccgccgcgtcgaagagcttgggcttggcaagcatttgcagccggaagacacaacagcagcttcactgcgggaagccgtctctcagacggatggtgacccgcatgtcctgaaacggatacaggacatgcaaaagcacattaaacaagccggaggggccgagaaagccgcagatgaaattgaggcatttttagcacccgcaggagtaaaataaccatttaaacgaacccgggaatccccgggttttttgttgctgccgtaaggaagcgggaaaagtatacagcggcgctttttgaacatactaccttctattaaatgtattaaaaaggaggaagtgttttgtcaaatcagggcaatttcaaaaaaacgatctctctgcttgacctgattttgatcggcatgggtgcgatattcggatcggcttggctgtttgccgtcagcaatgtcgcttcaaaagccgggcccgctggaagcttttcgtggattatcggcggcgtcattatccttttaatcggcctcgtttatgccgagctgggagctgcgttgccgcggacgggcgggattatccgctatccggtgtatacccacggccaccttgtcggatatttgatttcatttatcacgattgttgcctatacaagcctgatttcgatcgaagtgacggctgtcaggcaatacgtagcctattggtttcccggtttgacgataaaaggttctgaatcgccgacgattatcggctggcttttgcagtttgcgctgctttgtttgttctttttactgaattattggagtgtcaaagcgtttgcgaaatcaaatttaattatttcggtttttaagtattttgttcctttgacaatcatcatcgtgttgatattccattttaaatcggcgaactttgcgggagaatttgcgccgtttggctttggcggggttcagacatccatttcgaccggcggggtgatgttcgcatacctcggtctacatccgatcgtttcggtcgccggcgaagtgaaaaatccgcagcggaacatcccggttgctctgctgatttgcatcattgtttcggcttgcgtctatacgatactgcaagtggtgtttatcggagccataccgactgatatgctaaatgacggatggaaagcgatcggcagggaattttctcttccgtttaaagatatcgcggtgctgctcgggatgggctggcttgccactcttgtcgttctggatgcgattttatcacccggcggaaacggcaatatttttatgaatacaacatcgcgcttggtttatgcatgggcgcggaacggcacattgttcaaaatctttgccaaggtgaataaaccaacgggaattccgcgtccgtcgttgtggctgtcgtttgcgctcgccgttttttggacgcttccgtttccgtcttgggacgcgctcgtcaatgtttgctctgttgccctgatcctctcctatgcgattgctccggtttcagcagcggcgctgaatgtgaatgccaagcagcttaaaaagcctctgcaaatcaaaggaatggctgtcatcgctcctgtctccttcatatttgcgtcgtatatcgtctattggtcagggtggaacaccgtgtcatggctgctcggatcacagcttgtgatgtttgctgtttattgcgcgtgtaaaaaatacgttccgcaggacgatgtttcgtttgcacagcagcttaaatcaagctggtggatcgtcggatattatgtgatgctcctgattttatcgtttctgggctcattcggtaacggccttggcctattgagaacgccggtcgatttaatcttgatcgcgctaggatcgattgcggtattttactgggcgaaatatacggcgctgccaaaggcagtcattgattatgatgagaaaaaagaagaaaccgtttaagtatgaaaaccccgctgtatggactgcggggtattcacacgtttttattacagttgcggaagatctttagccgtttcggcagctttggtatcaatctgaatttgttcagataaattcgcaggatggtaataccctttggaaatcatatagtttgtgatctgttcatgggtgtcaatcgcgtcgtttaaatactgcttaagcgtttcgcgcacttctggagaagatgtttccgtgatagctgtggcaatgtttttgacaccggtttttgccgagattaaaaaatcggtggcaatgacttgttcagtcatcgcgcccatgcctgtcatgttttggatgaattcgttcatacggtttcacctctcactgacaatagaccttgtaaatgctcgatctgatgctttgtttgggatgcatcacgctccaagatgtcgcgaagctcttgatcctgaaccattcccgtcattgttgatgactttgtcagacaaaggtttttaaacattaacagctcatgcagctccaatgtttcatggatcgcattattcaatcgcaaacattcctttcaaatttgttattgtgtgaaggacacatctttagtatcaaaattcgttagcgggattattcggtttgttattttacaataaatcacataatgatgtcagacttttcggacgcgaaagaatttggtcaagagccatgttccttgcggaaaactgagtgtgagctgccagacgccgccgccgtcaagtccgtattcggtgatcagctgcagtttttttccgatgctgcgtgcgtcttcaaaccatacgacatgccgtctgccctgttcatcggtgtatctgaaaaaaggggactcagaatttgtatcatattgaatcggtgcctggtgcttcatggcgagctgaacggcgtcttggttggcgattccggggtatacggcaccgggctgatagggcagggtccagttatagccgtaaagcggaaagccgagaacgattttttctttggggacatggcggagagcaaattgaattgtttgccggacttcattgatcggagcaatggggccgggctcgcttgtcccgtggtgccagtcgtatgccatgatgaagataaggtcgctcactgcaccgattccgccatagtcataccctttcagccaggcgatattttcatttgttttcggcggaacggcaatcgtcaacacatagccggacggcttcagccgctctttcaacaggcggagaaaacctgaaaataaatctctgtcttcctccaaaatctgttcgaaatcaatattgacgcctgcatatccttttctggaaatcgtttggacaatattgtcgatgaggcgatttcttacggcaggctgatttaatacgcggtgcgcaagagacggactgaagcctgattcagttagattggtgactgtcatgaggggaggaacgcgccgtctccaagccgtttgtacggccggtgaatcattcagctcgcttaacgatccgtcgcttgaaatgtggtattcaaaaaatgccagatacgtggcgtatggggcaaaattatgaatcaattcctggtctaaccgggggtttctcagtgtgtaatatcctaaagcagtgatcggttttttcggcaattccggaatcatcacttttatccccggcctcatattggaaggggttacagacggatttgctttttgcaatgcttcgacggatacaaacgtccggcgggcaatcgtgtaataactgtctcccggctgaacggtatatgtataaagcggtattaaaagagcctgtccggggacaatgtttgttgcgatcaacccattcgccaatcggatctggtcaatcgaaattccgaacttggcgccgatgacaaatagtgaatctcccggctggactgtataaataaacaactggcacacttccttttgttcctctgtatgtgacagggggttttatgctatgtctatgaccgttgcagaaggatcatgcgccgttttttacagctggaatggtgaatagaaccgtgaagcggataattcttgactgaacagtctagaaagtgtatccttcaaataaaggaggtgataggggcttgggaaggagcaaagaatttgataccgctctcgtccttcataaagcgatggaggttttcggccaattcggctatgagggggcgtcgatgcaggagctgctcagccgcctgggaattgccaggcaaagtctgtacaatgcattcgggactaaaaggggtctgtttatcgccgcccttacaagatatctagatgataaaaatgcgcaagtgatcgccatgcttgaaagccccggatcagtgaagcaatcggttcggcagatcttccaggaaagcttaaacgttctgaaagaccccgaacgttcaaaggcatgctatatcatcaacagcgcaattgaacaaattccccgcgatccggaggttgccgaatacttcgataagcagacaaagcagttggaaaccgccttttacaaagcgcttgtccgagcacagtcacagggggaactaaagaagggcctccatgatctttcagcagttgcccgttttttgaatcaaacccggctgtcgctcacgtttcaggcgaagttaacgggggattttgatgcccttcaggatctgatcgatgtcagcctgtctattcttgattgatatattgtttgtcatggggagatgggctgctgcccgtttttatcactattttagactgattggtcaaaaaagaatggaggaaagaaaatgacgcgtgcgataaccgatgtgatggaactgtttttgcagtcgatgcttgaaaaggatatggaaaagtggatacagctttgggatcaagatgcggtgtttgagcatccatacgcaccgccggtttttcctaaaaaaatagaaggtaagtcagcgatttacgattatataaaggattttcccgaaaaaatcgatattgtccgctttacagcgccgactattcatcaaacggcaaaatcgggctattcggctgtcgaatttgaatgtgaaggcattgtgtgtgagacgggtcttccttataaccaacagtacatcagccttgtaaaccttaaagcgggcaaaattgtccactacaaagattattggaatcctttgactgtcgtcaaatcgttcggaggacagctgcaaacctttttataatctgacaaggagtgatgaaagtgggaaaaaaaatattgattaccggcggaaccggtacgacagggagccgaatcgccaaaaggctcgtgcatttgggtgccggcgtccggatcgcaagccggagaatacctgcaattaccggagcagaacatgtatattttgactggaatgatcaaacaacttacaaagacgcattaaaaaacacggactcattgtatttggttgcgcctgtcggtgtatacgaaccgtcgccaatcgtactgccttttttggaaatggcatcggcattcggcgtccgccgcattgtcctgctcagcgctgcaattattgatgaaaatggaccggttttcgggaagcttcatcacgcggtcaggcgatatgttcctgaatgggcggtgctaaagccttcatatttcatgcagaattttgaccatcagcatggcgcttcgattcgggagaaaaatgaaatcgtcaccgcatcaggcgacggcaaagtcgggtttatagatgcagacgatatcgctgaagtagctgtgcgcgcattgcttgatcaaaagccgcataatacgagccatattttgaccgggccggaagccttgagttatgccgaagccgcggcaatcatcggcagagcggcaggccgcgacatcagacatgtcaatgtcgaagtgtccgcgttgagaacaaggtatataaaggcaggattatctcccgattatgccggcttcatgtcggaattagatgagaaaatcaagaacggcaaagaaaaccgcatcacggatacagtggaacgcatcacgggaaaaaaaccgcgttcactggctgatttcgctaatgaacacaccggacgctggcgtctgttttaactcgttcctgaagctgaacggtcttttctcttcatttttgaccgttcagtccaattaataaaatgtttcgtttatttcccatgactcaactgtacagtaggccaagtgagggttcattcccatgcccattaaataagccattgccgctacttcttccatggcatggtgataggaagtggcttgggcttcatttaaaccgtaatgaacaaaaggtgctactgtgcacaacgtcttatgtttcaagtggggaaacaacggacatttaatgtggtgcaaggcggtttcgggatgctgatactgggggatatgcgtatgctgttcgggaaccgccgtctgctgtaaatgttctgcattctccatttctttcgtcctttctcgtgcggattttcgttgtattctatgttccgcttatgccctgtgtgttagacagttgtcacggtttgataggcaaataataagacagaaaggtcaaataccggtagacttttaagcaggataaaaaaaggaggtattttttatggctaaacatcatttttaccttcaggcagactggcctggaaaacgaaacgacatcggaaggattgaaagcgggaatttaaaaaccgaaatttcgataccaaaggaaatggacggcccgggggcggggacaaaccctgacgaaatgctgctcggtgccgctgcgacttgctatatcattacacttgcagcgatgatggaaagaagcggattggaaaaagagagcctgacgatggaatccgaggccgttgtcgatgtgacaggcggggtgtttacgtacgaaaaaatcattcacagacctctgatccgcctcccgaaagaagcggcgcaaaaagaggccgaacttgccgaaagactggctaaaaaagcggagacatcatgcatgatatcaagggcggttcagggcaacgtcgccattgaattagagccgaagattgtcgtctccaaagcggattagatttcgatcgtgagctgagccttttgatccgctgcttcggtgcgctttgaattgagcagaaagacgccgccgatgatcaaagtaagcccaataagagttttgagattaaatggctcctgaaatataaaatgcccgattgcagctgtcaaggccgttccggtgccggcccaagtcgcataagccgctgataaaggcagtgtttttaatgaaaagctcagaaatgtaaaagaagccgcaaaaccgattatcacgccggctgcgggcaggggggcgctaaagccttctgacagcttcagcatcgtgcttccgaatacttcggacaaaatggcagccgccaaaaagatcatgcctttcatgacattcgcctccttatgacaaattgatcagtacaacgcctgacacgagacagataatgccggcgatatttcgccggttcagcttttcttgaaaccacaagacgccgatgattgcagtcagaacggtgcccgctccgctccaagtcgcataggagaggcttaatggaatgacctgcaatgtgagcgacatcatgtaaaatgcgagaccgtagccgattactacaagaaccgacggctgccagcgcgcgaacccgtcagatattttcagcatggcggctgccgccgcttctgacaagatggcgatcagaagaaaaatgtagcctgcaatcatacggaatcctcctctatcgattttattgcatgattcaaaaggagagctttctcttcgtcagccagcagttccaattgaaacattccccgaaagccagatgcgccggatacgagtttgacatatgcaaaggccgggggggcaaactccgcagcgccctctgcgcgcgcttgtacaaagttgaacggtagttttcattcgaatatcataaagcgcagcccataaacgattttaaagtgtttcagcttttattccgaaatcgttatgagcttcttcaaagctttccccttttttagacataaaaaaaaccccgcttcactaaccggttggtaaaatccatcttaattgatgcaaaagttctaagtcaagaaaaaagtaatgtaaaaaggcccctgaaagagcctttatctgtcagaaataaggatagtaaggatacggcggatacggatatccccaagggccgagaagcgctccggcagtaaggccgcccaaaaatcctccgaagaaggggcccggaccgaaaaatggacgcgggccgaaaaacggccgcccaaaaggtccgcccaaagaaaggcctgccaatgattcgctggctgtcgtcgtcatatacaggagcatggtcgaaatgatacataaaaaaatccctccaataataaaatgatacctgactaacatcactgtattctgcccagccgtttttgcctgggcgcccgccggattttttagtgaagcagccctcaaaaaggagtgaacgaaaacatgacgctgtatcagtcggattggtcaaaagcgcctccccatgcccacgcctacagggcgagaacaacgactgccgagggacattaccacctaattgagggtttttcccagccggcaaacgggagcaatacagatgggcacgttcatttttattccggaattacttctttcgtcgatggtcattaccataggtattatgcgattacggggccagcgattccgcgggcggacggcacgcactatcatgaaatcgagggcacgacctatttggcatattctgcggctcccccggtcagatatggcggagtcgtttatgtaagcgatggaatgaaggaaaggcaccggcatccttttaagggttacacaagagaaatcgtcggaaatgagccgattggctggtgagggaatgtttggaaaacagtgaaaacgggtaaaatgaaatgggtgtttttgaatgtgaaatggtataatgggaggagcttgtttaaagagagtgatcatcagtgaataaaacgaagccgccggtcatcgttttgatcggaccgaccgctgtcggtaaaacaaaattaagcgtcatgctggccgagcgtttgaacgcggaaattatcagcggagactcaatgcagatttacaaaagaatggatatcggcacagcaaaaatcagagaagaggaaatgaacggggttccgcatcatctgatcgatattaaagaaccgacggaatctttctcggtagctgaatatcaggagatcgtcagacaaaaaattgcagagattgacaggcgagggaagcttccgatgattgtcgggggaaccgggctctatatccagtctgtcctttacgactattcattcacagaggaagcaggcgatcctgagttccgggcggagatggaggcgttctctgcgaagaggggggccgaatatgttcacgatcttttgaaagaacgcgatcccgaagcggcaagagccattcatccaaataataaacgaagggtcatcagggcgcttgaaatcctgcatacaacaggaaaaacgatgtccgaacatatggaaggacagcggaaagagcttttatacacgacggctctcatcggtttgacgatggagcgggaagtgctctatgacaggatcaacagccgcgttgaccagatgatggatgaggggctgctggatgaagtgaaactgctttatgatgaaaacgtaagaaactgccagtctgtccaggcgatcggctacaaagagctttatgcgcatctcgaaggcagagcgtccttggaagaggcggttgagacattgaagcggaattcgagacgctacgccaaaaggcagctgacatggtttagaaatcaaatggatgtcgcatggtttgacatgacgccccctgtcaatatcgagcagaaaaaacaggaaattttcacttacatagcaggaaagctcgaactttaatcgaaacaatatggtatagagaaacaaggaggaccagaaacatgaaatcgataaatattcaagatcagtttttgaatcagattcggaaagaaaatacatttgtcacggtctttttactgaatggatttcagctgcgcggacaagtaaaaggatttgacaactttacagtgttgattgaatcggaaggaaagcagcagctcatatacaaacacgccatttctacgtttgcaccgcaaaaaaacgttcagctcgaactggaatagcgattcacggactaaaagaccatgccttgcatggttttttcagattgcctgacaaaatcctgaaacaggttactgttttgggatttttcgttttcaaagcgactttacaatcacctgcggccgttgccggtctttcagaggaaaaaaactttggcaacctgtctaaaacgccgccgtcatcacgtcctgtgaaagtccgaggcattcaaatttacaaagcggcatctagtcgctaaactaagtagtgtttacatcaattcagtttgaaaatgaaaaggaatgagcgaacaatgaaacctaagatcgtcatcaaccattgggaagagacgtgtgaagatgattcctgctatgaatacggcacaagtattctcgtaaacggaaaagagcttgtcagggaagcgtcgatcatgacggctgttcagtcggttcttaaggaactcggcatcgaagccgatattaaagaggtatgcgagaacaagtgctgtgacgcttacaaaaaataagcgaaaaagtctagtctactaactcaatttttttcgtgttatgatagatttcggtttgtgagtaggatgagcgaacggctctcattctactcatatttctttggcctaaggcctcctaagctgaagcgaattgtgaactttcatcaactcgagcacaatatattgtgttttcttgaatgatagtatactatatattgtgtaaggttcgagtggaagactcggaaacaattttactaggtcgtgataatgatgattcagatcgtatttgattcaaaaacgggaaacgttcagcgctttgtggataagacgccttttcgcaataaacggaaagtcagcacagaggagtatctagacgaaccgtttgttttgatcacgtacacgacagggtttggggaagttccgaaaacgactgagatgtttcttgagaaaaacgcccatcttcttttgggagttgcggcaagcggaaacagagtgtggggagacaattttgcgaaaagcgcagaaaaaatctcgaagcagtatcaggttccgattctcggcaaatttgagctcagcgggacggccaaagacgttgaactgtttactcaggaggtagaaagagttgtcacaaaatcaagtgccaaaatggatccagttaaacaatgagatcatgatccaaaaagacgggaaattccagtttgataaagataaagaagctgtacatagttattttgtagactatatcaaccaaaatacggtatttttccatgatctgaaagagaaaatcgattacttaatcaagaatgactactatgaagaagagtttttaagccgctacacgtttgaagaaatcaaagaagtgttcaaagaggcttacgccaaaaaattcagattcccgtcctttatgagcgcttttaagttttacaatgattatgcgctgaagacaaacgacaagaaaaaaattcttgaacgctatgaagacagaatctctatcgtagctttattttttgcaaacggggataaggagaaggcgaaggaattcgtcagaatgatgatcaaccaggagtatcagccgagcacgccgacgttcttaaatgccggccgcaaacgccgcggagagctggtcagctgtttcctcttggaagtcaatgattccttgaacgacatttcgagagcgattgacatttcgatgcagctgtcaaagctcggcggaggcgtatctttaaacctttcaaaactgcgtgcgaaaggcgaagcgatcaaagatgtcgaaaacgcgacaaaaggtgtcgtcggcgtgatgaagcttcttgacaacgcattccgctacgctgaccaaatggggcaaagacaaggctcaggcgctgcgtacttaaacattttccaccgcgacatcaacgatttcctcgatacgaagaagatttcggctgacgaggatgtccgggtgaaaacattgtccatcggggttgtcattccagataaattcatcgagcttgcaagagaggataaagcggcatacgtcttctatccgcacaccgtttataaagcgtacggcgagcacctcgacgaaatggatatgaacgagatgtacgaccggcttgtggaagatccgcgcgtcaaaaaagaaaaaatccacccgcgcaagatgctcgaaaagcttgcgatgttaagatcggaatccgggtatccgtacattatgttccaggacaacgtcaacaacgtgcatgcgaacaatcatatttcaaaagttaaattttccaacctttgctcggaggttctgcaggcttcacaagtttcatcatacacagactacggtcaagaagatgagatcggccttgacatctcctgcaaccttggttcattgaacattttgaacgtcatgaaaaacaaatcgctcgagcagacagttaagcttgcaaccgattcgctgacgcacgtttctgaaacgacaaacattacaaacgcaccggctgtcaaaaaagcgaacaaagcgatgaaatccatcgggctcggagcgatgaacctgcacggattcttggcacagaacaatatcgcctacgaaagtgaggaagcgagggacttcgcgaacactttctttatgatgatgaacttctactcgattgaacgatccgccgaaatcgccaaagaaaaaggtgagacgtaccatgggtacgaaggttcagcttacgcaacgggtgaatacttcgaaaagtatgttacacaagatttctcgcctaaattcgaaaaagtggccaagctttttgaaggcatgcacatcccgacaaaagaagactggaagcagctgaaacagtttgtcaaagaacacggattgtaccacagctaccggctgtgcatcgcaccgaccggatccatttcatatgtacagtcaagcacagcatcggttatgccgatcatggagcggattgaagaaagaacatacggcaactccaagacgtattatccaatgcctggacttgcgccgagcaactggttctactataaggaagcgtatgatatggacatgttcagggttgtcgacatgatctcgacgattcagcagcacgttgaccaaggcataagctttacattgttcctgaaagatacaatgacgacacgcgatttgaaccggatcgatctttatgcccaccataaaggaatcaaaacactttactatgcaagaacgaaggatacagggcaagaaggctgcctttcttgtgtcgtttgattaaaggagagtatgcgaaagtgacgaaaatttacgatgcagcaaactggtcaaagcatgaagatgattttacccaaatgttttacaaccaaaatgtaaagcagttttggcttccggaagagattgcgcttaatggagatcttctgacatggaagtacttgggtaaaaatgaacaggacacatacatgaaggtgctcgcggggctgacgcttctcgatacagagcaggggaacacgggaatgccccttgttgctgagcatgtggaagggcatcagcgcaaagcggtgctgaatttcatggcgatgatggaaaacgcggtccacgccaagtcctattcaaacattttcatgacgctggccccgacagagacgatcaacgaagtctttgaatgggtcaaacaaaacaaatacctgcagaaaaaagctcagatcattgtcgggctctatgaaaaaatccgccagggcgataaaatctcgctgtttaaagcgatggtcgcatccgtttatttagaaagcttcctgttctacagcggcttctactacccgctttatttttacggacagggcaagctgatgcaaagcggcgaaatcatcaacctgatcttgcgtgatgaagcgattcacggcgtctatgtcggcctgctcgctcaggagatttacaatcagcagacgccggagaaaaaagaagagctgtatgcattttccattgatctattgaaagagctttatgaaaatgagcttgaatatacagaagacctgtacgatcaagtcggcctttcacacgacgtgaagaagttcatccgctacaatgccaacaaagcgctgatgaaccttggctttgaagcttattttgaagaagaagagatcaatccgatcgtgttgaacgggttgaatacgaaaacgaagtcacacgacttcttctcaatgaaagggaacggctacaaaaaagcaacagttgaaccgttaaaagacgacgacttttactttgacgataagtaagccgggctaaaagggcgcgccagcgcccaagccctgcccttcagctattgatacacggcaaaatgagagcagaacgaatctgctcttttcactttgaggaggaaacggatacaatgggaaaaatggacgaaatgattctcgtggtcccgcgggaaaacgtatttgcaaatgaaacgctgaccttccaaggcgtcaacagcgacggtgagacgatcgggaagatcatggcgcatattgaacgccacttcagtgaaatgagaaggggagacgccgaggaagatcctgcatttaaacagccgatcccttatgttgtcatcaaaagagaagacgaaatatttgtatatgagcggctcgaaggcggaggggaagcgcggcttcacaacaagctgtcactcggcttcggcggacacatgaactttgccgaagggcttgactttcccgatattctgaagttgaatacagaccgcgaacttgatgaagagcttctaatcgaggaatcagctaaagaaaaaatggtgacgctcggactgattaatgatgatgaaaacagcgtcgggaaagtacatatcggaatcctttcagcgcttgaattaaaaccgggcgcacacgttgaagtcaaagaaaaggagcagattgccggccgttggatgaaagccagtgatctgaaagaaaaaagcgtctatgacagacttgaatcttggtcacagtttgtcgttgatatcttagtttaaattggaaaactcgctgatcagcgagttttcttttcgtatagaaccggtttccattgaaaaaatgagccatgcttttcgatcagcccgaagccgggatatgggaaatgacagccgtggagcaggaactgtccgttataagcctgtcgggccagcagtctccttgtcttttctccctcgataggatcatgctcaagcgaaacccgcagcttcggattggagatactttccggaatatgaaatacatcattgatgatctgacagacgccgtcttttgtatgcaattcaatggtcaggtgtccaggcgtatgtccgggcgtatggatcagcttcagtccgggaagcagttcggtgtcttctgtcagcagcttcagaagcggccggacagcggagagaatgtgaaactgaggagacgccggcgtttgttttgcgtacagccattctgcttcactgagcagatgaacagcgtttggaaaagcgggctctccgttttttagaagacctcccgtgtgatctaaatgactgtgtgacaaaatgacatagtctatcgagtcaggcttgattcccgcctgcttcaggtgatgaagcaagtgcccgctttcttgtccgcctgtttccccaaatcccgtatcaatcagtatccgtttgccgttcgtctccagacaggcaaagttcagcgctgcttcaaattcttcaggataacgttctgtttccttggagtctcctcccgccaaaaaaaaatcccttgaaacccgaaatgctccatcagataaaattgtcatttgaaaagactcgagctgcatgcggtatggctccttcatgataaatccttcccccttgtgtttgaccgagctgcctttgaaaaggcagcttcattgtgtcttttcatttgcgatgagatttttgatcggttattattaaatcgtaattattatgatttaatagcggaagtataactgaatccgtttattctttcaatcaaaatatactgtttaaaaggaaaggagcatgattttatgccgacactggaagagctgtatcggtccgtcattatggatcatgcaagatacaggcgaaattttcgaaaaatcgataaacacggcgtgtattacgtccattacaaaaatccaacatgcggtgatgtgatgactttgtttatcgacattaaaaatgaaaagatcgaagacgcagcttttatcggagatgggtgcagcatcagcatggcttcctcatcaatcatgactgaactgataaaaggaaagacgttaaaagaagccgggttaatgcgtgaagcgatggaaaatatgatcagaaaaggagaagagccggaagaggatctgctgggagatgccgtttccctgattggcgtccatccgttgcgggcccgtcataactgtgccctgatgccttggcaggcgctcgatcggatcaaagagaacgtttattaaatgaacatcacatctaaagcactccggttctaaagccaccggcaaagaatatcggaagattcaagggaaaaaaggggcagtaacgaaagaggtatggaaaacgaaacgaatgtaaagcaggaagcaatggcgcagcttaaacggaaaggcattcgaatgacaccgcagcggctggctatctaccattattttctagccaacaggaaccaccccacaatagctgaaattcaacaatcattgagggagatatatcctgccgtcagtacagcgacgatatacaacaccatccgctattttaaacaagagggccttataaaagaaatggggtttaccgatccgcttcgttttgatttggctctagaggaacatgatcatgtcatatgcgaagtatgcgggaagatcgtcgattttcattgtccgcaactagagaaagtaaaagacattgcggcacggctgaccggatttaaagtgacacatcaccgattggaactgtacggcatctgcaacgattgccaggcgaaaagaaaatacgccgctaaagagaaaggggttagataaaaaatttgcttgtgcgaaaaaccaaaaaccgatatattggttttatgatgaagaataacattaaacgaatcaaacgaatttcgcttcgggaagaagtgtatcaaacgctgaagcgcgccatcgtacatttggagctaaagccggaggagcgcctgcatgaccaggagcttgcagagcagtttggcatcagccgcacacctgtcagggaggcgctcaaacgactggaagatgaaggccttgttgaagctgtcccgggatcggcaacacgtgtagcaccgttaaatcgcgaggaggctgaacacgcttttacagtcactgcggcgctgcatgcgctggctgtcagactgtcgcttccttttttaacggattccgactttgatcagctggaggcgcataacaaaacgttgcagcaagcgattcaaaaagaagacattatcgaagcaatcgaatcagatgctgcttttcatgacgtgtttttacaagcatcaaaaaacccggaaataacccgggcattggaaaggatttcttcaaaaatttaccgccttgaaatgtcgcagttttcctcgatcggcagcttgaaatctgttgaacagcatcagaacatcatcgatgcctgcagacagggggatcggaatgcggccatcaagcttgccgaggaaaactggctcagtctcggagatcgattggccggacatcaggaaaaggagtgaagggattgtgaggccgattatactgggcgtttttgcagccttcttttttgcttttacattcgttttaaacagggcgatggagcttgaagggggaagctggatctggagcgcttcgctgagatttatcttcatggcgcctcttttatttgccatcgtttggcttagggggaatgtgaaagagctttttcaggaaattaaaaaagcgccgggcatttgggtgagatggagcatcatcggcttcggtctcttttatgcgccgctctgttttgcggcggcttacggaccgggctggctgatcgcgggaacatggcaaatcacgatcatttccggttccctcttggcgccgcttttttatgaaaccgttcaaacaaaaacaggtcccgtacagataagaggcaaaattccttataaggggctcacgatgtcgttcatcattttaatcggggtggcgctgatgcaagctgagcacgcggcacagctttctttgcacgagatgctgctgtgcatcgcgccggttatattggcttcatttgcttatccgcttgggaacagaaaaatgatggaagtttgcgccgggcgcctcgatgcttatcagcgggtattggggatgacgctggcaagccttccgttttggctgatcctctcgctgtacgggctggcatcggcaggtgcgcccagccggggacaagtcattcagtcaggattggtggctgtattttccggaatatgcgcgactgtgctgttctttgccgcaacagatcttgtaaaaggggatatgcgcaaattagcggctgttgaggccacacaatcgtttgaagtgctgtttgcggccgctggtgaaattttaatcctatcgagtccgcttcccggtgccatctcatggagcggaatggctcttgtgattatcggaatggtgttgaacagccatgcatcgaatcaaaagccggcggttcaaagtaaagctgcaaaagcataaaaaaagcctgcgatctatacgagacagatcgcgggcttttcttgatgattgtccctattcctggtaaatgaaagcatcaaatccggcgtttttggcttgctgaacaagcgcttctgcattctctttcgaagaaaaggcgccaatttgcactttgtaaaggctgtccctgtcaattacaatggcatcaaacccttttgctttcgcttgagcggcaagtgaatcggcgttggctttgtccctgaaagcgccgatttgcactttaaaaagggctgtggatttttttgaaaggttaaatgcccttgccagtccgttggcgtggcctctcgcaatggattgaataaacgcggatgacttcagtttctcggcgtcgcttgtattgtctacaaagccattttccgtaagcagtgctggcattgctgtttcccttagcacgtgaaaattggctgttttcttgccgcgatccctgaaatcaaccacttttaaaatctcttcatgcatgatatcccgataggtggtggtaggtgcgccgacgccgggataaatgtaatcctcgaaacctgtcccgcccccggcattgatgtgaatcgatagaaagtagtccgccccccagctgttcgcggcgttcgtgcgttgcgtcagactgacggtttggtcgcttgtccggctcagctggactgtaacattttgatattcattcaggagaatgtttcttaaagccaaggcgatttgcaatgttaactgtttttcttgcaaaccattggctgaagcgcctggatcagtcccgccatggccgggatcgataaaaatttttaccacaagacatcacctcaataaacagtctatgaactgatgtatgggaagggttgtacgattgtcacctgataacggaattttttaaatattcagcttattatagaacgcaatatgatctttaggcaagggggttgcatgattaatgtttttatcatataataaattacgctgcattgtacgtaatgataattaagttttaacctttaagctgtaatagggagttttatatcggaaccggaatgtcatgccttcctcgaaaggacgacaggaacgtttctgcagacacccactttgaggagtgtggtttaaaactttcttacttgcatacggcaattgcagcacttaagtcatttgaacaaaatggcttttttatttgcggaaaaatagtttacaataaaaattttatgtaaactaaattgctgtgaaatttgaaataaagggcggtttccgcccttttattcattttaaagcgaattgcgtaatatgaaattaatgcgtgaatgccagccggcagaagatgcaaaaatgactggcgtcaaaaatgctgaatgatcataattcctgtgatcatcaggacgattcctagaatgcgctggacgttcaagcggtgtttggggattccgaaccacccaaaatgatcgatgacgagggcgatgatcatttggccgcttaaagccaaaacaacagtaagagacgctccgacaatcggcaaaagcaaaatattggacgtaataaagacgacgccgagtattccgcctgtccagagccaccacggactgcttgtgacaaaggtttttgctgtttgtaaattgtttaaaaataaccgccgatgctcaatgaacgatgtaagaaaaagaagaacgagcattcccaccaaaaacgaaatcagagaagcgataaaaggtgagtggatagcatttctcagctctgaattaatggatgtttgaatcggggatgccattccggcaaaaagcccgagcatcatgaaaagaaaaacgtacatagatttgtttttcatctgtgatgaactcccttgctatttaatattttttgatgatgaaaactccggaaataatgaataaaatgccgatgattctaggaaagtttaattcatgaacgggtacgtgaaaccatccgaagtgatcgatcgccagagccatgatcatctgcccaagcagagtgacgacaaccgtcagagctgatccaagacgcggaagcaacaaaatatttgaagttaaataaaaaacgcctaaacatccgcctccaatgaggatccaccagggaatggaaggaacaagtccgatgatagacaaaaaatggcgctctgtcactaaggcgacaatgagcaggagaagcgtcccgacaaaaaaagaaatggccgccgccccgtaaggtgacccgattttcatgcccagccgtgaattaattgaggtttgaacgggaatggccattccggccaaaatgccggctatcagtattaaaatgatcatcatttctaaaaactcctttttgcgttgattggaacgattatttcaaatctgcggaaagccttgctgttttgaaggacaccttgtattttggcgaaaaggagttcatgatgcaagtgttgattgatgaaaagattgcttattgtgatcccctctgcggcttaatgttgagagtgcccccttatgtattaaatagcgcaaatcggtagaacagccaagtgggacaataactttgatttttacgatccgccatacaaaaacctttggtatcccagtcattgtaaagctcacttttgtcttttcttttgcgacctttgccattgcatcctgcacattgaaattcaaagccaatactttcctcaacagccgctttatttctacatatcatttctatatttgtataaaaaatcaagtttgaatcacggcaaaattccgctcacccaattgaacaggcaaatttttgggaaagaagaattgttaaactgaaaaaagtcctttacactacaagtaatattttgttagggggtgggaacgtgttcaacgaaagagaggcgctccgattaagactggagcaactgaacaatgccgagattcagatcatacgcgaactccaaagtgagcggaaagacatttattccaggctgcgggaattagatcgtcaaaaagtttcttcatcacatcataaaaaaactttattagagttagtcgatgaaactgtaaatctcttgaaaaaatagatcgagttgtagatgaaagaattaacagcagccgatgcttgaccaaaaagataaaaaagcaagttatacttgtaattgtgcgaaaaatggaaaggttagcaacttgactagaaaaaaaacattgtataagattattcttacaaatccaataggaataaaagccctaaaactgactgacttgtcaatcaaggcttagggtgaggagggaaatacatggggaatacagacacaagagaggaattgctacatatcgcgcttgagctttttgctacgaaaggataccacgcggcaaaaatttcagatatcgtaaaacaggctggcgttgcacagggaaccttttactggcacttcaaaagcaaagaagaaatcgccaaggaaatcataggcagagggaaagataaccttctcgcagccattcatcaaggctacaggcaaacgtttgctcttgccgatgatatgatccaatccacgacagcgcttatgaaaagaatttttacgtttgcacaggagaatagaaacttaatgacatttttattagtcaagggacaaggcgccgatccggaaatcagggaggcaatcgaagaggcgctgatcagtgttgaacaggcatttaaaaagaacattcaaagggctacagaacttggaatgctaaattcctcccataacactgatctgcaggccaccatgttaacaagtcttgtgttgggcacactatcaaaatggctttttgggccaaagcatgatctgaattatgttcctaagttttcagttgatgaaatgactgaagaattggttcattttgaatttttcggactgattggccaaagggggaattaaatttgtctactattcaaaaaacaaatggagagtttgggatttttcatgaagccggtatgcaggcgaaagggtctttcactccgaattcagacggacttacaccgattgagctgttggaagcttcattaggtatgtgcatcaccatttctttgcaaaagatgtttgaaagggatggtatagaggtgctggaggatgagttttccgtttctgtttccgccgctaaagcccccgaaggcccgtcccgtgttgaaaaatgttcggttagcgttaaattgcctgagcatcttccgaccgactataaaaagaaactaatcacctctgctgaaagggcatgtacaatcggcaatacgttaaagcgaggggtaacgattgataccaatatggtgtaacaacctacatgatgaaacgaaggagcatgaaaatggaaaacaacagtaaaaaaccttcctatacaaacgctgatgattttgctgttacatcagtccctgaaaataaaagaaaatcgatttttaacattacgattacaagctgtgcctggatcatctcattgtcgacgattgtgactggaggggcattaatccagggattgaattttgcacatgccgttttagcagctgtcttaggcatgctgattcttgcggtatatggcttttttcaaggagtaatgggtgcgaaatacggaatatcgactaccgttcttgcccgtctggcctttggtcgctacggatcgagcctttttggaattgtcttggcgctgacgcttggaatcggctggttcggctggcaggttgctttctttggcacgaccatttccgaaatgtttccgggtgtttggcttgcaaagcctgaggtcgccatcgtttggggcggcattttaatgatccttaccgcgtttataggatatcgcgggcttgccgctttaagctttatcgctgtacctttagtcgtcattttttccatatggggaatcataagtgctgtcaattactcaggaagctggcataacttgctgacatttcacccgacaggggatcctctgacgatatttgccggaattacaattgtcgttggaaatgctgcattgggcgcggttgtttttcctgatgtgacgagatatgcaaaaggagcggtttcaggaggaataggcgcttctgtaggttatttccttggaggagtgttctgtcttgttgcgggagcggcaatggcgattgccgcgaatgttccggatatcgggtcaacaccgaatattcctgccgctatgagcaagcttggcctgggctttttagcatttttaatcatcgtttttgcacaatggacgacaaacgataacaatttgtataccggttcgctagggcttcgcaatgttgtgaacattcctaagaaagcacttgtggcgatcatgggcgtgatcggaattatcattgcattactaggtgtccaaaatatgtttgtgccatttttaacattcttaggcttgtatgttccgccgattgcgggagtcatgatcgccgatcattggatcacagcacctgtcatcaagaaaaaacaatatcaattcggggctggaacaacttattcgaagctgaatgttgcggcgattctttcggtgatcatcggaggttttaccgcttcaaagataacgttcggcatcgggccgattaactctactatacttgcatttttgatttatatcatctttacgtttattttcacaaaattaaatctccgttacgaaatcggagaagcgacagaggaatcgtctggtttttaagcggataaggaggaaaggttttcaatgatgaatgaaaaaaaccaatgggtatttggaattgatgtcggcgggacgtttacagatttagtggcagtcaacaaggacggaaaaatggtttcgacgaagacgccttcaaccccagaccagtctgatggtgtcatgaacggaattaaaaaaatggctgaaatcatcggaatagacgtaaaggatctattagccaatagtccattggttgtccatggaacaacagttgccactaacgccttgctggaatataacggagcaaaggtggggcttctcacaacggaaggctttcgggacgaaatcgaattccgccgcgcgtataaagaaagcgtgttttctccgcgcttagaagctccttatcaaattgtcccaagaaggtatcgtgtggggattcctgaacgactggatcatacaggaaatgtcgtaactaagcttgatgaagaagccgtccgccgggcagtccgcgggtttatccaagagggggtcgaagccgttgctgtctgctttctgttcagcttcatgaatccttcacatgaaatccgtgtcaaagagattattcaagaggaagctcccggcatgtttgtatcgttatcgtatgaagtgctgccgcagattcgggaatttgaacgggtgagcacgaccattgtcaatgcgtttaccggcccttccatgcaaagctacttaaaccatcttgacgaacggtttcgcgaagacggatttactggagaactgtttgttatgcaatcaaacgggggggtccaaaatgtcattcaaagcgggaaatttgccgcgggtggccttttgtcaggtccagccggaggagtgacggctgcttcctttatcggggaaaaatcgggctacgagaacgtcattaccgtagacatgggcggaacaagctatgatgtctcggttatcgaaaaattaaatccggcgatcacgacggaaaattggatcagcagatacagggttgccttgccgatgatggatatccatacgatcggctccggcggcggaagcatcgcctggattgacagcggcggagctttacaagtcggcccgcgaagcgcaggctcaaatccggggccggcctgctacggaaggggcggagaagaaccgactgttacagacgtgaatgtcttcttaggctatatcaaccctgataacttccttggcggagaaatgaagcttgaccgttcgctggctgaaaaagccattcgtacacgaattgccgaaccgctcggaatttcgacagtggaagccgcgcttgcaatctcacaaatcgtcaatagtgatatgtcaaatgcagtccactttgtaacgacacagcgaggccatgatccaaggaacttcgccctgatggctgtcggcggcgccggagccatccatgcaggcaagcaggcggaagacctgggcattaaaaccgttatcgttccgtcccttgctccggtcttttgtgcgctcggcgatgtggcggcaaaccttaaagtaacggagctcaggacgcgctttgaaagtttgaaaaacgttgacctgcaagcgatgaacgccgattttgaaaagatggaacagacggcccgcgaaaaacttggaggccaatcggtcaccaatcaatatgaaacgcgtcgctttatcgatatgcgctacgcgggggaagtccatgaagtaaccgtaccggtgaagtcaaggacgcgaaggattacagagttgaatcttgaagcaacggcggcagacttccatgaccttcatgaaagaatgtttgcccataaagaccctgagcacgacattgaaatcttaaacctccgtcttgatctggtgggagtcagagagccgttaaagcttaaggaggagcagtttgaacaagaggatccttcaaaagcgaaaacaggtgaacgcgatatgtattttgacatcgaaccggcgaaaacgcctattttcaacgggtcaatgcttgagccgggcaacctgattgtcggtcctgccatcattgagcaatggggtacgaccattgttgtttacccgggacatgaggctctaatcgattcataccgcaactgtgtcatcgaagtaaagcatgctcaacaggcgacaagaggtggaaatgcatgatccaagctcaaattctttatagaaagctgcaagcgatcggcagagaagtcggggataatttgcagcgaatctcccgttctcctgtgctttcgcaagaccgggcatttgctgcagcgatttttacgaatgagctgaaaatcgcggttcaacatcaatacgagcctgaacatttgttcgcattaaaagaaagtgtcgaaaatctgttcgactatttttcgtttgatatcgcagatggagatgtgctgctggtcgcagatccatacagcggcggaacgaaagggcagtcgctcaccatggcggcgccgctattccttgaaggggagctcgtactcttccccgctatccgcgctcagatgattgatttggccggcgagtatccggggggcttccatcccgatgcatttgaagtatggcaggaaaatatcagaattactccggttaagctttataaacaaggagttctgcagactgatattcttcgttttttattatcaaacagccgggtgcccgcttcttttaaagcggatcttgaagccatgtatacatgtttgcatggtgccaaacagcaattgaaaacgtttcttggcagctacggtcaaaaaacagtggccgcatcgatcaaaagcatgtttgaatacagccaaaaaagggttgagcatcatgtctctcatctgcctgaaacagaaatgagcgctgtccaggagtttgaagttaccaaagggcacaagagtacaattcatgtgcaaatttcaaagaaggagaatgcggttgagatcgatttgagcggatcgtcagagcagtccgtaaagccggttaattcacctgccgctttaacgaaggcgtttgccgtttggccgtttcttgcaaggattgccgatgaaataccgatcaatgaaggaacgcttcaaccttttcaaacgaagacgaggccgggaacgattctagatccggaatttccggcagctacagcactagctccaagcattaccggacatttcgtcgctgcagcggtatttaaagccattcaaaacggacaaggcacaagtgaagaatttccgccgatttatgggccaggtccgcaggccgttttttatccggagcttggcacaggagccgaaacaaaatcaatcgttctcgcacccgggtatccttcagcttcaaaaggcttcggaccgcctgctttatttggccaacggatgcttgtctctgcggaggaattggagctttaccacggttttaaaatggtttcccgggagtggacggacaatggggaggaaatggaagtgtccctgcttaaccaggaggacgatatttatttcaaccttcttctgccttttagcgaaaggggaaaatacgggtctctgtcaagaacgggagaccatgacgaaaccttttatgaaagcacggtacaccaacatgtgaaaaaaggcaacctcctcgtctttacgtactctcaaaaggaggagcagctatgatcaatcaggactttatcttatcacaggtggtcggcggttctcttgatgcggttgccagggaaatgagcgccactgtcacgagaacggcccgttcaccattgtttaacgaagcgcatgattttacgacgggcgtctttgacctttccggcaaaaaatcgcgccttgtcgcgcaggcccccggctgtacgcttcacctttatgcggtcgtaggcgcagtggaccatctattggacgcctttcggtatgatcttcaccccggggatattctcctggtgaatgatccgtatcatggaggctcgcacagccttgactggacgatcgtcatgcctgttttttataatcgcaagccgatcctgcttcctgctgtacgaagccatatggccgataatggcggtccggttgccggagggtacaatccgcgctcaaaagacatttggcatgacgggctgcggattccgccgttaaaaatttatgagcggggagaaaagcgaagggatgtattcgatttaatcgttgcaaacaaccggctttcacattggcttgaaggcgacttaaatgcgatgatcggggcgtgcaaggtcgctgcctcccgaatccagacgatgctggataagtatggcgccgagaaggtgattacagccattgacaaccggattcaatatacagaaaacagggttcgcgatgaaatcagcagctggccggacggcacctatgtcggtgaaacattcgctgatcacgactttcaaggcaaccgcgatattaaggttcgcgcaacggtgaccgtcaaaggcagcgatcttcacattgactttaccggttcatccccgcaagtaaaaggcttcatcaacagcccgctctcaaatacgacttcgtttgcttttgtcggtatttcgacttgctgtgatgaggatattccgatcaatgaaggatatatgaatccggtaacagtaaccgcgcctataggaacagttgtgaacccgcagctgccggcaccgtgcggacacgcgactgcgtgcgtcggagcagaaatagccgaggctgttcttcaggccatttcacaatgtgcgccaaaacgggtcggagtgaacgcccataagcttcctctcgcctattctcacggaaaatacgatgacggcaagccgtgggtgaatctgaatttttacggctataccggcggtgcgggagctgcatacgaaacggacggatgggggctttatcctcctgttatgacaggagttattcttccatctattgaaatgaccgaagttcaatacccgagccgtgtattaaagcatgaatatacaagcgattttacgggtgcgggccgatggagaggcacacccgggttggatgttcaaatccagcacttaaaggaaagccgcacaagcgtcatgatggcagggggccgaaacacaacaaaaggcttctgcggagccggcgattcaccaagcaacaaggtgattgtcgggtatggaacagacgaagccagagaaatcgatgaaacggcttttgaagtcaaaatgcctgtgggcggcatcatccaattttaccgtgcaggcggcggaggctggggaaatccgctggaacgtgaaccggaaaaggtgctggacgacgtcttaaacgagtttgtcagcattgaatcagcattgcaggattatggtgtcgtgattgaccctgagacacttgccattaacgaagctgaaacaaaacgtgtgcgggcatccaggcttccataaataaaaaagctgatctgagaggaattacttttcggatcagctttttttcttttcaagacatctatggtaaaaagaggataattgctttcgagagagaatgtaaacataaccggttttatctttttaaccggcgggtacataacagattagcatgtgaaggaggccaaatcatatgaaaaacaaaaaagcgttttggggaccttttctgttcggcgtcggcatcatcgccatgatcgacggcatcatctttcatcaattgcttcaatggcacagcgtgtacatggacacagaccgctctcaccaaattatgagcgacggactgttccatctgttttcgctcgtcatccttttcatcggcggaatcctgctgtggaacaggggcgaacttggcagcagccggccgcagcacatcttttggggagcctctttgcttggggcgggctggtttaacttccttgaaggcatcatcaaccatcatcttcttcagattcaccacgtcaaccagctaagcccgaaccgcctcttattcgactttgcttatgacgcatcgggccttttgatcattctggccggatggctgatctaccgaaaaggcaaacagggataaaacagtggtttgtccgcacagctacctgaatacaataagaaaatatttctcgggaaagcgcaggtttcaacaagacctgccctgtttttgtcaaaatttgaagaaataaaaaacccccattttaaaaattgatgtgatcagtaacagccgcttgaagaagtcgttttatgtaaacaagtttttaaaatgcggcaaagtgcagctgttcacttcaagcaaaaaggggattaaaaaaagatattcagtggaaaaaaggtgttcatatcgtttaacggacatcttttttaaataggaggtttacatataaaatgttaagtgtgctgctgcctaatttgcttatattttctgctatcattttatttttatattacatgatcgtattggtaaaggaaaacaagataaatcgtaaacaaaacgaggaaacccaacagttgcttagggagatattaaaggaagtaaaaaataaagattcaaagtaataataaatgttattaaagtttcaatatttctggatcaatatagtcccaagggcaatatgaagaggtactcacagcaaaaactgttatagaacataacgaccgcatctctggtcgtcttttttaaaacgcggcatgttacttatcttgataggaaggtgtcattctgttgagtagacagggtttttgaccgattcctgtccgatagtaataaaatattcattgacttaggaaggggttgaattcataaagtcttgcaaaatcactaatatccgcttgctttctggatagcattgttagaacgttagaagaataaggtcttggaggaacacatttgttacgcatcctttcactattgaatgctactgaaaatccatattaaaagtactgtaaggctacttaaagtatgacataatgtggagcttcttgatgaatggtattacgttgagtataaaatttcatcaatagagcattacaagagaaaggtctacctttatatcctagtcaaggtgctacagttgagctttgggaaaggaagcttaaacaattggtcgactaatatttaaagtgtttttgttaggaggtaaaacagtattggataagaaagatattaagttcctcgaggagctgctttataatacagataaagacgatctagtaagagtgacgagaaatattgaaaaccctgtgattcttcaagtttttgcagcgaattataattggaatagtggttttgatgttccaaaagcaattcttgagaatgagaattgcgattatggtacggggttattaatgttccattatgcagatggttatcgtatgctcgaaagcccagacaatgtttcagcatctgctttagaagaatggaaagattttttaatccaaacatatcaaaagcttataaatttgcagtttaaatctcaaaatatatcctgaaataacaagggttcaacggtttaagttttaaaaaaataacccgcatattcccgatgctttacttgaaaagtcaccagggaaagtgattgaagttccgaaaatttaacgcgtttttcacccaaagttacccgtggatttcaatccattagaattctcactttaaaatatgaggcatatcatttcccaaagttatgcacccatcagataaaagaaaaaatacttactgatgtataatttgaaatattaacgcattacatttcttcatctgaagtaccgactcgaatgcagcaattaggaagaagtgaaatttaatgagaagtatactgtttagaaagaggtattcgttaaacaaaagcactgcaatggtttattaatttgtaaaaagcataaactaaaagacccgactgccgctgacagtcgagtcaagtatacaaaccagctcacaatgggctggctcatattaaaatagactttcccttagaaggatagatctttactttaaaggatgatagattgtgatgaaaaacataagcaaatatgttgtcctgttttttggggtagccctatttttatacttttatgatatgtttatgcctaaaagtgtgctttattttgttgtgggaataccagcattatatattagcacagtccttatcatgaaaactttaaagctacaaaaaatacaaaagattaatccagaattaaaatagaccccttattaaaacagggggtctaattcataaactgcattcttaattggccttttagttcaaaatagacgggagggagctgtgtgttcgaaaatcttcttgtgcaatatttgaatttctttatgatttcaacacctcgatgattttagatgggaaagataataacttcctctcagggcatatatcctaataattaaggcaaacgcgttacacactaatcaattcgatcatagtgaccatgaataacaacggctccactgttattgatcaaccatatcatctttaattttctcaaaacgagcctggttaagaatctttttagcaaattctctattttgaacacattttctaacattagctttttcagattcaataaagagtttttggtatttatcttgaatatcttcgttaatatttttagatttatgaatataaaaaaaggaaaaattgaatttttaaaatacatgtataagaagttggattgtgatttttttaaaccacaaaccatatggctgggctgtgattattcaaagattacggttttattctgaacaaagagagatgtaaaaatggtaaatgtcttaaataatatcttgaaaaatgacagattggatgcatatccattatttaaaaagttttgttccctcaaagaaaaagggttgcgtaagaaatcctttacagcattatcttcctttattgatgaagcaaagaaatgggatgatattgcacaacagaattttgcttgttggctgtttgctttatttgaaacatcagatgatattcaccatgtactcgttcatccattggaaaaggaacttttacagcctttgcttgagagatggatgaagagtgatcctgaagattcaagaccatataggtggtatggggtgtttttaaatcctgaaaaccgtgtcgattatttaaacaatgcacttagacttggtggcgggaatgaacaactatccttattaactctaatcgatattaatttgaacgccctttggtattcatttcatcatatctccgaagatttgtatcttggcgatattaaagaagatacagcacttcttgctaagtcccggccattaaacaacaaagtagaatgtgaacaaacaaggaaaaacaataacgaagcacttaactattatcaagatctgttggatgactgggtgatgtttaaaaaagaacgatcaaagggatttgttgaatggtgtgaaaataagggtagaacctattattgggtcaaagcttattattacgaaagataactatattatgttcagtaacagaatcatgaagacaaaaaaggcgaatttcatttccttcaaatcaaaaagactttggtgaagatcccgctgtgaaacaggggagagccgagcagcgcctgcagcacatcttcagacagattggctccattccccgaaggacctcatcaatcaccactttctcccgatttgccatgtcaacctgttaagcatttaccaaacaggatgaaaaaattggtttgtccgcacagcttacctgaatacaataaaaaataaagtatttctcgggaaagcgcaggtttcaacaagacctgccccgttcttgtcaaaaagcattggattgtgcagtcatgtgggcgtctgtcacggcataagcgcgccatgaataggatataaagagagaatggtgaggtgagtgtgttggaaagggctgttacttataaaaacaacggacaaatcaatatcatattgaacggtcaaaagcaggttttggccaattcagaggctgaagccgaatatcaggccgcactgcaaaaaaatgaagccaaacacagcattctgaaagaaattgaaagggaaatgaacacgctggtcggaatggaggaaatgaagcgcaatatcaaggaaatctacgcctggattttcgttaataaaaagcgcgaagaacaaggccttaaggccggaaaacaggcgcttcacatgatgttcaaaggaaatccgggaaccggaaaaacgaccgtcgccaggctgatcggcaggcttttttacgaaatgaatgttctctcaaaaggccatctgatcgaggcggagcgcgccgatctcgtcggtgagtacatcggccatacggcgcaaaaaacgagggatttaatcaaaaaagcgatgggcggaatcctgttcatcgatgaagcctattcccttgccagaggcggagagaaagacttcggcaaggaggcaatcgatacattggtcaaacatatggaggataagcgcaacgaattcattttaatcctcgccggatattcgcgggaaatggatcattttctttcattaaacccgggccttcagtcaaggtttccgatcagcatcgattttcccgattactcagtcagccagctgatggacattgcaaaacggatgatggcggaaagggaatatcagttcagccctgaggctgaatggaagctgaaagaccatctgatggccgtcaaaagtacggtcagccccgcgaagttcagcaatggccgtttcgtccgcaacctgatcgaaaaatccatccggtcgcaggcgatgagactgctgatgggagactgctacttaaagaatgacttgataaccatcaaaagccaggatctcgacttgaaggaagacgcgccgcacgtataatggcgcgttctttttttattttcgaggatttctggcaaccgctcccttcgtttgttatgatagtactgcttattgactaacgttaagaaaggaacatgatcacttgaacgaacaggaagtcatgaaagagaaagccatattagtcggatgccagcttccgcacgtgtctgatgagcgtttttcatactcgatggaagagctcgccgcgctgacgaaaacggccgacggaacggttgtttccacggtcacgcagaagcggaaccgtgtggatgctgctacatatatcggaaaaggaaaagtagatgaattggcggtgctctgtgaagagctgtcgcccgatgttttaatttttaatgatgaattgtcgccgagtcagctgaaagcgcttgtcacaacgcttgacgtgaaaatcatcgaccggacgcagttgatccttgatattttcgccaaacgcgcgaggacaagggaaggaaagctgcaaattgagctggcacagctgcaatacgccctcccgcggttaagcggccagggaatcaacctgtcaaggcaaggcggaggaatcggaacaagaggtccaggggagacaaagcttgaaaccgaccggcgccatatcagaaaccggattcatgaaatcaatgttcagctgtctaccgtcattcgccacagaagcagatacagagaaagaagaaagaaaaacggtgtactgcaaatcgcgcttgtcggctacaccaatgcagggaaatcgacatggtttaacaggcttacagacgccgacagctatgaagaaaaccttttgttcgccacacttgacccgatgacccgcaaaatgatgctcccgagcggatacagcgtgctgctctcggatacagtcgggtttattcaggatctgccgacaactttgatcgcggctttcagatcgacgctcgaagaggtgaaagaagccgatctgattcttcatatgatcgattcttctcacgaagactacgagggccatgaggagacggtcaagcgccttcttgaggaacttgaagcagacgatattcctgttttaaccgtctataacaaaagagaccggaagcggcctgatttcatcccttcttcagggagagggcatatcatgacgagcgccaaaatagacggagacttgccgctgtttaagcaggcggttgaagactatctgaaaaaggagctgctcgttccgtatgacgtgagaattcccgcttcagaaggaaggctgttgtcgagaatcaagtctgagacaatgacgaacagcaccgtttttgacgaagatcgcgaagcatatgaagtggaaggatatattctccctgaccaaaacattttgggagagctgaagaagtatatgtaggaaaggatactgcaaaacatgtttgagacattaaaacacggagatctactaaagaaaacggcggtggaggctgaaaccgacatcgcacagatccacaaaacaattgatgaaatcagtgaacgaaatgagtggagggtgctcgaaagctacagaaagcacaaagtatcggacacgcatttcacaccatcgacaggctacggctacgatgacatcggccgcgatacgctggaaaaaatctatgccgacgtcttcggcggtgaagcggcccttgtcagaccgcagatcatctcgggaacccatgcaatatcaatcgctttattcggcgttctccgcccgggggaagaacttctttacatcactggcaaaccgtacgataccctcgaagagatcgtcggcgtcaggggcgaggaaaactcggggtctttgaaggatttccagatcggatacagccatgtcgagctgacagaagagggagccgttgattttgaccgggtggcagcttccatcacgccgcagacaaaggtcgtcggaatccagcgctcaaaaggatacgcagaccgtccgtcttttacaattgatgagattgagaagatgattcgctttgttaaagaaataaacgaaaacatcatcgttttcgtcgacaactgctacggcgaatttgtagaagagcgtgagccgtgccatgttggagcggatctcatggcaggctcgcttattaaaaacccgggaggcggcctcgccaaaacaggcggctatatcaccggcaaggaaaaatgggtgaaagcctgctcctacagaatgacttcaccgggaattggcagtgaagccggtgcatcgttgtacacgctccaggagatgtatcagggctttttccttgcgccgcatgtcgtctcccaggcattaaaaggagcagtgttcacagcccgattcctcgaaaagctcggctttaggacgaatccttcatggggcagcaagcggaccgatttgatccagtctgtcgaattttccaccccggagcagatgatcgcgttttgccaggcgattcagtacgcttctccgatcaatgcccatgtgacgccgtatccgagctatatgccgggctatgaagacgatgtcattatggctgcaggcactttcgtacagggagcaagcattgaattatcagcggatggccctataagaccgccttatgtggcgtatgtccaaggcggattaacctactcccatgtgaaaaatgcgatatgcagtgctgtggatgcgctcatgaagcagggattaatgtaaagaaaataaagaatattttcatgtaaagaatccttacatcgagttgacacattatataacatcacatataataaatttatataagaaaaggaggaaattgagatgagtgataaaattcgccgctcaatgcccttatttccgataggtatcgtcatgcagctgactgaactgtccgcaaggcaaattcggtattatgaggaaaatggactggtatttcctgcaagaagcgaagggaacagacgtttattttcattccatgatgtagataagctgctcgaaattaaagatttgatcgaacaaggtgtaaacatggcggggatcaaacaaattttcgccaaaacagaaaacgaacaaaaagaagacaaacaagacaagccgaaaaaagcagagaagcacaacttgtcggatgaagaactgagaaaactgctgaaaaacgagctcatccaagcaggccgtttccaaagagggacgacattccgccagggagacatgtccaggttttttcattaatttgttagcaactgcattgctatatacatttaccttttagaggaggagttttacgaatggcaaagtatacaagagacgacattgttaaactagtaaatgaggagaatgtaaaatatattcgccttcagtttacagacattcttggaacgattaaaaacgttgaaattcctgtgagccagctggaaaaagcacttgataataaagtcatgttcgacggctcttcaatcgagggattcgtccgcattgaagaatccgatatgtacttataccctgacttagatacatttgtgattttcccatggaccgccgaaaaaggtaaagtagcccgcttcatctgcgatatttataatccggacggcacgccgtttgaaggtgatccgcgcaacaacttaaaacgcattttgaaagaaatggaagacatgggcttctcagatttcaatcttggaccagagccggaattcttcctgttcaagctagacgaaaaaggcgagcctacgcttgaactgaacgacaaaggcggatatttcgaccttgcgccgactgatcttggcgaaaactgccgccgcgacatcgtacttgagctcgaagaaatgggctttgaaatcgaagcgtctcaccacgaagttgcacctggacagcacgaaatcgacttcaaatacgccggagccatccgcgcttgcgatgacatccaaacgttcaagctcgttgttaaaacaatcgcgcgcaaacacggcctgcacgcaacattcatgccaaaaccgttgttcggcgtaaacggatcaggcatgcactgcaatctatcactcttccgaaacggcgccaacgccttctttgacaaagacgccgatcttcagctgagtgaaacggcaaagcaattcatcgccggcatcgtcaagcacgcaacaagctttacagctgtgacaaacccgactgtcaactcttacaagcgccttgttccaggctatgaagcaccttgctatgtggcatggagcgcgcaaaacagaagcccgttaatccgcatcccggcttcccgcggcatcagcacgcgcgtagaagtcagaagcgtagacccttctgcgaacccgtaccttgccttgagcgtacttcttgcagcaggacttgacggcatcaaaaacaagctggaagcaccggctccgatcgaccgcaacatctatgtcatgacaaaagaagagcgcctcgaaaacggaatcgtcgaccttcctgcgacactcgcagacgctctcgaagaattcaaatcaaacgaagtcatggtcaaagccctcggcgaccatctattcgaacacttcgtcgaagcaaaagaaatcgaatgggatatgttccgcacacaagtccatccttgggagcgcgagcagtatatgtctcagtattaatctaggaatcccttggcaccagcggtgtcaggggttttgaattttggtcaaaagaatgtaaggggtcttctttttggtctttgaccaaattatgaccaaaaaaatgtgaagttataatctaactccataattgcctcgtaatctttcattctattttggtcgctatttactgatatatttgatgtcagcacctgtatttcaagagcaataccacgtgaaaagcgtggtcagcttggaatgccgcggcaaaagtgacctaatgaactaaatactaggtggggtggacatgttatattagggtgaacaataagctgagggaggaaatatttgaatgcttgaattggataggaatataaacaaagtaaacggccttaaagaagagcacgcaaagggaatcctgaagattatttgcggaaaactggataatctaaaacacgcgggtgatcatatacagagaaagaatttgtcgaagatattcgatcgataattgagaactttccagaattagataataaagaagagaataatgaataaaaaatccttcttgcaagaaggattttttttataaccataccacaccgacgacatatacgatcgatatagttataaacaatttttaaaacgggaggttttgaaaaagcgaaatagtaataactaaagttgataaagagcccaaagatatcaaagatacaatttttcggttgttttgcttttttgaagatttacttagttcataaattaatgcaccccataaaagcatggatgccaaaataataatactcatatacgcataattctcctttttatggttaacattgtcatcaattttaccacatttaggattgagatgtcgatgaaataagcatctttatttcattttaactcttatagatttgatttcttcaggtctatttcattcttttactgaagaacaaaaccgtttattttcaacgcggacattatatttccttcgaagttctcactatgaacactggtattcacttactctctagtatagagttccttattgaaatgtctttattgcttttgttgtcgaaaatgaaatggaaaccttttatagccataacagaaagagactatgcaacaaaaaaggctaacaaaatgaggttgcaagctgcagcctttttagtttgaaaaaagtcagtacaaatggaaagaaatcatccaactcgctgctgtactttaaggtgacaagtgaattaagtgaaaggagagactgtacgtcaggtccaggaaacgttggctgttctgagagcaaggtattgacggctatacggccagaaagcggcgggaccgtctactggtggtatttacgggtctaagacaaaagattaaaaaaattagaaaagttaagtaatacaacaattttaacagaatgaagtatacgtagataaaaattttgaaagaaatctgttgagttgaattggtcttgaggaataaagagctgatttaagagggaaagaaacaataccgctgaaaaacaactattgacatatgtaagtaaatagaataaattattgattgtcaataaaaaacaacttattttatcataacacacaagttataaaaagtcaatgtttttttaaaaaaagatgcttttgaaaggaagagaggtttatgaacttatctcgttttttgaattccattcaattatccccacaatcaaaacctatgatggagctacttgaattaaatgaaaaaacaaaagagcatggcctgatcttaacacccagcgatataaaaatgttaatcgtttatagaaataaagtgcttcatgatcatggacgtatagaactggggattgaagtactaaaggaattaattgaggtgtttgctgcttcaccctatatggatgaggataattatgtcgaaacgttaatcgagcttcaggagattttttattatctcagaaatgaaacagaagataagataggggacatgaaactgattcatcagatgatggagtgttttaacgggccttctgccgggtctttagagatattaagaagtaaaatggaggaactcgcggagagtttcagaagagatacgatgagaagtgagtctttatataaaggtgatgaataacatggacaaagaaaacactttaaatcgctatgatttggtttcaaattttacgattgataaatcaaagttaaagcaaagccaatatatgttgtcgcttctaaaagaaggccaaagtgttggagttattaccagcgagaaagcatacaagatacaggtagagattatgcaaattctgcaacgattgataggccagtataccaaaggggaaagtatgtcggtgacaacggaaacggcggaagggattatggtttccctcatgtatgcaatagatgcttatgctctccattttgagaaacctgaagagtttatagtacatttacattctgatagtataaaaaatatatatacaaaaggtgtcgcattacttcactgttattttgaagaagctaaacaattatatcaagacgtaaaaaaaataaaattagatgtgcctgttgatgcttatactttaaccattgacgaatcgttacctgtatttatgaatcattataatgttatttttgaagctcaaaataccatggcgagcattgactatcctttagccattgacaacatggaactgcaaggtgttttttatattaaacagtatttagagcgactgctgatagaaacgagattctgtcacttttttaaccatcacgatttaatgtatgtcttggcaaactttggaagaatatgtcattttattatcgcatagaactttttaatattttttgagttaatgataacaatgctgttttttcactcctatccgggggcgaagccaatcaagtcagaatttctgaagttcaatatgacaggttaagtcgcttgttaagtgattgccatgctgataaaagggcaaacttaattaacaatgcatttgatcggttacagcgggatttaaagacggatcaaacaatttctgattatatcaatttgtatcgcaatgaatttattcaaagggtaaataacgctgcggaaattgatggcttcaaaatgttgatcatcagagaaattgaagagagagaaaaaccaatagcgttaatgttaaatgaaaatgatcgcatgagtgatattgaattgcggaaattggtggattgcatcatggaacgaaaaaacacagcagaaaaaatattgctgatccgcgatcattttgtttcactacatgattatttggatttgctaaattcggggtgtctgtttgacgacgaatatgacgcactttttgctacgtttgggaattttgaattggccatttttgcgaaaattgtattttatgaagaattaagagggggaattctcaatttcattgacattgttgctgactgctctgaagcaaagagcgagtgggaaacatattatatgaaatttattaaacaactagaagatgagcgcattgcaactattggacacctgatcaacgatattgactatgaggagatttcgttttattaagttaaagacgttattataagttcttttaaaaagaagagtctaaagaaagacgaagataaataacagcactcgattaaatgcaatctcatcccgctaaggaaagttttttcaatacaacttaaaagcttaaagtaactctactccaatttgcttagtgaattttacttttattctcttttcttctccaatacttataaccatgaaatcttcaactttcttaatgctagttatgttttgaaaaacacctgtaaatactaagaaatctttataggttatatccaggctacaagttagttgataaacatccagcgttaaaattaacttgaagttttgattatctttaaaagtataaatcaattcgccggcctctggatcatcagctatactgaccggctcgctctcaaaaagttccagtaaatcatattcattatattttataaacatccaactgactccttaaaattatagtgatattaatgaagttaaaaaaacgcagatctttaaagatttcgatcattactgtgcaataagaatttctgtttttcaatcgttgcaacttcaaaagctattcctctcggtattgttgtgtcacttgaggaaagaatcatgcatggaagtgaaaagaaggctgagtatttgttcaattctataaggaaatagcagtataatcaacacctctttaaagggaacaaaatgatgaatacatctactacgatggtcgtcctggtgaaatcaggctagagccgtccggtgcatccgaaaaaaactccggaaagagagggacacttaacaaagtatgaatagtgaaatagacaaatgtatattttgtgaaatagttagtcggaaaatttcaagttttgaggtttataaaactgactatgtgacagcatttcttgatataaatcctgttacaaatggccatacattaatcataccaaataagcatattgaaagactggatcatataaacgatccccatctatctaatgaaataatggattctttaattaaagttcctcaattattaattcagtcaggtatttgtgatgactacacgatactctcagacaacggtcactttgctcagcaagatattaaacacctgcattttcatgtcataccgagacatatgaatgaaaagtttgaattcaaattaaacaccgactttactgcagctaagaagagtaacttactttcgatatggaaaaagattgtagggagatgatgagaaaagatcgtaccagaactttaaaagtggaaagatgagttgatcttttgttttagtgcgggttttgctgaattcatcatttcggcctcagaaattcttccctttgttgtataatggtaaccatgattattaatcatggttgcaagggagtaaattatgttattaatagcttttgtattcgcgtattttatcaagcagccgatattaagttttgggacactttttcttttcatctacggatttagattttcttctaaaggcattaatgctgaaaaatgcgattattatattaatcaatatagacttatattttgcttcgtcatacctttccttaatttttatatgtattggtcaacgataggaggtaatgcaggattcgggtttacgtttagcccgcttaccctcatgcaaaagctgtctttcttgtcacaagttattttgatattcttaccagaaattcgcaaatttttatctcgaaaaaacttcattcatattgatgaaaagaagcaaaaattagcatcggttttgtatccaattgctttaatcctaacaatttgtatggcatattgttaaggatcttaagcaatggcctttactctacatgaaagttgcatccactatactttgaagggggctattgatgaatttcgatccggaaaaactaaggaaatttcttaattgcgcgtcaaacccgtcaagcccaaagaatacaaagattaaaaattactgtgtgaatcaagaatgccaggagtttgtagcctttgatattgattttgaaaatgtagacatcgctctgcgtattgccggcatgttggggaaatccgccacgaaatttacgataaatcattttcttttccctggtacgaacaaaatagattatattcaatttataatttttgaaattaatgattcagaactattagcatttttagagcaactataacagcattcttgtttgaatgcagttctctgggtgaaaataaagcagggatctcccccataagccgcagcaatcataattgtcttagatatttggtgttgcgaacagtccctttgcaagacagcttcgcgggttcatcaggctcagccgattagatggccaatggtctgtgtgaaaggccttggcagaactgccttcaaaaaaaaacaccattataccaatcaggagggcaaaaagtgttttttgcaaagatcatcgatcgtttagccttatatgatttgcacagaaaaagaagtaaagatgaacatttttccgctttttcattgaatccgattgacagagacgaattttataaagcaaaagcggctgatgtcgccattatgctttatgaatcaagaaaaaaccatttggccggacatttcagctatgaatctttaattccatccggggaccctgtcaacgatgctttaaaaggcgaggtttttttaaataaaaatgatatagatcagcctaatgttatttttgtgcacggctggcgaatggattcatacgacagaataaaaaagatatttcatgatcgtattatgaacgaattaggctggaacttgtattactattctcttccatatcattttgaaagagagccggaacattcgctttacagcggagaattgatgataagcgcgaatttgaatcgtacggttgattcgacgagacaagctatcgtcgatttacgggctcttattcattggatcaaagcaaataaaaacggccctgttattatagtgggcgtcagtttaggcgggtggatgacaaatttactggctacccttgagactcaaatcgacatagtggtatcgatattttatgctaatcgtctttcttatgcgatatggaataccatcccgggtaaattcataagagaagaattagaacagcacggtgtgacatatgaggatttaaaaacatattgggaaatcacagatcccagccaagctgcgccgaaaattaacaaagataacattttgctgatttccgccgtgcatgaccaatatgttcacttagaggatgctgataagttgtgggaaagctgggggaaacccgaaagacatctctacaactgcggccatgccggaattgttctttgtcgcaaaaaactggcattagatacaatttctttcatccgaaaaaaattaaagcagcttcataagtaatttcaatttattaataagcgggcaatttccagaatgctaaatcattatataggaggctttttatgtactttgtttccggatttgtttcagttttgcttggtctcgtcatgctatttaccttacggttgttatctgttgctattcctcatgttataactgatgcagctggcaatgatgaagcttcagcttattttcaatcctctgtattattttatcctgtgctgctgcttattttaggcgtagtcttgattatcgttcatttgcgaacaaatgataaggaaaaggattcattcaaaggcgagtaaaaaatggctaatccggaatattgggccaaagtgagcggagtggtgagacagtttgtttcgatctaaacataatatcccaaaagtgaaatttgattataagttcacatctgatgaatcagatatcccaatgaaaatgagaaaaggcccttcagtagcaatgagagtagagggagaacttgaaatcaaaataaatgaaattacatattttaaagaaaatatcgccttattggaattttatgtttctttaaatgagtggattaaaaagaacaagaaaaaaaacaaagttacggagtatagatattacacaatggagtatgaaaagggcgaacccattatttcattgataccatttgattataaggctcgactaacgaccatttgggaaactcaacaattatataatgtattcgaccttgattacatcaccgaacaaatggaaatttcacgcaaaaaacttggacgtgatattgaacatcattataggatttcattgaaaagctttgttggtaagatcccattaagaaaatattgatttatcctaaaggctaaaaacaccttatctgcgatgtgaaaatgaaatgcatattctaaaagaagcgggtatatcaatggctatgaacggagaatcacaacaccattgatatggaagcatccaaaaaaggagaataaaacaatgaacttttggcacaagcgctttcaagatgagaactatgtgtatggaactgaaccgaatgcgtttttggcagattcgcagaaaaaacttcaattgtcgggcgatgctttagccatcgcagaaggcgaggggcgcaatgcggtttttttagcagaacaagggatgaacgtcacttcatgggattatgccgaatctggactgaaaaagacgcaaaagcttgctgaaacccgtcatgtatcagtaaagacggagcttgttgatttaaatgaagcgtcttggaatcaagatcagtgggacgagattgtatgtatttttggacattttccagaagagctgcgccgaaaaacgcttctgggagtaaaaaaagccgtgaagcccgggggctttttcgtaacggaagtgtattcgacgcaccaaatcccttacaaaagcggcgggccgcaggatccagaacttttatatacaccggaagaatttttgcaaatcttttcagattggcgtactgtccacttttttatgggagaagtcgttcgtcatgaaggagattcgcacaacggcctgtcccacgtcattcaatttattgggcaaaagcaataaatactgcctgggaaatctgattttaaaaaggcgccgttcacggcgcttttttttgcgtaaccttttcaccctcattactactaatgtagtgaaagcgggggaaacgatgaaaaacaatattagactcaagcggctgctgatgatcagcgcaattttgcttttaatcgtcgggggatatgtcagtgcaatgatctttggaaagaaagtggtgtatgaaggaacgggagaaagcggtctgtggcatgcttcgattgagaaatcggataaaacgtcaatcgggcctaattattttttgaatttatattggaatggcacggaagaagatgcgaaaagaacgatcgtgaaaacaatcaccttatacatagatggcaaaaagtatgatgacagaggagaatacgatctttccgagtatacgggagaggaaatggatggcggaggccatatggaagatcatatcgcgacttttgattttatgcctgaagaggatgttatcgggcatgcattatcagttaaagtggaatggaaaaccggagatgaagaaaacgcggaaacaatgaaattaaacaagattccgtggtataaatgaaacgacgatcactgaatagggaagtgatttaaaatgaacgatattgagatcagaaggccgcgaattgacgacgttgaagagctgaatcagtttttcagaattgtggtcgaggataccttcgctaaagagggaatagccgatctgctcgatgataaagaaagtgaaattgaaagtaagaggcaatacttgaaagcagatttagacagcaaggggaatagccggcacttttttatcgcttcagatcaacgtctgaataaaatcatcggtactatcgaatatggccctgcaagcgaattgatcagcatttgtacggatggagctttaaaggatttatatgaggtaggaacggtatttgtccacccggattatcaaagacgcggaatcgggactttgctgttgaacgtcatgtttttgacttttttgaatcagggagtaaatgaattttgtttggacagcggctatcccggtgcccagagaatatggaagaagaaattcggcgagcctgactatgtgctgaaagattattgggggaagggatacgatcatatgatttggaggagacggacgaaggatatgccgattgatacaagaacatcagtcatgccgtaggtgctgcccatagagggatcacgaacaaaaccatcctttatattccatatatgtgttaaccataaaaagaacttttcttgaatttatttttaaataaattgttaaagttaaaaaagtcctataaactataatggaatcttaattttaggatgtgggagatatgttcaacgaaagagaagcgttgcgtttgagacttgaacagctaggtgatgcggagatccaggtgatgcgggaattgcgaaaagaacgagagggcatttattcgaagctgcgtgaattggatcgggagagtgagcctgcaattaacaaaaaatcttcattaatcgacttggcaagcgctgcagcagaggaattaaaacaatcccagcatgccgctgacaaacatccgcctatcaagaccccatctcatactattttccaatcaaaaacaaccatacagcgtgaggctgccataaacattttaagccgctatgaagagggcttgaaaggcattaagctcaaaactgaaatcgagaaagaaaccggctttccgattaaaaacatgacgacatttatgaagagcttaatgaaacatcgcccagatattaaaaagcctgcccgcggccattatattttgcataaagaaaaagacctttgaggttttcgtcattattccagattcatattgtcataaatcagagcggaatctttaaaaattgaaaccaaacagcacctatatcgtatatttagctaaaactaatgcaagggtgttctacatgttggataaaaagaaatacttcatgattatggtaccggctttaattttagggtttttatttcaattttttgttccctcagaacaaaggtacttggggattgtgtttattttagcaggcggggtgatttattatctttgggtgcatatcgaaaaggacaaacagaaagattgagctcatcctttgagttggaatccactaaaaaaacgtctgttaagacgtttttttagtgatatccattgttagccaacctgctgggcggcaaccgactgagccggtaaacaaatgctcaaacagccgtttctcccagattttatcgatcttttaactttaaggcgtaagctttgaactgttaagagctttgatgcttaagctttaaacgctgaacgctgagctttgagcttttatctcaatatgggcacagcgtctctttggctgtgctgatgatataaaaggagggagtaacctttccctcggaaggtgtttagtttgatcggttttcggttgactaacaatcggccgtcaatcgatggtgattttggtgagtgtattgctctcggacaatgcaaagtcaacttccatttcaaagtcctcgatcttttttgataagcaatcgatcttctcttttagattcagcggatcgatgatttttgcttcattttctgcgaggaaagatttgacgatttcctggttttcagccgcttttactttgccgtcttttccgaaaagtgtctcgagatgcttgtccagtctttccgttactttttgattgacgttctcggcttcgccgactaaatcagcgtacacttccttcagtttatccaaaagctgaatgtcgtagctgatagaggtttttctttcgatggcttcagctacggtcatcttgactccggccacttcgattttggtcgtcgcgttggatacaacaatggcagacttaatggcatttcgccttttgattaaggcttcgattgattggtaatcggctttcgctctggattccaagtcttcggttgtccgaaatccgtttggcagtttttttccgatcatcaagcctccgaatgtggcttcatttacggcccgcttgattcttttatccaacattttgagttcgcttagtgctctggtgatcgtaagttccattctatagcccctttgtgttttttatattgaaaaggtaaaatgcctttatttactcataagagtaatcattatatcatatttattttccaagtgttatattttgagtatatattttcatattgtataatagtccaaaaagattaatagaaatctataggaggtctaaccgtttgcgatttcattgttacgatgaacattgcatttcccttgaagcagaacagggagatcagcaaaaaatttaatatgctcgacaatgaggtctggtatcaaaatatcgccaaccgactgggaacctttcagtaaggcgctttatcgcgcaatcggatgctgaaaggatcttaaacggtcatgaagaaaccagtaagttccggattgaatgatgacaagagcttttagcaaaagaaaagctatgctgagtactttccttaattcctattgtttgtctttgttcgtttcactgcaaaacatacagcgaggacggctgcgataagggaggcagctccgcatgccagcttgatcagcggtttcaacaatatcaactccatctgtttcggtatatgtgtaaattataaaagggattcatatccaaagacagcttatgattaagattttaaagaaattttaaggaaataagtcctgtgccgaccggttgacaatgaaaagccgatcatctaaaatgaatgatagtcattcatttttagggaggtctgcatatgtcaaagcaaacgtccgggaaatatgaaaagattttgcaggcggccattgaagtcatttctgaaaaagggcttgataaggcgtcgatttcagatatcgtgaaaaaggcgggtactgcgcaaggcactttttatctttatttctcatccaaaaatgcgctgattccagcgatcgcggaaaatcttctgacacattctttggaccatattaagagcaaggtcgacggaaccatgtctttctggaccgccttggatatcatgatcgatgagacgttcaacatgacggaacttcatcaggatattatcgttctttgctactcaggtcttgcctttgaccattcgatggaaaaatgggaggcaatctatcagccttattattcctggcttgaaggacttattgaaaaagcagttgagaaaaacgaggtcattccggccattaatgtgcgctggacggcccgaacgattatcaactttgtcgaaaacacagcggaacgttattacatcggggcggaaaacgacgaagagctcagtgtgttcaaaaaagaaatatttacttttctgaagagaagcataggaaccaagtaaaaaatgaccggctgcagctgttcattttttatcggactaaaaaatgactgacgttcattcacaataggaagggtgttatcattgagttggctcctcgtaattgctgcgggttttttggaagtggtgtgggcctcaggtcttaaacatgcggattcattcgtcgattggctgatgatctttgtactgatcgcggtaagctttattatgctgatacgatcttacaggaacattccgatggcgtcggcttataccgtatttgtcgggatcggaacggccggcacatatgtgacgggtatttttatgggcgagaccttttcaggagggcaaatattctttttgatcgtgctgttgggaggcattattggcatgaagatgtttacaaaagagaacaatgcccagtcaggaggtgatgaatgatgccatggatgtttttagtgatttccggaatcgaagaggttattgccgccatcgctatgaaatatgtagacggcacaagaaaaaaatggccgattatcgtcatggtgttggggtttggcttgtcttttttctgcctttcaaaagcaatgcagatgctatcagccggtgttgcatatgccgtatggaccggaatcggcagcatcggcattacggcagtcagtttattttggtttaaggagcgtattcgtgctccgcagctcatctcgcttggctttattataatcggggtgatcggcctgcgccttacatcatcttaaattttaatttgcattggaggttgctgatatgattaatcagcttaaattgcgtccgcttgaaagagaagaccttccgtttgtccaccgtcttaacaacgatgcgaaaattatgtcatattggtttgaagaaccgtacgagacttttgttgagctgcaggatttatttgacaaacacattcacgaccaaagcgagcggcgctttatcatagagaaagagactgagatgatcggattggtagagctggtcgaaattgattatattcacaggcgggcggagtttcaaatcataattgatcccgagcatcaagggaacggttattcgtcaagcgcaacatatttggcaatgaactacgcattttccgtcttgaacttgcacaaattgtatttgatcgtcgacgaagataatgcaaaagcgattcacttgtataaaaaggcagggttcactatcgagagcgagctgcaggatgaatttttcgtcgacggctattatcgtaacgccattagaatgtgcatttttcaggatgagtttttatcacttaaaaaaagcaaagaggaaggcatgcagggataaataaaagagatggcggcgccatctcctgcatgcttttttaatttttcacacctaattgctctttggctttggcgggaatatcgtctttgtcaacctcttcccatgacttcacgcctttgttttcagaatagaaaagcctcaaaaacgcgcctatgcgaaggtttttatcagctgtgaattccattgttttttcttgaccgtcttcatcaaaaccggccagttcatatttgaagacggagtattcctcgccgtcgtcaaatttcgacgtgtcttcctccccgtttccagtaatgtgaacataatattcgtccgtccccacacggtttaagttacatccgcttaaaaatgcggcaaatatgatcatcaggctgatccatggaatatggtttttcactttttctcctcatttatgtttctgtctaaaatgataagattcattgtctgataaaaaaattgaataacgtgacatgaacattacacttttgtaagggatcgttttagcacacgcaggcaaattaaatttcaatatcctttttattcaataaagtttataatatggaaaaaaggaggggcgccaatgaaaaaaatcgtatgtttgatggtgttttcaatcatgacggccttcggtattcacatccagcctgctgaagctgcggttataaaagatgagaaaaagatgaccatgacaatgactgaagatcatgtgggattttttatggcggacagcaccaatgtaaattactacccgacatggctgtattacaagcttacgatttttaacgcggaaggctgcacactcaacatcaagctgcagagaatcacgttaacaggacatgcggtcactttaagcgagaaagagtatacgggaaatcatcttcatttaagtgctgcagataaagtgagcgggtcgccgcaccgaaatcatttcttggatatcacaaaagtgtcggggtgcggggatgttggaatcacaggtttttacggctttgagcaccaaatgccgggctactaattgatatagaaagcgcgggaggggacttttccagagtccttttttcatatcatcgcaaaaaatgctaaatatcaggagaaaaaacaaacgctgcttttattgagaggcgccatcctcttgctgctatgttctgcggctggttatgctctttatcagcatgttgccggaggccggaatgaacaggcaggcgccgtccttcatcagcaggcattacattttaaattatcgactttagagggcggtgacatcgaactgaaaaaatgacggggaaaggcggtgcttgtcaacttttggggggctttttgtacaccgtgcaaagaggagatgcccgtcatgcaaaaagcttatgaccgttttaaaggagacggttttgaaatcatcgctgtcaatgtgcgtgaatcgaaaggtgcggtaaagagctttgtcgaccgccatggcttaacttttccggtcgctttggatcaatcggctgaagtttaccgttcttgggaaatgtattatttgcctgcaagtatattcattaatcgggaagggagagcgtagcgaatgtatgtcggaggaatgtctgagcggcaagttgatatgtgggttgcagacattcttagcgattcatagaaactcattcaaaaggcatagacaaacacctattgttcttatcgttcataaggtagctcaggagaggagcgatcttatgttttttcatattaaagaactacagtatcacgcaaagcctgataaacccgatccattatttgcgaaaaagctgcaagagatacttggaggacagttcggggaaatatcagtagctctgcagtatcttttccaaggatggagtgtcaggggcaatggcaagtacaaagatctgctgatggatacaggagctgaagagcttgcccatatcgagatgctggcgacgatgatcgcaaggcttttggacggtgcgccggtcggtgatcttgaaaaagcggcaaaagatcctgtgatcggtgccattctgggagggatgaatccgcagcatgccatcgtatcaggattaggggcgatgccggccgacagtgtgggaaaccgctggaccgccgattatattatcgcaagcggaaatttgcttgccgactttcgggcaaatttaaacgcggaatcacaggggcgcctgcaggccgtccgcctttatgaagagacgacggaccgcggtgttaaagatatgctctcctggctgattgcaagggatacgatgcatcaaaaccagtggcttgcagccatcaaagaactggaagcgaaagaaaatgtcgtcgtcccaagtacgtttccgcgcaatctggaaaaaagggaagtctcccatgtattatttaatttttcaagaggcaacgagagcgctgcaggcagatgggcgaagggaccgagcatggatggagaaggcgtttttcagtatgttgagcatcctcagccccttgcgaaaaaaccggtgttaagacctgcgcctccatatattcatgatacgccgccatcagttattcaacatcaccgggatgatgtactgcctccgaatctttattgaaccgctttatttttcctatgatcatatttcgggcttgcagcgaatagccatattgaagaatggtatttaaagggaggcgcaagcttgaaaacttataaggaaacggccgttttcgaacataccttttggcttcaggttttaggtgatcatgcgcgttttattttggactctctcgccgaaagggaaaaaaacgatattcaaaaggcgaagcagttcaagcaagcgtttgatgttttgctgaaaaaagtgaacgcttcgcctgatttgtattcattaacgcttgaagctgaagaatatgctcttcagttcaggaaatttaaactcttcatcattaaaaggcacctgacaggcgatattaaaattcacctttctccaacttttatcaaccatatggtaaatgaactggaggaacatttgcttgtgctaaaatacttgaaaaagcgggaagcgccgcctgttttccacgagctgcaccaccatatgctgtggctgatggatgccgccggacatgccggcgcgattgccgatgacttggatgcggttgaaaaacgattgaaagaaaagagccgggagtttgtcaaacactttgaacagttctacattaaatccgttgaattgacgggatatctcagagcgaatgttgaatcttttcccgctctcagaaggatgaacaaagacgtgaagcttgagatcgaactgttccgtacatttttgaaagaagtggaggaattggagcttacagatcagatgctcggtacgttctccgcactgatggcagaccatatgatgagggaagaatgctattatttaatgaaaatcgccgaatcgacaaatacgcaagaacctgcgtgcgaccctgcaaaaccgaggctgcttgaaaagtaaagccggcggttttgctgtttttttgatgaagctgcgaatcgatttggcacctgcaagtttgcacagcctttttcatgcgattataattcagaatatatagaaaatctaaagactgtttggagggctttttcgtgcaagtcagaaaaataaaggattcagatgccaaaagctatctcaaactctgtgaaacgatcgatgaagaatctgaattcatgctgtttgaaccaggtgaacgaaagcttcacgcgcaacggcaaatcaaacagatcgaatccggaatgtgcgaagtttttgtttgtgcggctgacgacggaagcttaatcggatatgttgcagcagccaaggggcaggttcagagagctcgccaccgcgcccatgtggtgatcggcatacgccaagcgtatatcggacaaggtattggagtaaagctttttcaggcattggaaaaatgggcctgtgaagaaaagattcacagacttgaactgactgttatgactcataatacagctgccgttcgtttatacaaaaaaacgggctttatcattgaaggcactaaaaagcatgctttgaaagtaaaagggcaatatgttgatgaatatgtcatgtccaaattaatcaacgaacagcaaagggaggtttcaaatgaatgacgggtgccatcaggccattgctgctgtcagctattacaaaacagaacggacgattgattttaaccggcaaacttatacaaaaaagcagaatcaaatgtacttgtacaacgataaaattttaacagcaagccgccagtatcgtttggagcacgtctatgacgtttcatacagacctttttccgaggccggtttgctttacctccatacgaacaagggggtatttgcttatgaagtgaacgttgaccccgggtatttcattgaggcttttaaaaaacagaaaaatccaattaaataaattgcaatatatatgaagtttttagcagtaaatgctagaatgaatgttgggaattttgcaagggaaggaacataccggagcctgttagggcgattgaccttgttggcttaccgggcttatgccacttggcggtgtttatatgtcactgctatgcttgatggtagaacgtccgcttaggctgcaggtgtatgtttgagcaaagattttaagcggctttttccaattttctttcacataacaagtccttgacgttcccagtatatttaaatacatagacggtttaacttaattagagaagtagagaggacagacagcttaatgaaaaagaagacacagaatacggttcaaaagatcgtagaagccggatatcgtctgttcgcccaaaatggatattcggcaacctctgtagatgaaattatgaaagaagccggtttttctaaagctacgttttatttgtattttaagtcaaaggagatgctgtttctccatattatgaatgagcagatggaagatcgctttcagaccagcatgaattgttttcgaaaaaagacgctgaggggattgctcgcggggattgaacacttgattcaaacatcaaataaagagcattcgacagctttatttttggaatttatggcaaatagtcatagatatcctgagattcaaagaaaggtagcccttctgtatgagcagtggagggagttttttgtcgaaatgattgagcagctgcaggaagaaggcattgttcagaaacagctccatccgaaggtgatggcgtctacgctgattgccatctttaacggctacaaccatcaacaccacgcggatccgtcgattaataaacaggaacagcttcagtccattattttcttgctgaatccgaagctgcatctttagataaaagacaagctatgaatacatcataagacttttgaaacagccggcgctgccgaccttgagtcggcggttttttgcgtcagatgaatccacttcggtacgccgcacaacaaagcaaatcacatgcaaccgtttaacatcgagcgtttatttcttttaaatagttgacacaagcaaatcgttattatacaattatctcgaattcgagataattaaaaaggatgaatgccatgggcagtcaagatatggagagatatgaagaggagttgtctttaaaggcatttattgtcttgtctcgagcattacaatcgattaaaaagcgtgtggaagaagacattaaatgtttaggattaaatccaactgagtttgctgttttagaattaatctataataaaggcgatcagccgatacaaaaaataggcgaaaaggtattaatcgcaagcagcagtattacctatgttatagataagctggagaagaaaagtttaatagtaagaaggccttgtcctaaagatcgccgtataacatacgctgccttaacgaatgaaggaactgcactgatgaacaatctttttcctaaacataaagcagctatgaaaggcattttcggcgggctggacattaaagaaaaagaagttctaattgaaaagttgaaaaaactgggcttccatgcccaaagcatgtaaatttttttacgacaatatctcgaattcgaaatatacgaattcataataaatgtcgattgcgaggtagtagtaatgaccgaatttctagagttagtaaaagaaagacgatcagcaagtaattttcttcctggatattcaatttctgaacaggagcttaatgaaatatttgaaattgtaaaattggctccctctgcttttaatttgcagcatacaaactatattgcggtgttggataaagaaaagaagaacatgttgcatgaagcagctaatggccaatacaagatcctaagctcgtcggcagtcatcatcgttttgggtgacaaaaaggcctttcatcaagcaaaagaaatctacgaaggtttaaaactgctcggagtacttaataaacaagaatatgatgatatggttcacgatacggtttctttctatcaatccagaggagaagcatttcaaagggatgaagccatcaggaatggctcattatcttctatgctctttatgatggctgctaaagaaaaaggttgggatacttgtcccatgattggctttgatcctcaaaaggtaaaagaggtattgaatataaatgagcaatatgaggtcgtcatgatgatcacccttgggaaggaaaaattagaaagcagaaaaccgcggggatttagaaaacctgtaaatgaatttgtaacctatatctcttaataaagctatgtttcatgaaagaggagtgaaatgatatgaaaaagaaaacaagcggaatccatcacattaccgcgattgtcggccatccgcaagagaatgtcgatttttacgctggcgttctaggtttacgtttagtgaaaaaaactgttaattttgatgatccgggaacataccacctgtatttcggtaatgaaggcggaaaaccgggaacgattattacattctttccatgggtgggtgctcgccgaggagtcattggagatggccaggtgggagttacttcatacgtcgttcctaaaggcgcaatggcattttgggaaaacagattggcaaaatttaatttgccttatacaaaaatgaaccgttttggagaggagtacttagagttcgatgatcctcatggacttcatctggaaattgtcgaaagagaagaaggggaaaagaacagctggaagataggagaaattacaccggacaaagcaatcaaaggatttggcggagcaacacttttatccaaacaaccggaaaaaacggctgaattattagaaaaggttatgggacttgaaaaagttggtgaagaaggagattttgtacgttttcgttcttctggtgatatcgggaatataattgatttgaaattaacaactataggcagcggacaaatggggattggtacagttcaccatattgcctggagagctattgatgacaatgatcaattagaatggcaaaaatatgttgcagaaaatggttatcgtgttacacccgtgcaagacagaaattattttaacgcgatttattttagagaacacggggagattttatttgaaattgcaacagatcctccagggttcgcccatgatgaatcacatcaaacaatgggagaacagttaatgttgccggctcagtatgaacactacagagagcagttagaaagaagattaattcctataacagtgaaggcgctggattaatttttgcacggaagtgattcaatgctgtccattgatccgcttacaaaaacggaaagagagaactacaagtttttaatcgggagtatcataccaagacccgtggcgtttgttacaagcctgtcagaggagggcgtcttaaacggagctccatttagttattttaatattgtatcttcaaatcctcccatgatctccctgtccatacaacgttctgaagggagccaaaaagatacagcgagaaacattctgaagagcaaagaatttgtggtccatatcgttgatgaacaaaatgttgaaaaagtgaatgcaacggccgcgagcctacctccaagtcaaagtgaaattcagttagcggagttaaccccggttgaaagtgtgaaagtctcggtaccgggggttaaagaagcgaaagtgcgcatggaatgtgttctggagtattcattagagttgggagataaacactctcccggctgcgatttcatgataggtcaagtcgttcaatatcatatcgagagcggcatttatgaaaatggaaaaattgatccgagaggcctcggagccatcagccgattggccgggcatgattacgcaaagattggtgaaatctttaccagggaaagaccgaagtaatataaccatccacgatatctcgaagttgagatttattaaactgaaatgttttaagcttattgtagcaaggaataataaaggcagcgaaacactttcaagggggtggtttttaaaaggtttaaaaaaagaaaacaaaaaagcgggtgtaaaatatgggatttttaagacaaattatttagaaaatcaaaggagatggatcatatgtcaaatgtgaaattagctgtagttttttatagtatgggcggaacaaactatcaattagcaaaatgggctgcagaaggcgcaaaagaagcaggcgctgacgtcaaagtattaaaagtacaagaattggctccgcaatcagttattgaaggaaatgaagtatggaaagcaactgttgatgcaacaaaagacattccagtcgtaacctcagaagatatagagtgggcagacgctattatattcagtacaccaacgcgttttggcaatatggcatcccaaatgaaacagtttcttgatacacaaggcggactttgggcaaacggcaagacagttaataaagttgtaagtgcaatgtcctccgctcaaaatccacatggtggtcaagaagcgacgatcttgtccttatatacttcaatgatgcactggggagctattattgcttctcctggatacactgatcctgtcctatttggggctggcggaaatccatatggaacgagtgttacagtcgatcaagacgggaagatgattgaagacgtagaagccgcagtgaaacatcaagcaaaacgaacggtgaccgtagctgaatgggtcaaaaagggcaatcagtaatatttgaaatttaaaagagccaaatgactggctctttttttagttggttcagttgagccgtttttcttatttgatgtcttcatttgactgcgaacacgccataattgcgcggcataaggaataagatatccgacatatcctataacgatgcccgtgcaggaggaatccgtcttttaagttgatgatttcacaatgataaaatttttttctattaaattttaaaaaaatgaaactttaagttcatatgaacgtaaacataagtgaaatgattttatttagtcatacgatcaatcaacaaatgcaaaaggggtgaaacaaaagtgaaagtcatgattggttcgatcatattgctgctcattatagggtttggcgtatggcttatgttgagcccgctttttaaaaaagtcggaagcggggcgaccaaaataaagaaaacgctggaggacgacaaagatgaatgaaaaacaaccaaagaaaaataaaaacaaaacgctgctcggcggaatcattgtcgctgccgctttaattattggaggattcacggcctccctgttcatcgagaaaatcccgaacggatatgtcggcgtcgtttattccccgaatggcggggtaaaatcggaaacgctggatcaaggctggcatttagtcgggctgtttgacaaagtcacaagatatccggtacggatgcagactgtaaacaatcaggatattcaagtggctacttccgacggcaaaaacatctcaatggacattgcctacaactatgtcgttcagcctgataaagtcgtagaattgtttaataaattcggagcggtcgatattgaatcaatcgaaaacagctacttgaaaacaaggctgtgggacgctgcgagaaagtcgatttccaaatattccgtcattgatacatacggacaaaaatcatctgatgccgctgcagaaattcaaaaaacatttgcagatgatatgaaggggctcggctttgtcattgacgatttaacactcggcgtgccgaagcctgataaagcgactcaggaagcgattgacgcgcgcgtgaagtcttcgcaggaactggaaagaacacagacggagctgaagatcgccgaagcggaagcgaaaaagaaaaagatcgaagcccaaggtattgccgagtacaacgaaattattaaaaagtcgatgtcggatgaaatgatcaagtatcaatggatccaaaaatgggacggaaaaatgcctaaagcgaccggatcgaattccctgatccagattccgaccgatgagaaaggaaaataaaacgaaaaaaatcccttgccaagggatttttttcgtctcgggcgcacgtatataatggtgttaacaatcgtttctgagacagggggtaagatgttgtttgctccggaagccattctccgtacgtggagaaaatttgactcttttccgatggaaacgctgacaaaagcatggttttatcatcaggcaggagatgggagacagcgggaagtatcgatgatgaaggagcactatcaagagtacgggattgccggcaattgttttgacctttcgatttggctgctggatgagttcacaaaagacggagtggaagcttttccaatcggccgttcgttcaaaacggaacgcgcgcatgccgcagtcatcgcccttgatgaaagaggccggcgctttttgtgtgatctgggagaccaatggctgcatccgattctgatcgattgcgaatctgaagattataccaatgaaaagctgggcggttttttccctgccgcacaagttcaagtcatgccgacagccggcggagttgaggtcctttaccatcggccgaacggaaaggtgtcgactcaagtctacaatacagaccctgttgacatgtccgtttttttaaaggcggctgaatactcgcaggcggcattgaagcctgcgcctttactggaatgcagaattccgtttcagcatgaaatcgcccattgggaattcagcggctgggacatatatcttagtacgagcaaaggattatacagagaagcgaagccggacacaatcgaaggatggactgaaaaaatccacgatatctcaggatacgataaaaatgttctcaagaaagcattggagatttatcaaacccgcgcgtgatcttaaaccttgaaaaaaactcattttatacatatcatgtggaaagaggagaggataagatgagccattatgaccagcaatacaatgcaatcatacaaaaaattattgaatcagggatctccgatgaagaatatcaggttcggacgaagtgggattcagacggaacgccggctcatacgctgagcatcatgagcgaaaaaatgcggtttgacaattcagaagtgccgattttgacgacgaagaaggtggcgtggaaaacggccattaaagagctgctttggatttggcagctgaaatccaatgatgttcaagttctgaatgatatgggggttcatatttgggatcaatggcgtcttgaagacggcacaatcggagcagcgtacggctatcaattagggaagaaaaacagaacggttaacggccagaaagtcgatcaagtggattatttgcttcatcagttaaagcataacccttcttcacgcaggcatttgaccatgctgtggaatcccgatgatttggatggcatggctttgacaccctgcgtctatgagacgcaatggtatgtgaaagaaggaaagctctctttagaagtaagagcgagaagcaacgacatggcgcttggcaacccgttcaatgtgtttcaatataatgtcttgcagcgcatgatcgcgcaagtcctcggttatgagctgggcgaatacatcttcaacatcggtgactgccacatctatacccgtcacatcgacaatttaaacattcagatgaaacgcgagcagtatgaagcgccaaagctatggatcaacccggatatcaaaaatttttatgactttacaatcgatgattttaaattaatcgactataagcacggcgacaagctgacatttgaagttgccgtatgaacaggcggatttcccgcctgtttttttgtacagtgatgaaaaacggccttggaggatgattcaagaagatacagacatataatacggcaagacaggcacaagggctgtcgatatggagctgtttgcgggaattcattaaaacacgcggctgaagttatgtttttaccaacgatatcaacggttcatgttctgatgcaaaagcgatgacgtgcagcatcttaaaaaataacgtcatagaagaataaacgttcatttacacaatctaaacgtctttttcacaaagaacccgaaaagcaaaaacaattctctcttaatctgttagtaacaccagcatatacaagaggaggttgtttttgtcatgatcaaaaaatgggcggttcatctgctgttttccgcattggtactgcttgggctttcgggaggcgccgcatattctcctcagcatgccgaaggtgctgcaaggtatgacgacatattgtattttccggcatcacgctatcccgaaaccggcgctcatatcagcgacgcaatcaaagcagggcattcagatgtctgcacgattgaaagatcgggagcggataagcgccgccaggaatcactgaaggggattccgactaagccgggctttgaccgtgacgaatggccgatggccatgtgtgaagaagggggcaaaggagcgtctgtcagatatgtcagctcatcggataaccgcggagccggctcctgggtcgggaacaggctgagcggtttcgccgacgggacgagaattttgtttatcgttcaataaaaggcgaaaaacaaatatctttcctttgggaaacatttttgttgacaggaaaatcgttgtgggggataatggtaatgtaagcatattatcattccctctgtttcaggttcgcatccttcattgccgaatggatgtgagcctgttttttcgtgcaaaaaaaccgccgaccggcggttttgctgatgagtccgtgttttaatgaacagtgcgaaaaacgccgatgacttttccgagaatcgtcacattctgaaggatgatcggctccatcgtcgggttttccggctgaaggcggatatgggtttcctccttgaaaaaccgcttaacagtcgcttcgtcgtcttcggtcatcgcaacgacgatatccccgttgtttgcggtgttctgctgcttgacaatcacataatcttgatcaagaattccggcatcgatcatgctttctcccatgatctccagcatgaagacgtgctcatccggcggcgccaggcgttcgggaagcggaaagtattcctcgatgttttcgactgcggtaatcggtgtaccggcggtcacctttccgatgaccgggacattgacaacctggtttttcggaatatgaatttcctcctctgtatcgagaatttcgatcgctctcggcttcgtcggatcccttctgatcaatcccttcgtttcaagccttgccaagtggccgtgtaccgttgaacttgacgccaggccgaccgcttctccgatctccctgacggaaggcggatagcctttgcgcttcacttcttctttaatgaaacgcaaaatatcaagttgtctttttgatagcttcgtcattttttgcacctcaaaacgtcgattttagctagattatagcatgtttttcctctgagtacaaacataggttcgaaaaaaacgattgacagaaacatttgttcgtatgtatactgaagtcacaaaaaccgaacaaacattctggggtgatggatatgaaaaaagaatcattgatttttgtcagtctgtttactgctgtgatcagctgctgtattctgtttgtgtcttttgccggtaagatcgaagaaagaaagcaatatgttaaaatagaagtgcaagaaggcgatacattgtgggagctggccgaccggatcaaaggcggaaaaaccgctgacaaacacaaattcatcgaatgggtcgccgataaaaacaatctgccgacctctgtcattaaaccgggagatgtcttgatcctgccggtagccaaacagcactccgatcaatatcagcttgcagttgtagaataagagattgaggggatttccatgaatgcgattatttacaccagggtaagcactgcgaaggagcagcaggaaacctcattaaagcggcaggaggaagagcttaagtcgcttgccgccgaacacgggatgaacgtcgtgagcgtcatttccgagcaggcgagcggatatgaaatggaccgcgacggcgtcttcgatctgctcgaggaaatcaaaacatcagacatcgacgcggttttaatacaggatgatacgcggcttggaagagggaatgccaaaattgcccttcttcactgtttatataaagaaggcgttcaaatctacacgctggctcaccgcggaaagctcgagctttccgaagcggactcgatggttttggagattgtcggcattgtcgaggaataccagcggaaaatacataacctgaaaattaagcggggaatgaagaaggcggtcgaaaacggctaccgcccggagaggaacctaaaacaccgcaatgaaggcggcgggagagagcgaatcgaagcgcctctttcagaaatcgtcaggctcagggagaacaagctgacgtttgcggagattgcagccgtgttgagaggcttcggatacagcatatcaaaagcaaccgttcaccgccgctaccaggagtataaggacggccttgcagactaatctgttgtcaaacgaaagcggatttagtagtatgatggatatataccgaatcaaaggagtatcttatgatttctaaagaaaaaatagccagaattaacgagcttgccaaaaaagcaaagagcggatctttaacagacgaagaaaaagcagaacagcagaagcttcgccaggaataccttcaaggcgtccgcgcgtctatgaaaaacacgttgaaaactgtgacgattgttgaccctgaaggtaatgatgtgactcctgaaaagctcaaacaggaaaaaagaaaccgccgattgcattaattttagggaatacgccgatatcgtattccctttttgtatatactacaatttagaatgaaggcaaagattcgtcatttttcgcccagcttttgagctgaaatggttgtgaaaaccgatgggtagatttatgataagaaagtagagtccatacaggaaggggatcataatgaaaacgattgaattaaaatctgtcgcaacaatacgaacactctccatagacgcgattgaaaaagctaaatccggtcaccccggcatgccgatggggactgctccgatggcttatgcgctttggacaaaaatgatgaatgtcagccctgaaaatccgaattggtttaacagggaccgttttgtgctttccgccggacacggatcaatgcttttgtacagcatgcttcacttaagcggatatgacgtttcaattgaagacctcaaaaatttccgccaatggggaagcaaaactcctgggcatccggaattcggacatactccgggtgtagatgcgactacaggtccgcttggccaaggaatcggaatggctgtcggaatggcgcttgctgaacgtcaccttgctgaaacttacaaccgtgacgactatcgcgtcgttgaccattatacatacagcatttgcggtgacggagacttgatggagggaatttcatccgaagcggcttcgcttgcgggacatttgaacctcggccgtctcatcgtgctttatgattcaaatgacatttcgcttgacggcgaactaaaccgctcattctctgaaaatgtaaagcagcgctttgaagcgatgaattgggaagtgctttatgttgaagacggcaacaacattgccgaaattacggcggccatcgagaaagcgaaacaaaatgaaaagcagccgacattaattgaagtgaaaacaacgatcggtttcggttctccaaaccgtgcgggcacatccggcgtccacggcgctccgctcggatcagaagaggcgaaattaacgaaggaagcgtatgagtggacatacgaagaagatttttatgttccttccgaagtgtacgagcactttaacgaaacagtgaaggaagcgggcaagaaaaaagaggcggaatggaacgaactgttctccgcatacaagaaagcccacccggaacttgccgaagagcttgaactggcgatcaaaggcgagcttcctgaaggatgggatcagaaagtacctgtatatgaaaaaggaagcagccttgcttcacgtgcatcctcaggtgaagtgttaaacggaatcgctcaacaagtgccgtttttctttggcggatccgcggacttggccggttccaacaaaacgacaatcaaaaacggcggagatgtttcagcgaaggattacgccggcagaaatatctggttcggtgtaagggaatttgcgatgggagcagctttgaacggaatggctcttcacggaggcctccgcgtattcggcggaacgttcttcgttttctccgattacttgagaccagcgattcgtcttgctgcattgatggggcttcctgtcacctatgtatttacacatgacagcattgccgtcggtgaagacggaccgactcatgagccgattgaacagctggcatcacttcgtgcgctgccgaacttgtccgtcatcagacctgccgacggaaatgaaacagcagctgcctggaagctcgcgcttcaatcaaaagaccagccgactgcgcttgtgttgacacgccaaaacttgccgacaatcgatcagtctgctgaaacggcttatgaaggcgttaaaaagggtgcatatgtcgtttcaaaaagccaaaacgaaaaaccggaagcgatcttgcttgcgagcggatctgaagttggccttgcgcttgatgcacaaagcgagctgcaaaaagaaggcattgacgtatccgttgtcagcgttccgtcatgggatcgatttgacaagcagccggctgaatataaaaacgctgttcttccaactgatgtgacaaagcgtctcgcaattgaaatgggatcgccgctcggatgggagagatatacaggcactgacggggacattctcggaatcgaccagttcggtgcatcagctcctggcgaaacgatcatgaaagaatacggttttacgcctgcgaatgtagttgaccgggtgaaaaaactgttaaatcgctaatcgggcatatgaaagagaatgatctgcggatcattctctttttttcgtttcgacaaaattagtcgcttcttttatcatcatcagacaattatttctaacccccttttgtataatagaaaacatatatctttcgaaacagggggatgagacagggatggaacgccattattatacgtatttgatagaagaggaatttgccagccattattttggaagagagtccgtcatgttcaaactgttttacgattatcattggacgagccccgatcaaaagtctcaattagccgcgaaacagatcgagtttattacaaaaccgattcccgctgctcatatacacaaaagaatgaaaatgaacctctgccgggaagactatacacaggttgactatgtatacagattgattgttccaaaaggaagcgcttcttttattatcaaagaccgtcatattgagattttggcaaagggtccattcgatgccgaaacggttttctttgaggtattgcgaaaagtcagtccgtgttttcttgcgatggattttaatatgaaacgttatggctggctgaaccctgtgaaagaaagaaattttgtataaaaaaaagaatttggactgtaaatgttgtataatagcgtttggtttagtacactttatacgagacaacatgaaggaggaaattaaatggatttgtgggttgtcatcctagtgggcgttttagcattgctcgcaggtgttgcactcggattttttattgctcgtaaatatatgatgaactatttgaaaaaaaatccgccaattaatgaacaaatgctgcgcatgatgatgatgcagatgggtatgaaaccatcccagaagaaaattaatcaaatgatgaaagccatggaaaatcaaacgaaataatgcgaatgcgattatgacatagaaggaacatggttataaaataaaaaacccgcttccgggttttttattttgatctatgattattgtgtatttccgagagatagtttttggtattccaagagaaggatatccagctgctggctgtgctgaatggtgatatgtgaagtcatgccgtttgtcatgacgatttttagcagctcttttcttttttcctcaatttcatgaagcagattttctttcatcacaggaatttatcctttcttctgtaaaaatcatctttttgttgcctactaaatgctattatatccatatataggtttcttttcaattctgaaggtgataagggtaaattgtcaaaattgattatataaagaaattcgtgaaatcaacatccttttttgtgatatgttaggaaattgaaatgtaattgtcatatcaaatgattttctttcatggtattccaaaaaatagaagggagaaagagatggctgatatcaattatattctcgctttcggtgcagggtttctatcgtttatttcgccatgctgcctgccgctttatcccgcttttttatcatatattaccggtgtcagcatgagtgaaatccattctgacaaacttatgtttcaaaaaaggagcttggtacatacggtctttttcctgatcggcttttcgatgatctttgtggcactcggctacagcacgtcgcttgtcgggtcgttttttaaggattatcatcagctcatcaggcagcttggtgcggtttttatcatctttttcggatttgtcactttgggggtttttaagcctgaatttttaatgaaagaaaggcgcctccaatttaaaaacaggcctggaggtctgctcggttccatcggaatcggaatggcatttgccgccggctggacgccctgcaccggcccgattcttgcagcggttattgcactcgccggaacgaacccgatgtcggccgtgccttatatggcgctttatgcactcggattcagcttgccgtttctgcttctgtcttttttcattacaaagatgaaatggcttcggaagcatcagctcatcatcatgaagatcggcggagttgcaatgattgtagtcggcatcctgctgttctttgactggatgacgaaaatcattatcgtattgtcaagcctgttcggcgatttcagaggcttttaaactttgctaaggaccgccttggttttttgttacaataggacttattcacagcaaaactgaataatgatgttggaggggagtatgacaagggttttaattgttgatgatgcaaaatttatgagagataaaattagagaaatacttgaaacagaagacttgcaagtcgcgggtgaagccgagaacggggaagaagctgttttgctttatcaagagctgcagccggacttggttatcatggatattacgatgcctgtgaaaaacgggatagaagctttaaaggatatgatccagctgaacccgaaagtgaaagtgatcatgtgtacggccatgcggcaaaagcggatcgtcgttgaggcgatcgaagccggagccaaggacttcatcgtcaagcctttcgaggaaacgaaagtcgtcgaagcgattcggcatgtgctcggaaatgcttgcagctgataaacgtgaacatggtttttttcttcgttttagagtatagtaacaagtagagaaattagctttagaaaaagggatgatatgtatgatgatcgtcgtttcatctatacttgctatcgtgatggccgtcattgtcatggctgtcagaatcaagtcatctgaaaaaccggctacggccaaaaaaattatactgcctccgatttttatgagcaccggtgctctcatgtttttatttccggtgttccacgtaaccggtgctgaatttttggaagctctcaccgtgggcatgatcttttctattttcttaattaaaacctcaaaatttgaaatccgcgatgataaaatctatattaaacggtccaaatcgtttgtgtttattttaattgcgctgctcgtcatccggatcgtgatgaagagcatattaagcacaacgatcgattacggcgcactgagcggaatgttttggattctggctttcgggatgatcgttccttggcggattgccatgtatttatcgtttagaaagctttcaagccagattgaagcgtcaaatcacatacaggtcaattaaaacaaaacctttcctgaaagaaggaaaggttttgtttatttaaaaagctcttgatatgtagagtgatcaatgttcttttcttttaaacgtttcacgaggaacttatggtctcttttcggtgtggccataatatagcctctgatgattaaatcccggtcgatggcgcctgctttttctttcaatgcaagctccccgatcttaccggcgatttttgcttttgctacatcgcgaaacagctcgggtacgggtgaaaccaattcctcaagcagttctttttcttcgtcattccacaaatgccttgtctgttcaatataataatcctgccagtccagctcagatttcccatcttctttaggcagcctttttaaaaatttgcgaaacatgaaaaaaccgccgattgacaagaggacgatcatgatgacgatccaagcgagcatcagccataaaaaccatccttccagcatctctcatcactcctttgtctataacctattttacatgaaggcgttttagaagaacatagaaaaaataatataaaatgggacaccggcctggtcaaaagagatgctagaacataatctattgtatagcgattccctaatcggccatagagaattgctagaggatatttgacgaacgaacggaaaaaaacccggatggcaagtgttttaagcgctgtccgggttctgcttgttgtgcaggtttgatataaaaggaatattgattgaaagcgaaatgtcatctttgcttgattctttattgattttaactgcaagaatgttgttttcgcattccgcttcgatctgtttgtcattcaaaaagaaaggaagcatcagcgatttctcgtaaagctgctcatcggttttaactgcaagcttgaaatcgtagcctgaaaacgtcaagtcaagatgccggacattcaagtggcttaaatctgcttcaattatatattcagtgctcgtttcataaaggtcaatcggtaaagtttcatcatagaggagaaaagggtcgtcaacaaactgtttcatccattctttatcaaaatctgcggaatcgaaacgttttgtatttgtcattggagcattcctccatacctagccttaccattagattatgcacacctttgaattcatgtgaaggagggtggacaacgcctcagggtgacgcgcggtaaggaaaaaaaccgcgccgtgaaaggcgcggaaaaaatgttacatatcgtgactggaattgtgtttttgtcttgtatggttccggttttttacttttttgcttccgctcaaaggctctggctgccccggctgagctcctttcggtgcgtttttgcgcatatctttgccgtcgtttttatttgtcaatgttttaacctcctaagatattcatgaaggatctttcgtatttattgattggttttccgttttttgttgttttggcgttccgcctcagtgagtatgtgctgatcattttcaatatatcccgcgccgtttccttggcgtttcgcattgttcattccatttattacatgatttgcttttcgtttggccaatttcaatcacctcagactgtagtatagccttagcgggtgtattgtataaaaaaatgtatttccagtaaaataaacttttttccgtatataagtcattcttattgaatttaataaaaacattgatatttacttatgtttaaaattgttttaagattaaattgtgagaaaattgtggtgaaatatgccgatttttctggcgtatgatcttgatctttaaagggggattttggagaaatggcgaatcagcaacaaatcgcaaaaaaagacgcttttcaatcaagaaaaacgtttacagtacaaggcaaaacgtacagctattattctttaaaagcattagaggatcaaggaatcggaaacgtatcaaaacttccttattccattaaagttttgctcgaatccgttcttcgtcaagtagacgggagagtcattactgaggaacacgttgaaaacttggccaaatggggcactgccgaattaaaagatattgacgttcctttccaaccatcccgcgttattttgcaggactttaccggcgttccagccgttgtagaccttgcttcattaagaaaagcgatggcttcagtcggcggagatccggataaaatcaatcctgaaataccggtagaccttgtcatcgaccactccgtacaagttgacaaagcgggtacggaagatgcattgaccgttaatatggaccttgaattccaacgaaatgcagagcgttacaaatttttaagctgggctaagaaagcgtttaataactatcaagctgttccccctgctacaggtattgttcaccaggtgaaccttgagtatttggcaaacgttgtccatgcagtggaagaagacggcgagattgtcacttatcctgacacgcttgtcggtactgactcccatacaacgatgatcaacggaatcggcgttctcggctggggcgtcggcggaattgaagctgaagcaggcatgctcggccagccttcatatttccctgtacctgaagtaatcggtgcgaagcttgtcggaaagctgccgaacggtacgacagcgacggaccttgcgcttaaagtgacacaggtgctgcgtgaaaaaggcgtagtcggaaagttcgtcgaattcttcggtccgggtgttgcggaactaccgcttgcagaccgtgcgacaatcgcaaatatggctcctgaatacggcgcgacttgcggtttcttccctgttgatgaggaagcattggaatacatgcgtttaacaggccgtgatgaagaacatatcaatgtggtgaaagaatattgccgtcaaaacggactgttctacacgcctgatcaggaagatcctgtatttaccgatatcgttgaaatcgacttgtcaaaagttgaagcgaacctttcaggtccgaagcgtcctcaggatctcattccgctgactgacatgaaagaaacgttccacaagcatttggcaagccctgcgggcaaccagggattcggtttaaacgcgagcgaggctgacaaagaaatcaaatttaagcttgaaaacggcgaagaagccgtcatgaaaacgggtgcgatcgcaattgcggcgattaccagctgtacaaatacatcaaacccttatgtcttaatcggtgcgggcctcgtcgccaaaaaagcggttgaactgggattgaaagtaccgaactatgtgaaaacatctctcgctccgggttcaaaagtcgtaacaggctacttggttaattcaggcctgctgccgtatatgcgcgagcttggatttaacatcgtcggctacggctgtacgacatgtatcgggaactccggaccgcttgcgcctgaaatcgaaaaagcggttgccgaaaacgacctgctgattacgtctgtcctttccggtaaccgtaactttgaaggccggattcatccgcttgtcaaaggaaactacttggcgtctccgcctctagtcgtggcctatgcattggcaggtacggtagatatcgacctgaaaaacgaaccgatcggcgtcggcaaagacggtcaaaatgtgtacttcaacgatatttggccgacgatggacgaaatcaattccgtcgtgaagcaaaccgttactcctgagctgttcagaaaagaatacgagcgcgtgtttgatgacaatgaacgctggaatgcgattgaaacaacggatgaagccctgtataaatgggatgaagagtccacttacattcagaacccgccattctttgaaaacatgtcagttgagccaggtacagttgaaccgcttaaaggcttgcgcattgtcggcaaattcggagactctgtcacgacagaccatatctctcctgcgggagcgatcggcaaagacacgccggccggaaaatatttgcaggaaaaaggcgtttctcctagagacttcaactcatatggttcaagacgcggaaaccatgaagtcatgatgaggggaacattcgccaacatcagaatcaaaaaccagatcgctccgggcactgaaggcggttatacaacgtattggccgaccggagaagtgatgtccatttatgatgcctgcatgaagtataaagaagacggcacaggtctggtcgtcattgccggaaaagactacggaatgggttcttcccgcgactgggcggcaaaaggaacaaatctgctcggcatcaaaaccgtcattgcagaaagctttgaaagaattcacagaagcaaccttgtgctgatgggcgttcttccgctgcaatttaaagagggagaaaacgctgaaacgctcggtttgaccgggaaagaaacaattgaagtagacgtgagtgagtcggtgcgcccgcgcgatctcgtccaagtcaaagcgattgccgaagacggcacggtcaagtcgtttgaagctgttgtccgctttgacagcgaagtggaaatcgattattaccgtcacggcggaatcctgcaaatggtgctccgcaataaaatgaaacagtaattgaatgaggaagagagagcctttagctttctcttcttttttcagcgtaatcctgaatgtggaggatgccgatgatgaaaaaagtgctggctgccgcgtttcttttagtcttggccggtcttgcggtttggaattttacagggcaaaaggaagccgaaatcggcattgagaaaggagacaaggcgcctgattttacgctgccgtcattaaagaatggaaacgatgtatctttgtcagactttaaagggaaaaaagtgctgttaaatttttgggccacctggtgtagaccgtgtgaaaccgaaatgcctgcaatggaagagcttcaaaatgaaaatcaggacattgccgttttagccgtcaactttacatcttccgagaaaaacgaaaagacggtcaaagcgtttgccgaaaggcacggtttacatttccccatcgtcttagaccgaacgggcatcaatgcgaaatacgagattttttcatatccgacgacatttatcattgatgaaaacggaatcattaaagatatcgtgctggggacgatgtcgaaaaagaatatggaagaaaagctgggattataaaaaatcccggcttttttgcttatattgcccaaaaaatggtgaaaatgaaaacaagctggaggtgattcaacatgaaaaaagcgaaaaggcgaacatttgaagaacttgtctcggaaaataaaaaggagctcatgaccaaccaggagtttcttgatcggctggaagataagcttgaagagaaatttaagctgaagtgagtttttaaaaatcgattcatgtttacgctcctttttgagaatcctaatgctgaaaaggagggatagacatgccgagagaacacgacaaacagtctaaatttgccccgagccatcttgggacaaaaccggtagaatataagcgcaacaaaggaaaaaagatgcatgataaatcaggagaaacaccgatcattatgcagacaaaaggcgagtaaagatgaaaaggaggcagagacccgaatgacacatcaaaaacatcatccggatgacagatcagacaacgtagaaaagcttcaagacatggtgcagaacacaatcgaaaacattgaggagtctgaagagcagctgtcttttgccagcgaggcggaacaggaacagatccgcgaaaaaaatgaacgccgaaatgaaagcattgaggcgatgcgcaatgaaatccatgacgaggcggaagcccgcaaaaacggatatcatcaataaaccagggcgacctggtttttttgcatgaagccgtccgtcgtgtttttgcccattgtatatgctagaattggattaaatacatttgtgaaaagggagtagagggaatttgtacgtctcaaaaaaagaaatagaagtccgctatgccgaaacagaccaaatgggtgtcgtctatcacgccaattatttgatttggatggaggtaggccggacggctttaattaaagaactcggcttttcttatgccgaaatggagaaagacggcatcctgtcgcctgtcgtggatatcaatgtccgctacgtcaaacctcttcgctacggtgaaacagcgacggtacatacgtggattgaagattacaacggctttaaaacggtatatgggtatgaaatttttaattccgccggagaaaccgctgtgaagggaacatcgtcccatatttgcgttgacggggacagcttcaaaccggttcagttccgcaagctttatccaaagtggcatgaagcatacgaagaggccaaaaagtaatggcgttcggtattaaaagaaacgagctgaacgaatggaagcgcgccgttttaaacggcgaagttgcgtttcttacgcattactggctcgatgacaggtatccggatgtcaaaacggtgacaaaagcaggatgcgcgaacattgagaagcttgcagagtggggcaaacagtacggactgaaaaaagagtggattgataaaagaagcgaatttccccactttgatttattgggagagaagcagatcatgattttaaaacaagaaaagctctcaagccatatcaagcgtttcaggcttgaataatacggtgttttaaagaaactcggacatccttgaaacaagcaagcattgttcttgcttgtttcattttgatgagcaaaaacgtatctttagtttcagttatattgtcatcatctgtttcaatcacaaagttcacctttacttcagtgtttttcatgccttgataagccattttatttttcgtaaaaaagtccctaaaacaagaagttttagggggaaagagtgagcggctgattaattttgattgtctaatttatgcaggatgtccttatctatttgcttctcgctcgctttttctttgctggatatgatttcccttctatcttcccaatgaataatatagtactgacctttctgcattttttcttgagaagagagctttaggtttttggatttcccatctttatcataacccgtaacatcatagttataatttatatatgtgtatccatcacttgctttttctttcacgacttttggatctgttgtaattttgacgtaataatcttccgttgaataatatccggaatataaaaagtagcccccgaccaaaattatcagtcctgccgttaaaattcctaaaaaccatttcatcatttatcacctcggaacccatcatatataaaacctcccaacgaaaccattgatttatcttacatattcctttcacatttgtaagcaataaaagtccaagcgcatcaaaaaaacagctgcttggagcagggaagttgcccattgctcaggaagcattagaatcatcaacatgacggtgtaatgttttcaaagcaaaaggacatctttccggcgaagatgtcctttgaaaatatccatcattatctattgggacttccatcaatatatctctgcacccttgttggggatgactgcaatagaaagtgtgccatccggacaaaccaaaatctcaagacgcatttttgaagttttaatcaatgaaaaaattaagagcagtcaaaattatagaaaaacctaaaatagtacctacgacaatgctatgccgtttacgattcattacaacaacagcgatatattcacggatcatggcgttcggccaataataaaaagcggtttttgaaccgatcccctggctctttaagcctgctcgttttgcatataggctggcgcggaacaggtggaaattgtttgttgtgaagatgctgttgtatttgccgtctgataatgagtccatcagttgtttggagaaaagcatattttgatatgtatttacagaacggtcttctttgaaagtgtgctcttcaggtatccctttttttaaagcatatctctgcatggcttctgcttcagaaaggttttcatcaggtccttgcccgccggaaaaaataattttcggcggaggagcaacagctgcttgtttccgataaaaatcgacagccttatctatcctgcttgctaaaagcgggggtacagtatcgttaattaatccgcttccgagaacgatgatgtaatcctgattaagtttcggtctgttaaattgatatagaaaataggctgttaagaaatttgttaaatgaaagaagaaatagaccgcaataagcgatgatcccgcaaacaacggctgaacatttggcgataaaaaacgagcggggtcaatcactgacaatagaaaaaatatgataatgcctagcccggaaattaaagtcaaacaattagacaatcgtcgtccttctcttttgataagaattctcgcattcagaaataacccgatcattaaagcaaatagaccgaacgttaggataaagaaaaagatcagcagcggtacaatgacgaaaagtctgaaaaagccaattccgaaaacgtatgccagatagtaggaaagaacaagaaatgaacaaaaaaatagattgaataaaaaaccgttgatgatccttcttcggtccgttaaataaaagatcagaaaaacagccagtaaaataaaagttgtcacaccgtaaaccatgaccaaacacctcgatgtaaatgactttgtataatattagagtgtgtaaaaatctttattgaatggggaaatccttgccgctttattttaaacgaactgtattttagatatacaggatctgtacccgctcagttattcgtgtttgctgccccgtatataatgtcctttaggagctttacgcagctcgcggtgtacatttgccgaacactcaggcaagccaccctagattttgaaggctttttttcggcacttcaatgacgaagaaaaataaaaaaacttgcagaaaaacgggggattctctgcaagccgtaaaaaatgatattttactgatattcaaaaacaggttcttccgcagattcgttataggtgacaagcagatcatggccgtcgaaataccatacatcgctttcttcaacgaaaaacgtaatgccgtctttttccgcacttacaccgatttgctgcggctcatcttttgagaccccaagggagaagcctttttgaacattgctgcatcctccgtagcggacaaagaagcgaacctgatcaccttcttttaaatcaagctcgttcttataccatttaagcgcctcttcattaattttcaaattcacgggcaagcactccttcatcatttgtttcaaagcatgctgaatctatttatagtatataacgtttttgtccgatcatgaaaatataatgttcttcggataggctcatcttttgccggacatccacttgattttgggctcggttttatcgatgatgcgtttaatgttcgtcctgtgtctgtatacgacaaacgccgtaagaaaggcgacgactgccaccaataaaaggtctttcgtaaacagactgtaaaccgttgtatacaagccggttaaaatggaagaaagcgatacatattttgtgatatacaaaaacagaaagaacaccgcaaccattgtgagaaacagaagaggctgatagcaaagcaatacgcctccggaagtagcgacagcttttccgcctttaaattttgcgaacacagggaacatatgcccgatgactgcggctacgccggccagcaaagggtgtacgccgatgtgcaggatggcgggcagaaaggcggcgagcgtccctttcaaaatgtccgcagccacaacgatagagccggcttttacgccgagtgtccgaaatgcgttggtggcgccaagattcccgctgccgtgttccctgatgtcgattcctttggcggcctttccgacaatcaagccggacggaatgctgccgagtagataggctaaaataaataataaagctattaacatttcatttctcctttttagatgatcccttctctttattttaacatgagaggcgccttccatgacggcttttctttagaagtaccgtatatatcatacaagataatgcgcgctaatcatatgaaaattttgattatctcctttgttttcgtgtaaactgaacttaaaaggagtgatcggtgtggaaaatccttctaaacaggaaatcaaaaccattcttgaaaacagcagacgaattgcggtagtcggcttgtccgacaaccctgaaagaacatcgtacatggtatcaaaagcgatgcaggacgcgggatatgacatcatccctgtcaatccgaccattgatgaggcgctgggcgtcaaggctgtggcatccttaaaagacattgaaggacacgttgatatcgtcaatgtgttcagaagatccgagcatctgcctgatgtcgcaaaggaattcctggagatagacgcagatgtgttttgggcgcagcaggggcttgtcaatgaagaagcttatcagcttctgagcgaaaaaggctatacggtgattatggatttgtgcataaaagtggcacactcgttaacaaaatcggcataaaaaagacaaaaatccttgttttttcaagggtttttgtcttttttatgcgagaatatgtttgcgaattgctgtgaaaaacggctacaataagtcttggacagttttttaagaatgattttccaattgcgatgtggaaagccttgtgctgcgggtgatgaatcgtgtaaaatgacggctgtgcaaaaagcggctttcattttaacatgttcccgacaatgcttgaagaaattggaaaataatcggataatactttgctttatatgacagagtgtgtattattctttataagcaatgtttgatttttgaaaggggtttatgcatttggttaaaaaacagcaagttgactataatgatgattccatacaggtgctcgaaggccttgaagcggtcagaaaacgccccggtatgtacatcggttcgacagacagccggggactgcaccatctcgtatatgaaatcgtcgataattccgtcgatgaagtccttgcgggccatggggatcacattatagtaaaaatacataaagataacagcatatcggtgcaagacagaggccggggaatgccaacaggaatgcataagctcggcaagccgactccagaaattattttgacagtgctgcatgccggaggaaagttcggccaaggcggctataaaacgagcggggggctgcacggcgtcggtgcatccgttgtaaacgccctgtccgagtggctgacagtcacgattgagcgggacggaaatgtttacaggcagcgttttgaaaacggcggcaaaccggtgacatcccttgataaaatcggaacgaccaaaaagaccggcaccctgattcatttcaagcctgatcctgcgatgttcagcacgacgacgtttaactttgaaacgctttcagagcgtctgagagaatcagcctttttgttaaaaggactaaaaatagaattgatcgatgaacgcgatcaaacaaaagaaacgtttttatacgaaaacggaatcgaagcttttgtcgcttatttaaatgaggagaaagacgcgctttctgaagtggtctcatttgaaggagagcacaacggcatcgaggttgacttcgcgtttcagtttaatgacggctattccgaaaacatcctgtcgttcgtcaataatgtcagaacgaaagatggaggaacccatgagtccggtgccaaaacggcgatgacgagagcattcaacgagtatgcgagaaaggtggcccttttaaaagaaaaggacaaaaaccttgaaggaacggatatcagggaaggcctgtcagccatcgtttccgtccggattcccgaagagcttcttcaatttgaaggacagacaaaaggaaagctcggcacaagtgaagcacggtcagccgttgatgcaatcgtctctgagcagctcgcctattttcttgaagaaaacagggaaacggcaacattgcttgtcaaaaaagcgattaaagcctcccaggcgagagaggctgcgagaaaagcaagagaagaggcaagaagcggaaagaaaagaaagaaatccgaagcgacgctctccgggaagctgacgcctgcacaatcaaggaatccatccaagaacgaattgtatctcgtggagggtgattctgcgggaggatcagcaaagcagggacgagaccggaaattccaggctgtcctgccgctccgcggaaaagttatcaatacggaaaaagcgaagctggccgatatttttaaaaatgaagagatcaatacgatcattcacgcgatcggcggaggggtcggcgccgattttgacattgaggacatcaattacgacaaagtcattatcatgacagatgcggatacagacggcgcgcatatccaagtgctgctcctgacttttttctaccgctatatgaagccgctgatcgagcacggaaaagtgtttatcgcactgccgccgctctataaagtgagcaaagggtcgggcaaaaaagaaatcattgaatatgcctggtctgatgaggaaatggacgacgtcctcaaaaaagtcggaaaaggatatacgatccagcgctataaaggtctcggcgaaatgaacgctgaccagctttgggaaacgacaatgaaccccgagtcaagaacacttgtcagggttaaaatcgatgacgcggcccgggtggaacggcgcgtaacgacattgatgggcgacaaagttgagccgaggagaaaatggattgagaaaaacgtcgctttcggacttgatgaagaaagcaacattttggaaaacgagaatttatcggtcgctgaggaggtttaaataaatggcacagccagagatttatcatgatttaccattggaagacgtgatcggcgaccgtttcggccgatacagcaaatatattattcaggaccgggcgctccctgatgcgcgcgacggcctgaagcctgttcaaagaagaatcttatacgccatgcatgcggaagggaacacatacgataagaatttccgcaaggccgcaaaaacggtcggtaatgtaatcggaaactatcatcctcacggagacagctcggtctacgaagcgatggtgcggatgagccaggactggaaggttcgcaacgtgctgattgaaatgcacggaaacaacggaagcatcgacggtgatccgccggctgcgatgcgttatacagaagcaaggctcgcggcgatcgcgtcagagctattgcgggatattgacaaagaaacggtcgagtttgtaccaaactttgatgatacgagcaaagagcctgtcgtccttccggcaatgttcccgaacctgcttgtcaacggatcgacagggatttccgccgggtatgcgactgacattccgccgcatcatctcggggaagtgatcgatgccgtgattaagcggatcgactcgccgaactgcagcgtggatgacctcatggagttcgtaaaaggtccggactttccgaccggaggaatcatccaggggaaagaaggcataaaaaaagcctatgaaaccggaaaaggaaaaatcatcatcaggggcaaagccgagatcgaaacaatcagaggcggccgccagcaaattgtcattactgaaattccgtttgaagtcaacaaagcgaatttagtgaaaaaaatggacgaattcaggattgaacggaaggtcgaagggatttcagaagtccgtgacgagaccgaccggacaggcctcagaatcgtgattgagctgaaaaaagaagcggatgcacaaggcattttaaatttcttatacaaaaacacggatttgcagattccttacaactttaacatggtcgccatccataacagaagaccgatgctgatgaatctcacatcgattttggacgcttatatcggccaccaaaaagaagtcatcaccaaccgttctcagtatgagctgaaaaaagcgaaggaaaggcatcatatcgtagaaggcttaatgaaggcactgtccattttggatgaggtcattgcgacgatccgctcctccaatgacaagcgcgatgccaaaaacaatctgatcgaaaagttcgcatttactgagccgcaggctgaagcgatcgtttccttgcagctgtacaggctgacaaacacagatattacggccctccaggaagaagcaaaagaactggaccagaagatcaaagagctggaagagatcctttccaatgataagaaacttttgaaagtgatcaaagacagcttgaaaaaggttaaaaaaacctatgccagtcaaaggcgctctgtcatcgaagaaaaaatcgaagaaattaaaatcaaccttgaagtgatggtggcgtcggaagacgtttatgtgaccgtaacgaaagacggttatattaaacgaacgagccagcggtctttcgccgcatcaaacggccaggacttcggcatgaaagataccgaccgtctgctctgtcagctggaaatgaatacgacagacgttctgctcttgttcacaaataaagggagctatgtctattgtccagttcaccagctccctgatatcagatggaaagatttaggtcagcatataacgaatatcatatcgattgacagcgatgagtccatcgtcaaggcgattcctgtcagagagtttaccgaatctgaatacctgctgttctttacgaaaaacggaatggcgaaaagaactcagctgatgcagtataaagcacagcgctattcaaaagcactggttgcccttaatttaaaaggcgacgatgaagtggtcgatgttcatgtaacggacggaacgaaagatttgtttattgcgacacattccggctacggtctgtggttcacagaagatgaagtcagcgtcgtcggcgcaagggcggccggtgtcaagggcgtcaatttgaaagacggcgactttgtcgccagcggacaggttttagaggaaaaagacgtgcttgtgctcgtgacccagcgcggatctattaagcggatgaaccgcagcgaatttgaaaaaacgtcaagggcgaaacgaggggttctcatgctgagggaactgaagaaaaaacctcaccgcattgccggcctgctcgcatgttcatatcatgatcaaatcacgcttcaaaccgaaaaaggcatcacagaggagatgcttgtcaaagaaatcaagcttcatgaccggtacagcaacggttctttcatcatcgacgaagatgaagcaggggaagtaacggatgtatggatcagcaaacatgagctggagtgaaatcgaacagcacgccgttgatcattcaatatctaggggcgtcaccacatgtctatcaagccgtttcaatgctcagaaaaagagcatgccggataaaccttaaacagcacgatgttactttcttgtgacacaattatacagcatctaatatatcagagactgattttttctcttcggtgagattttcgcccgtttttctgattcaacatttctttgcttaattgataccagagtaaaacaacccagtccgtgttcgcgcctttagtgaacatggactgggtttttcttgatcacgctatgattattgtatttctaactcttttacggtttcgccttcaactaacacaggttgatagtaggtttcgtttggtaaatccttctttccttgtaattttttaatgacccaatcagctgcatcgtgtcccatttgttcttgaggatgggtcaatgttgttagtttgatattcgcatttttggcgatatacgaattgtcctgaccaataattgacaatttgtccgggatagaaatattaagttgtctgcatacatttgctacttccagccctacttcgtcgttgtagcagacgattgcagtcaacacgtctcttttttcatttagaaacttcttcaggtctgtgtataggtccagcttcgtctctatattgtacgaaagcacatgctccgggtaaaatcgtaatttggcttcaccaagcgcttttatataccccttcattcgatactttccttgtaaatcatccatttttgaaatgagaccaatttgtgtatgtccttttgatattaattcttttgttgcgagatagcttgactgcacgtcatcgagacaaagaaaaggaacatctaattcttcataataagcattgatcatgatgaaaggaatatcctgttccttaaacgataggtagtaggcaatattgggattgtacagattgcttttcgtaggttcaacaattaaaccatctacgccaaatgacagcatcatttccaaagcttttttttcttgttcgacatcattatttgtactagctaatagtaacgaataattagcctcattcaatctcccttcaattccacgaataatggaggggaaaatgtaatcagaaatgtaggtcgtgattacaccgattattttgttattggaattcccgccggcttttgattgatactggttactaacataagtgccagaccctttttcacttcttaagaacccttcgttcgatagttctaaaatggcttttcgaacagtgtggcggctgactttgtactcttcctgtatggcggattcagtaggaatttggtctcccgctctgtaaactcctgaaagtattttactttttatgtcattaatgatgaccttatactttggtttcatttcactcacttctttcgcagttgttcgcattctaatttttttaattgaatgatttgtgtggacatattttatcatggcttacaatgaattaaaagattccgccttattttcgtgaaaattaactagcaattataaaaattttctttaggttttatgttattcaaataccttttattataaacattaagagaaaaataacagaaaatatcgtcgtgatatttatatgaacatattatattctagattgacatatgtacgtacaaaaaatatactaaggttgtaataaagttaagcggaaaggaaaatgctttctttcgaattataatgaaatcgctatcagagggggggattacgtgaaagcgaatcgagtaaacatcaagcaagccataactgagggagaaacatcacttggaattgaattcggatccacacgtattaaagcagtgttgattgatagcagttttgaaacaatcgcatctggaagctatgagtgggaaaacctcttggaagatggattttggacgtacaacttggtagatattatcactggattgcgaacagcttatagtgaaatgaagaatgaagttgaacgaaattatggcatcaccattcgcaaaatcggttctattggaatttctgcaatgatgcatgggtatatggcttttgacaaaacaggggagctgcttgttccgtttcgaacttggcgtaactcaacaaccggtgctgcagcaaaagaattaactgatcaatttcaattcaatatccccgaacggtggagtattgctcacctttatcaagcgatattaaatgaagagaagcatttgcctcgcattgactatatcaccaccttagccgggtacattcactggttactgactggtaataaagcaattggcattggagatgcttcgggcatgttcccgattgatgaatcaacgcaaaattacaatgaatcgatggtcaagcagtttgatgaactgatttcgaacaaaggctacccttggaagctgaaggatattcttcctaaagtttatatttcaggcgagcaggctggtgaattaaccgaaattggtgcaaaaattctggatcagtcaaaaaatttacaaccaggcattccaatttgtccaccggaaggcgatgctggaacaggaatggttgctacgaatagtgtgaggaaacgcactggaaacatttcggtgggaacttcagtttttgccatgattgtattagaaaaagaactttcaaaagtatatccagaaattgatttggtcacaacgccaaacggcagtccggttggaatggttcatgcgaataactgctcaagcgatattaatgcttggctaggattgtttcgtgaattttttgaagcaatgggacaaaagattgaaacgaataaattattcgaagtgatgttaaataaagctttggaagctgactcagatggcggcggtttgctaagctacggctatttctccggtgaaaatattacgggattagaaaaaggccggccattatttgtccgctcaccagagagtcgtttcaatttagcaaacttcatgcggacacacctttttacagcctttgctgctttgaaaatcggaatggatattttgaccaaagaggaaaaaattgaaatcgatagcattttagctcacggcggtttattcaaaacccctcttgtcggacaaaaaattgttgcagctgcaatgaatacgccggtatcagttatggaaacagccggagaaggcggtgcgtggggaatggctattcttgcttcttacatgatgaacaaaggtcaagaagagagcttagaagacttcctcgacaaaaaagtctttgaagaggatgccgggcaggaaatttaccctgatcaattagatgtagaaggatttgaagcatttatcgaacggtacaaaaaaggtttaatgattgagcaggccgctgtagaccatttgatttaatggagggattgacgtgctagaacaactgaaagaagaagtattacaagcgaatttggacctgcctaaatacggactcgtgaaatacacatggggaaatgcaagtgccattgaccgtgaaacaggtctattcgttatcaaaccgagcggtgttgattatgaaacgatgaaagctagtgatatggtggttgttgatttagatggcaatgttgttgaaggagagctgaggccttcatcagatacagcgactcacgcagtgctttataagcgctaccctgaaattggaggaattgtacacactcattcaacttgggcgacaatctgggctcaagcaggccttgatgttccagcgatggggaccactcatgcagacacattctatggttccgtaccatgtgcccgttacttgacacaagaggagattgatcgcggttacgaagcagaaacaggtcatgtgattatcgaaacatttgaggagcgagggttagatattttagctgttcccggtgtcttacttcacggtcatggtccatttacttggggcaaagatgtaaaatcagccgtattgaatagtgtggtgttggaggaagttgcgaaaatgaatttatttacaagagaattaaatctttttgcaaaagaattaccacaacgtattttagataaacattacttacgaaaacacggtaaaaatgcttattatggtcaaaagtaatgtcaattctatcaaactatcaattatcccatcaatttaagaaaagagggttattatgttaacaacagggaaaaaagaattttggtttgtcgtaggttcacagcatctttatggggaagaaacgttagcggaagtcagagcgcacgcgcaagccatgaccgatgcattaaatgaaagcgctgttttgccatatccgcttgtattgcaagatttggctgttaatgcagataaaatcactagcatcatgaaagaagtaaattatcgtgacgaagtcgccggtgttatcacttggatgcatactttctcgcctgcgaaaatgtggattcgcggaacaaaattattgcaaaaaccattacttcatttagcgacacaatttaatgaaagtattccatggccaacgattgacatggactttatgaacctcaaccaatctgctcatggcgaccgtgaatacggttttatcaatgcccgtttgaaaaaacaaaataaagttgtcgtaggttattgggagcgacctgaagtgcaacagcaaattgcagaatggatggacgtagcggttgcttataacgaaagcttcaacatcaaggtcgctcggtttggtgacaacatgcgtaacgttgctgttactgaaggggataagattgaagcgcaaattcaatttggctggacagttgattactttggcatcggtgatcttgttcaatacgtgaatgcggttacagatgaagagattaatcgtttgtttgcagaatacgcagacctttatgaatttgattatggcacttacagtcgggaagattgggagaagagtgtaaaagtacaagcaagctatgaaatcgctattaaacgtttccttgatgatggtggttacaatgctttcacaactaactttgaagatttatatggaatgaaacagcttccgggtcttgccgtccaacgtttgatggcgcaaggatatggctttgccggtgaaggagattggaaaactgcagcgctcgaccgcttgctcaaagtgatgagccgtaaccaatcaactggttttatggaagattacacatatgaattggctgccggtcaagaatcaattcttcaatcgcatatgcttgaagttgacccatctttagcaagcaataaaccaaaaattatcgtctctccattaggtattggtgatcgtgaagacccggcacgcctagtgttcgacggaaaagcaggagatggcgtggttgtttcaatggcagactttggtacgcactacaaattgttgattaacgaagtttctgcatttgaaccaactgttccagcaccaaaccttccagttgcacgggtgctttgggaagtgaagcctaacttccaagatggagtgaaagcatggcttgagaatggcggcggccaccatacagttgtttcattgtttttaacaacagaccaaatgatcacttatgcaaagctcgttgacttggaatatgtagtgattaagtaatgcctctaacctccgaggaggtgctgcttccttggaggtgaaaataggcatcagttttcaaaatatttatgattttgtaagcgttatcgcgacattcagtaaaaattgaaagcgtttaaaaataggcgaataaaaccatgagatttagggagaaatcccaccaaataatatcctggcatgtatttgcggcttgaaagcgcttttattatttcttaaaaagccttcaatatttttgcagtggatttttacacaatttaatttcaaccttgaggaggaaactttaatggttaatgaaaagaaaatctcaagtggcttcatttacttttttggggcttttgcgggcattcttttcggttatgatatcggcgttatgacgggtgctttgccttttctgcaaaatgattggaaccttcaagacaacgccggggttattggatggattacctcttcggtaatgttaggcgctatttttggaggcgcccttgccggacaactttctgatcgtttgggacggcgcaaaatgattttaatttccgctatcatttttgttgttggatccattttgtcaggaatagcacctcataatgggatactatttttgattgtttctcgggttttattgggattggccgttggtgccgcttctgcattggtcccagcctatatgtcggaaatggcgcctgcacgtttacgtggacggctgtcaggaattaatcaaacaatgatttgttctggaatgttgctttcttacattgttgattttctattgaaagatttgccggaaacaatggcgtggcggttgatgcttggtttggctgctgtacctgctttgatcttatatgttggaatgctaaaattacccgaatcaccacgttttttaataaagaacaataaacttgatgaagctcgcaaggtgttgagctatattcgctctaacaaaggagagattgattctgaaataacgcaaattcaagaaactgccagagaagaagcgaaggcaaatcaaaatgcatcatgggctaccctcttaagcaataaatatcgttttttattaattgccggtgtgggtgttgctgcttttcaacaattccagggtgcaaacgcaattttttattacattcctttaattgtagaaaaagcaacaggaaatgcagcaagttcagctttgatgtggccgattattcaaggagttattctcgtgctaggttcattaatattcttagtgattgctgataaatttaatcgccgtactttattaacagtaggcggaacaataatggggctgtcctttattttgccggcaatattgaatatattaattcctaatgcgaatccgatgatgatggttgtctttttgagtatctatgtagcactttattcattcacatgggctcctttaacttgggtcatagttggagaaattttcccgctggtaattcgcgggcgtgcgtctggtttagcttcatcatttaactggattggttctttcttggttggattgctatttcctgttatgaccgcttcgatgtctcaagaagctgtgtttgcaatcttcggtgtgatttgtttgcttggagttgtatttatccggacacgcgtccctgaaactcgaggtcgcagtttagaggaaatcggaaaaaatggagaaaataaacgagttgacggaaaaagcgcgtaaataaaacctatggaggcttggagtagaattcaaagaagatatcttgggtgccgcttatcgcaggggaaatcctcgcactagtgtattttgaaacaggggttcaaaagatcgtaaacatatggatttcctcacggcgccttgcttgagggcgaagttgctcacttcggcctttttttaattaaaattagcctcttgtttgtatcatttccgctcaattgtcccgcttcgttatatcctaaatgatggagccgtccttcaacagataaagggacctgggcaatcataaaagattgggaaaacttcaagaagaagggcgtttagaatgacaatttggcagtaaacgctaagtattgatgcgattcgaaattcatggacgccacgatttgccgatgggggaggaaccaacggcctgcgttctttgttttttaaacgtgaaccataaatcaaggcgtggttggacgccgtggccgtttcgtattacacggttttaagccatgctatatagctgattattcaatactaaatatggaggggaaaactccgccctccatatagaatataattttaaaattaattaaataccattccgccatcaatgataagagcttgaccagtcatataatctgaatctggccctgcaaggtaagaaacgcatgctgctacatcttccggctcggataagcgttttaatgcaatatttttagcgaattgttccatgccccattcaaacggcttgcctgcttcatcagcggtttgctgtgcaatccccatcatcataggagttttaacgatacccggacaaaaggcgtttacagtaatacctaattcagctagatcttttgccgcagtttgggtaatcccgcgaacagcgaactttgttcctccgtaaaccgctaagcccgggttgccgacttggccggcttgagaagatgcattaatgattttcccgccgtgtccaagttctttaaaggcttttacacccccctgtattccccaataagtaccgccaacgttaacatcatagactttccggtaatcttcatatgtaatgctttcaataggggtggttggtccaagacccgcattattaatcaccacatcaagaccgccaagacgttttactgtttcatcgacagctttaaaaacatcatcgcgatcagcaacatccactttaaccgcaattgctttgccgttaagcttattgatgtcctcagcaacttgtgttgcagtttctacattataatcggcaactgcaactgcgaatccgtcctctgccaatcgtttgcagattgcttctccaattccttgaccgccgccagtaacaaaagcaatttttccagatactttactcatataaacatcttctttctataagtaattggtatttaattggtacaggaatattatatcttatatttgtagatttgaagtaaagccgcggcatttgttgaaaatatgtttaaaatttttcgaaaaaatttaatagtttttgaaagaggtggaagaactgtatgtaaaactataaaagggatgttctgctataaaacagcgattcagccatcgctaaacggatgaagaccaaatgaaaaggcatgaacccgcacaatgccggattcatgccaaacaaactgcttcatgaaattttattgtctagctttttcaaatcgcttcaaattcagctgtcctggcgattgaaaagatcggtaatcgcgtgcatgaattcaattccttgaaaaacaaacagattgattgctgtcaatgaaaatagtccaataatcaccattcttatgataaataacatgttaaaacctcccgctttttttgtatggttatggttttaaaacatgcgctttatcgaaataagaagagtgatagaacaccgcgagcataaatgccttcagatgctctttccgcctgttcatcatgaacgcttgaccggaagcggcagctaagattaagagaaggacggattcagctccgaaaccgagtgaattccataatgatttcgccttttcttcaccatattttccgactgtcagttcatggagttcgtctcctgaaacagcggctttttgcgcatggtgatttgccggcatctggggcattgagaacgaatgaaggctcgcaatgactaaaaagaatatggacagttgcagaaacaatgtctttttcatttgatctcatccccttagtatctcatcatcttagcatattttattatataataaaagatgattattttgtgacagtttgcaaataattattgacaacattagatttttcgcagcgcatttgaaatgaaagcgcatttttatgtatgaataaagataatactctgctataatgagcattgggtctaaagtaatgatgatgccatcagcctttacgattaaaaaacagaaaattctatctagttttgcttgcgtcattattatgatataatcctatcatgttagaaaacttaacatcaaaacaaaattcgtttgtttcaggagggtgctatggaagaaattttaagcgaaatcatcaatgtcccgagcggttttatttggacttatttagtctatatattaataggaataggcctgttctttacgtttaaattgaaattcgttcaattccgctatttcttcgagatgtttcgtatcgtcggacaaaaagaggagaaaggaaaaggcgtctcgtctttgcaggcattctttatttccgccgcttcccgtgtcggaacgggtaacctgaccggtgtggcgcttgctgttgcaacaggcggaccgggagcggtcttttggatgtgggtcgtcgcgcttgtcggaatggcttcaagctttgtggaaagtacgctggctcaagtctacaaggtcaaagacggcgatcatttcagaggaggccctgcttattacatggaaaaagcgctgggcgccagatggatggggattatctttgccgttttaattacaattacattcggcttgatttttaatgcggttcaagccaacactatcgtcggttcgatgcaaggggctttcaacctggataaaacagtggtaggcatcatccttgctgcaatcaccggatttatcattttcggcggattgaaacgcgttgtgacagtttcgcagttgatcgttccggtcatggcgatcatttatcttggacttgctttatttgtcgtgctgacgaatatttctcaaataccggccgttttcgcgatgattgtgaaggatgctttcgggatcgagcagattgcagggggtacgctcggcagcatcattattatcggtgcgaagcgcggtttgttttcaaacgaagccggaatgggaagcgcgccgaacgcagcagcgactgccaatgtctctcaccccgcgaagcaaggctttatccaaacgcttggcgtattctttgatacgatggtcatctgcagtgcaacagcctttatgatcctgctgttcaatctgacgcctggcaaagagcttgacggcattcaaattacacaagcagccatgcagcatcacattggaagctgggcgcctgcatttgtcgcagtggcgatttttctgttcgctttcagttcaatcgtcggaaactactattatggtgagacgaacattgaatttattaaaaagagcaagacggcgcttgctgtttaccgtacagccgttgtagcaatggtgatcttcggatctgtatccggtttccagcttgtgtgggacatggcggatttatttatgggattaatggcgatcattaacctgattgcgattctgcttctttccggaattgctgcgaaagtgctgaaagactatactgaacagcgcaaagcaggaaagaaccccgtctttaaggcaagctcgattccaggtctgaaaaatacagaggcttgggaagacgagaaggaaacattgcaatcgaaataaaccatattaaaaaaggcgtccttgggggcgcctttttcttatttttactgacagctgaaagaagtgatctcgttcaggtcaataccgaagtaaacccagcggaattgacgcggcctccagcggtagcccgcaatcgaacgacggccgacgaaaaccgggtagaaccaaaaacggctgccgtttctcaagcggatgaacgtgtatctgaacaggcatcttctgattccgccaggatcaacggcaaataccgaagggccggagtcttgcggaaattggctcggcggcggggggagcagctgctgttgctgctgtcctcctgctcccggaggcggccccggcggaaattgctggcgatacggatcatatagtgaaggatcgtatggatacaataaaaacgctcctttctgatggtttgctttatcgtatgattgattggtaatatgggtagcttgcctatggagaaaaaaatccctaaagccgttttagctttagggaaaatgtttacatgcttttgcggggcgcccgtttccggtaaacaacatagcttcttgtcaaatattttagcggcatgctgaatacgtggacgagccgagtgaacggccagacgatgaaaatgacgtagcccatgatgatgtgaagcttaaaccagaggggcacgctcgccataagcccggcatccggcttgaataagaaaatgttgcgaaaccacgggccgattgttgtcctgtagtcgaatccttttgaatcgatgtttaagaaggttgccgcaagcccagtggtcatcacgaataacaaagcgacaagggtgattaaatcgccggcagagctcgtttttcgaatccgtttgtccgtgaatcggcggtaggtcaatatgagaagccctgacagcgcggcgatgcctgcaggcagtccgaagccgatcgcgatcttatggtacatatgctctgaaacgccgagcgcctcataaaggctttccggaattaaaattcccatcacatgtccgccgatgacaaaaaagattccccagtggaaaaggctgctgccaagcgcaagttttttcttttcgagcatctcgctagatttggccgtccagccaaattgatcatgttgatagcggtaaatatgccctccgataaaaatggtgatgacaatgtaggggaggatgacccacagtatttgttcgatcatggctgtacattcctttcaacaccaatttcctctaagatcagcattaatccgtccaataacggtgtatagatgctttcattctctgaaagctgcgatctcaattcttccaggtttgctgcgtatttttggaaaacagcagcagctttttcttgatccgcaactgcggcaaattcaagcatgagcggcagataatccggcagctctttatctgtcggctgaaaaccggactgctgatacagatctttcagctgcagcaattcaataccgcgctccctttgttcgccggagttgaaataggtgacataaaggtttgtttttttgccgaaatcaaacgtatatacgtatgtttcaatcaattcctcagacgaataggaagccgcgctttccaagaaggcaagcagatgtcctttcagcgcttcatgctcgatttcgccgatgatctgctgccattcggaacgttcttttctccactcttcatcagggtaggagaggaggtaagaaagagcggcaaaaacggtttgtttgtctgttccatccatgaagcttccctccagtgtttatatgttttggcaagagccgggtcctccggcaaacgataatccgcagcttccttgttccatgtatagatccgcgacttcttcgcgatgggtttgaggaatgacgaaccggtcatcgtatttggcgattgcaagcagacggtacatgtcttcaatctgctcttcagtcaatccggtatcttgaatcagagatgaatcgatctgtttgttcgtttgggtcgcccgcatgtgcatacgcatcacagacattttctttaatgtcgttctaatatggtgtgtatcaccggcagtcagcaaattggccaaatattcgatcggaatccgcatttcatcaatagcagggaagatatcttcagctgattgggctgttccttttccttcaaacatattcataatcggactgagcggaggaatataccataccatcggcaatgtccggtattcaggatgcagcggcagagcgattttccaatcgatgatcattttgtagatcggagatttttgcgctgcttcaatccactccagcggaatgccttgagcttttgcttcttctgcaacagcgggatcattcgggtcaaggaaaatctccagctgtgagtgatacaaatctttttcattttcggctgaagccgcttcttcgactttttctgcgtcataaagcatgactccgagatagcggattctgccgacgcatgtctcagagcagattgtcggcagtcctgcttcaagacgagggaagcacaatgtgcatttttccgccttgttagtctgccagttgaaatacacttttttataaggacatgatgatacacagtgtctccatgagcggcacgcattttgatcgacgagaacgatgccgtcttcctcgcgtttgtacatcgctcccgacggacaggaggagacgcaggaaggattgatgcagtgttcgcatatccttggcagatacatcataaagacgtcttcaaattcggttttgatggattcttccatttttttgacgtttggatcttggaggcctgtaatgtggccgccggcaagatcgtcttcccagttcggaccccattcaaggttcatgaagtctcccgtaatggaagacttcggccttgcaacaggctgatgttttttctccggactgtttgtcagcgtttcataatcatagttccaaggttcatagtagtcatcgatcgtcggctgatacgggttgtagaataaattcatgagccgcgttgctttggcgcctgatttaagctggagcttgccttttttcagctcccagccgcctttgtatttatcctggttctcccattgtttagggtagccgatgcccggttttgtttcgacgttgttgaagtacatatattctgcaccggaacggtttgtccaagtgtttttgcatgtgacgctgcatgtatggcagccgatgcatttgtcaaggttcattaccattccgatttgcgctttaatcttcaagccaatcgacctccttcaattttctgatcacgacattgaggtcgcgctgatttcctgtcggcccgtagtagttgaatccgtagctgagctgtccgtagcctccgatcatctgcgtcggcttgacatggatgcgggtcgggctgttatgggttcctccgcggttattcgtcagctttgttcccggcacgttgatatgtctgtcttgggcatggtgcataaacgccattccctttggaatccggtgtgatgtcacggcccgtgcgacgacgacaccgtttcggttgaagcactcgatccagtcgttgtcctgaatgtcggtttcttcggcatcgtctttattcatccagactgtcggcccgcctctgaaaagggtaagcatcggcagggaatcaaaatacatgctgtgaaccgaccatttattatgcggcgttaagtagtttaaaacgatttcttttccttcctgatccggacgcttgttcaagaaagggcggtggatcaggatcggcttgaatgtcgccatgttttcgccgaattctgtcatcatttcatgatcaaggtaaaaagactgtctgccggtcagcgttctccacggaatcagtttttcaacgtttgtcgtaaacggagaatagcgtcgtccgcctttttcagaaccgctgaaagcaggggaggtgatcaccgttttcggctgagctgaaatttgctcaaatgtgaagcattcctcttcccgttcttcagctaaatctttcaactcaagattcgtaattttttcaagcgattcccacgctttaacggctactttcccgtttgaagtggaagagagagtcaataccgcttcagcagcttgtctagcatcactgatgtcgggacagcccttggcgatcgtgtcgtcttttacgacgccgagcgtttttttgagagaattatattccgcttcaacagaccagttcattcctttcgtaccaaacggctgtttgacaacattcggcccaagcgatgtcatcttattgaaaatctgcttataatcccgctccacaacgtgaatttgcggcattgttttgcctggtacggcagggcagtcgcctttgctccaatctttgattttcccgagcggctgcgccatttcttgtggagtgtcatggagaagaggagtcgcaacagcctctttgacaggttccatatccacttcttcagccagatcggaaaccgcttttgccagtgctttaaaaatatcccaatcagactttgcttcccacggcgcgctgattgccggattaaacgggtggatgaacggatgcatatccgtgctgctgagatcgtgtttttcgtaccaggtggccgcagggagcacgatgtctgaataaagggctgttcccgccatccggaaatcgagattgatcagtaaatcgagtttgccttcaggcgctttgtcacgccaagtgatttcttccggacggatgctgtcctgatcatcgttcatcagtccgtttgtcgtgccgagcaagtgtttcagaaaatattcatggcctttgccggagcttgagattaaattggctctccagacaaatagatttctcgggaagttcttttcattgtcaggatcttcaatcgaaaacttgagctttttctcctcgagctgtctggcaatatagattccgacttgctgagcgttctcagcgcccgctttttctgcttctttatacaagtcgatgccgtttttctcaaacgtcggatacgatggaagccagccgagtctcgccgccagcacattgtaatcggcatggtgcttgtagcgcgatgtttttgcgattggtgaagcgagcccgctgatttcctgatcttcatagcgccactggtcggtggcgaagtagaaaaatgatgtgccgttttgcagtttggcagggcctccccagtccttggccatcgcgatcgtctgccatccttcggccggccggagtttttcctggccgacatagtgagcccagcctcctccgttaactccttgggctccgacgagaagcacaaggttcagtacagctctgtaaatggtgtctgaattgaaccaatggttaattccggcgccgacaatgatcatcgagcggccctctgtgtcaatcgcattttgcgcgaattccctcgcgatcttgatcaccatttcacttttaatgccagtaatcggctcttgccaagccggtgtaaacggttcaggatcatcaaatgatgccggcgtctgtccgccgattccgcagttgacgccatagttggcgagagtcaggtcgaaaacggtggaaacaaagacttcctcgccgttcaagatgacttttttgatcggaagcggtctttcaagcactttattgccgtcatgtgagaaatacgggatgttgaccgtgccgatcatatcttcgtatccaagcatggaaagccgaggtgtgatcggtttttctgaatcctcatcaaccatgcgcaggttccattttcctttgccgtcccagcgggagcccatcgtgccctgcggaatcgcaaatccatctgtgtcttcgtcccaaacggcaggcttccactcatcgtgctctgtcgcgcgcccgatatctttagcatggaggaagcggcctgctgtgaacgttccgttttcctctttcaaagtcaccaaaaacgggaaatcggtatattgttttgcataatcaataaaacgttccgttttctggttgacataaaagtcttgcagaataacgtggcccatcgccatggccagtgcgccgtccgtgccttgtctgatgctcagccaatcatcggaaaactttgaggactcggcaaagtccgggctgatcgaaatcacttttgctcctttatagcgggcttcggctaaaaagtgagcgtcaggcgttctggtaagcgggacattagagccccatgtcatgatgtagccagaattgtaccagtcgctgctttccggaacgtcggtttgatctccccaaatttgcggtgaagcaggagggaggtcggcataccagtcatagaagctcagcatcggcccgccgatcagggacataaagcgtgatcctgctgcatggctgagcatcgacatggctggaatcggcgaaaagccgacattgcggtcagggccgtatttggcaatggtatacagaagggaagccgaaatcagcttcaggacttcgctccattcggcgcggacaaatccgccttttccgcgcgcctgtttataggctttcgctttttcagggttttcgacaattgatttccatgcttcaagcggatttttgctgctgtttagcgcctcgcgccacatctggatcagcacaccgcgtacatacgggtatttcacgcggagcgggctgtatatataccaggaaaagctggctccccgcggacagccgcgcggttcaaagtccggcatatcagggcctgtcgaagggtaatcaagccgctgcccttcccatgtgacgatcccgtttttgacgtagatattccagctgcaggatcctgtacagttcaccccatgggtagagcgaaccactttatcatgctgccatctatttctgtatacatcttcccaatcccggtcttcataagtggtttggctgtgttgattggaatggcgttcaataggggagaaataatttaatctcctgaaaatgggactctttttcttttttttcattgctggttcactccttctgagtcagtgatgctaccctcactatatatggaggaggcgctgcaccttgttaaatttgtcacatggtttcggcttttcacaaatttgtcacattttcaggagggggaagagggcggacaaaaaaacagcctgcatggaagcgggctgtcgaatggttcaatcgctcgtgttcaaaattctcttttccccgttaatctcctgaatcggggcgatgttctgggtgaattccaaagtgccgatatagcggccgttttcatcgcgtacggcaaaatagcggatgaacacgtattgtctttaaatttgatccaaaaatcttcaacatctttttgccagatttaaagtcgtccagaagtttgttgacgatgtggacgctagccggcggatggcagttttggacggttcggccgattacggcttttgtccgggcgaaaatccgttcctttccgtgtgaaaaatagcggaccacatcgttttcatcgatgaaggtgatatcgaccggaagatggttcatcatgtgttcaagctgatccacagacagaataccggtagggagtctgacatagccatcagccgcctcttcgctcgttttgatctgatggcgttcaggcttccacaccgtttccggagcagtcaggcaatatccgatctcgtcgctttcggctgcgattttcagccattcgtcttctgtcagcgttctgagcgccatcggcaagaggatattttcttctttataaatcatttccgtgccttcttgaatgataaacgttagttcgcggatgacctcatcttttttgtccggcgtatactcttccaacaaacgcttcacttctttaatgctcttgcggataaaatcgtcgacagcccacatgacttggcttggccctgtaattccgtacttttctaaataggggaacagaagattttcttttctgctgtaatgtttgtcgacgtcagctagcaaatttaagtctgcgagcagtttgagaatgttgtcgcgatgatcttctttttcaaagcgttccaaatgaagctgcattttaaagttcaaaaggaggtcgatttctttattttctttcataaatgtatgaacgggatggccaggctgcttgtcggcgtccgcgcggtgaatgtcttcaatcgatcctttaaacacagcggcgtgaacggagcagagctcttggatctcttcaggtgtaatgccttcttccttcatcaacgcctgttccagctgggcgatttcttcggcattgactgagccgaatgccttttcgaaccgttttttgacgtcggcaagcggctttcctttatgaaggtcgatgatgatctccttcagaagctgctttttttcctcaggcagaccttgctgcgtttcccgattgttaatgatttcgctcattgtttttctcctttccaaacggggtcaaatccgtgtgctttcaatatgtctaagacatggttccattcgatttgcatcattcgcgcgccttttggaatcgtcatgatgcgcccggctgtttccagcatgccgggctttgtaatattttgaaacccggcatccttcatcacggcttttagttcaggatgcaatgtgcaaagtttgtaaacggaatcgtccaaatcaatttttttatgcaagggatcacatcctttgatagtgatgatcattctcatctataccgtaatacaaggaagctgaaaaaaatgtgacgtacatcacatttttttagcgcaaagccttcggaatataaatgcagctcggatcgctttctaggtaatcgcctgtcagagcataagcacgcgagcgcgaaccgccgcacacatgacggaattcacagacgccgcatttccctttaaatccgtccggatttcgaagatccttaaagatcggtgattcgcggtaaatctcagccagcggctgttcgcggatgtttccggctttaaccggcaggagtccgcttggatatacatcaccgatatgggagataaacatgaacccgttgccatcgttcacacctttcggagcccggcccaatccgccgatggcatccatttttcctttctgcaatgcgtgttcatagcggattttcatgtgggggtctttcgcttcccgcattttttgctgaatgacgacccgccggtagtgctgggctgctgtcgttttgatgtcaaaaggcgcttcttttgccaaacggctgagccagagaaagactttttcatggtccaccggggaaatcatatcttcccgcttcgcgcggcctgtcgggacgagaaaaaacacactccatagtacgcagttcaattctttgatcagctttgccatttcatccaggtaatcgatgttataggaggatatgacggtattaatctgcagaggcagctgacattcatgaatgtagcgaatggccttcatagtcaggtcaaaagacccgtccgttccccgaaaatgatcatgaatctcccgggtcgggccgtccaagctgaacgcccatcgggataacccgatttcttttgctgattgaatcgcttctcttgtaacattcggcgtggcactcggggtcatggagacgcgaacccctttttggacggcatattcaataatggcgaatacgtcgtctctcattaaaggatcgcctcctgtaagcacgaggaggggattgtccatcgcatgaatttgatcgattaaatcttttccctctttcagggatagctcccgaggatcgcgtttattttgagccgatgcccggcaatgaaggcacttgagctcgcaagcccttgtcagctcccaaatgacgataaacggagacttgtcgaaatcgcaaagtatcatctttcatctgtcctttcgtttgcattcatgtgtatcgtagcggaaatgcaggagaaaaaaagttaagtagatcacatttggaaaaaagaagagaaagaaggggagaggcccttctcacacgtcgtcttctgcggaggagttgaggtagcgcaaaaaaagctggtatgaaaaaaataaattctgctggagcaacatgagaaagttcgtctgtaattggcggttataagtcatcatttttttgaaattatgaaacggtatttcaagtacggcggtttcagaggcagtattgactgaaataaacggagataagaaaggttcgcctttttgatcaataggaaaaacatcgcctttttcccactcggcgatcgtccgtgattcttccggaagccttctgtcggaaaaatgcacttctccttttaaaacaaaatagacggattgcgaatgaaggaacgatcgcgaatgctgagacggttggatatctatcaccttaccgttcttcagcagctttttgatgatcggaaggggtactccgaaaaacataggaagatttttcagaaacaataagtagtcaaaccggtccatggtatatcctccttctctatattggcttttagtataaagcgccgggctgcagggcgcagtgatttaattcacacgactgtatgcaaaatgtcactgtgtaaaaagaacgaaacttttataatgtaatagaaaagaagggaggatgtgtgatgaaagtgttcataccgaagcagcacggcgcctgggcgatgcttgtcatcccgtttattctcggcatgttcgccggaggcgcagatgtaaagcatattccgctgttctgcggatggctgtttctatatcttgcggcatctccggctatgatgatggtgaagaagaaaaatatcgtttactatcaaaaatgggttctcatctacggcattccggccgtcgttttcctgcttatttcggtcctgctggagccgcagcttgtgtatctcggtctgccgctgtttccgctctttctcatcaatctttattatgcgaaaagaaacaacgacagggcgcttttaaatgatatagctgcaatccttgttttcagcacgggcgggcttgcgagcttctggatgggagcggggaagcttgatggtgaggcatcgtttgtttttatccagtccgctttgtttttcacagggagcgctttttatgtcaagtcgatgatacgtgaaaagaaaaacaatcgattcaagctttattcatggggctaccatgttttcctgccgttcgtctcgctggccgcaggggcaggatgggcggtgatcggcgtagtgccgagcagtcttagagcgtggtttttccacgggaggaaactgtcgattaagataatcggaatctctgagctggtgaatgcctgtatctttatggccgtgttgatcgtttttctgctgcaaacgtaaaaaacaaggacactgtgcttcatgtccttgtttgttttcgctttttcagtcgatattgcagatttcgagcgggcagttttcacagtcgatttcgcgttttaaataattgatctggtggatgacgatttttcccgagtcctcaattgaaatgacaccgttcttccggaggtcgctcagcatgcggttgatgctttctcttgcagcagcacaaaatttcgccagatcctggttcgtcaggacaatattgatgagaatcccgtcgcttcttgtgatgccgtagctgtttgcgagacggatcaaggtggagtagagcgcgccttttttaccattcagcaaaaggtcgcggatcttcgattgaatctttcgcaaatgcgtgctcatccatttcataaactcaaacgtcagcgcaccgttttgaatgagttctttttcaagcttatctttattgatgaccaacacttcgccatcagagaggatctttgcgctcagcatatatttcgcatcttctgtaaaaagcgtaagctccccgacaatatcattttttttgcacattctaagcgtcagttctttgccatcggacgtcaatttgccgatctggacaagtcctgactgaataagatacagttcctctgcatccatcccttcttgaaaaaggaatgtgtcctgcctgatttttcgtcgcgtactgatcgattccagcaagtgatgcagatcgtctgagagcaaatctgtgtctgattttctaacagaaatgttcattgagcgtcaccccttttgcagttcttattttaacgttaaataaggcagagtgaccttttaaatataaacaatattgtgaacatatgaatatagtcccgaaaaagagcctgggcatatcggctcaatctctttttgcaggaagggcttataaatggttggccttcgttttggacgatgttttgttcacttcctgaaaatacatccagaccacgatcacaaagcttgcaagagccgcttctgacagcgccatgaatccgatcgcataatggccggttgcctgaaaaacgcttgacaggatgagaggcgggaaaaatcctcccaagccgcccatcgctgatacgatcccattaacgatgccggcctgatttgaaaaataaagcggcacgagcttaaagatgatcccgtttccgagtccggcgcacacggcaacggttaataccccaaacccgtacagtccgaggctcggcgaaaaggccaataaaatccctgacaaggtgcagccggcaaatacatacatcaacagcttcagcgggttgaatttgtctgccagccagccgccgacaggcctcagaaaagtggcgacagcgataaatccggcggttctcagccctgaatcgacgggatcaagcccgaagtgattaacaagaaagttcggaagataaatcgtaaacgcgacgaaagatccgaatgtaatgaagtaaaacaagcttaaaaaccataatgtctgatttcggtagactgccttcatttgctctgttacagataccgtaacttttgtttcttttcgatctccaaggataaagttcaataaagcgaatacggcgactaacacgatgtacatccgcaccgtattttcccacccggcggtttttgcgacaacaggagcggcaaacgtagtaatcgctgtaccgacgttcccagcgccgtagatcccattgacaaacccgtgcttttctttagggtagtatttcggcagtgatgtgaccccgatggaaaagaccgctccgccgatgccgaggaagaagccgccaaggatcaagtcgaacagcgaatcggctgtgctgatccaaaaaaccgggaacagaagcagcaaaaagctgatcatgaatgtaattcttgctccaaatctgttcgtgtagtagcccagcggaatcctgagaagcgacccgagtatgaccggaatggccgtaacaagggagacctcgctgtctgtcagggcgatgtcctgcttaatgtggggcattaaagaggaaatcaatacccaaaccataaatcctgcgactaaactaaatgactgcagcggtaattgtattttttgacgatttgccattgcggttttgctcctttcaaagggaaaaatgaataaatcaatcagcatgtttatcttacaaaaagtctttttaaaacattgtgaattacgtcacacggtcattcgcttgtttcgtgtttaatatcggtaagtgacggagagtaaacggatgtaaaaaaataaattgttcatttgcggactttatcgtttatcatggaaataaaaaaaggagtgccgcttttatgtttataaagcttacccaagaagaaaaacaagcgatcatcgatgaaatcaaacgcttttatgttgaagaaagaggagaagaggtcggagacattgcggcgattcaaatgttcgaattcgtaaaggaaaagctcggaccttacttttacaatcaggccttgaaggacagccgcagagtggtggaagagaaggcagcggcgattgaagaagagctctttgcactggagcgccgtctgtgacaaaccgctctcctttagcaaaaccgaagggattgaaagaccaatggagtttctgaagcaatttatgattttcagcgggttgaatgatgaagagttcaagcaaatcgagcagatcgcggccaagcgcacctatcagccgagaatgtttgtttttatggagggggaagagagggaagcggtatttttcatcaaatccggtcttgttaaagcctttaaaatcgatgaagacggcaatgaacaagtgatttcgattctgcaaaacggggatatgtttccccatgtcggcttttttgacctctccccatacccggcaacggcagaagccgttcaagaaaccgaattgatcgtaatccgcatcgccgattttaatgaacttttgatgaaatttccggaaatgacgataaaagtgatgcaaatcatggggaaaaagattctcgatttgcaagagcggatccagggttttatctcaaaagacgtccagcaccgcttgacacatgtattaatgaagcttgctgctgaacatggcattcctcaagaaaaaggggtctacatcagcctgcccattaccaatcaggattttgcgaacatggtcggaacgtcaagggaaacgattaaccgcacattaaatgaattgaaaaagaaaaatctgctgacagctgacaggagcggaattttcattcatgatacagactggctgaacggctgcaattaaggcatgagttttaggctttccattgaacggcagatggaaagcctgttttttattttgttcacaaatacgccatgatttaagtgatctggttcacaactggtgttttgcatatccagtatcttaggacatgcaaaatcaaaaaaggagtgaaccgcaatggaagtacaaagaaagacggtgcccgttaaaaaagcatcaaaaaacggttttctgaaatccattctcgtctttactttaatcgtaagtttttcggtgctgcttttgggaggctattggatcttcaaaggacttgcaccaagacctgttgaagtgtccgggccaaacggagaggtgctcatgacaaaatcgtctatttcaggcggtcaggccgtatttcaaaaatacgcgctgatggtctatggaacgattttggggcacggatcttatatggggcctgattacacggccgaagccctgaaaatctatacggaagggatgcaggattttaaggcggaggcacaatacggcaagcgctttaaacaactttcagatgaaaagcagtccaccatccggaatcacgtcatccgcgaaatgagaaaaaaccgttatgatcgcccatcagatacattgaagctgacagacgcgcaggtctacggcttgcatcaagtgcgcgatcattaccgcaaagtctttacaaaaggagacggctgggggcttgagcccggtttaattaaagaaagccacatgcctgaacgcaacagggcgtgggtcgacagcgaagaccaaatcacgcaggtctccgattttatcttttggacggcatggctttccagtacattaaggccgggcgacgacattacgtacacgaacaactggccgtatgatgaagatgcgggcaacacgatgtcattcgccgccgtttggtggagcggcgcaagcgttaccatcctcattttatttgtcggcattattttattcgtgttttaccgttacaagcttggaatgaaagaggcttaccaggaaggggcgtttccggtatttgatctggataaacagccgctcaccgcttcacaggttaaaaccggaaaatatttcgccgttgtgtcgctgctgttttttgttcaggcgatgttcggggctttgctcgcccactattatattgaaccggacagcttttttgggattgattggatcagggagctgttgcccttcagcatatctaagggatttcaccttcagctggcgatcttctggattgcaacttcatggctcgggatgggtatttatgcggcgccgtttgtcggaggccgcgagccgaaaagacaggggctgcttgtcgacattctgttttgggcgctgatcgtccttgtcggcggaagcatggtcggcgaatggctcggagcgaaaggctttttaggaaacaactggttcttattcggccatcaaggaatggaatatattgaactcggccgcttttggcaggtcattcttgcgctcggcatgctgatttggctgtttatcgtcttcagaggcattaagagcggcctcaagcgggagcctgataaaggcggtttgattcatctgctgttttattcttcgatcgccattccgctgttttacggtgctgcctttttctttaatcccggcactaatattacaatgtcggatttttggcggtggtggatcatccatctttgggtggaagggatttttgaagtctttgccgtcgtggtcatcggctttttgctcgtgcaaatgaacctggtgacgaaaaagtcgactgtcagaacgctctattttcaattgacgatcctgctggggagcggtgtcatcgggatcggacaccattactattacaacgggtcttccgaagtctggatcggcctcggttccgtcttctcatgcctggaagtcatcccgcttaccctgcttgtattggaagcttacgaacaatacaagatgatgaaagacggcggacatcacttcccgtataaagcaacgttctggttcctgatttcaacggcgatctggaatctggtcggcgccggggtattgggctttttgatcaacttgcctgccgtcagctattttgagcacgggcagttcttgacacccgcccacggacacggggcgatgatgggtgtgtacggcatgtttgccattgccgtctggctgtatacgctccgcaatatcgccaaaaaagaagcatggaatgataaatggctgaaaatagcctgctggtcgctgaacatcggcctgttcggaatggtgtttatcaatttgctgccggtcggttttcttcaattgaaaaaagcgtttgaagacgggtactggagctcaagggcgcctgagtttttacagcaggatgcagtgcaaacgctgctgacttggagggccgtgccggatacgatctttttagccggaatcgtgattttggttgtattcagcatcagagcattattccatctccgcaaaccgacgtatcgggaaggagaagcgctgcctgttaaagacattgcttcagatgaatagataaacaaaaagacagaggaagtaaaatcctctgtctttttgttttattgattggcttccgcttcaagccgcgggaacaaaatattgttttccaggtgaatgtgctgaaaaagatccgtttccaattcatcaagctttaagtaagtcagtgtatatgttgtgcatgccccttcaggaagggtatagtcattggtcactcttctcagttccttcaggatgctgcctgcggcttcatgctcttgttcaaggacgtcgatcgtctgaaccgcttctgctaagcggtccattgatcgcgtctcttcataggccatcactttcgggaaaatatgttcctcttcctggaagaggtgatgttcgagttctgttttcagctgatggaacaattgatggacctgggcgagctccggatgatggatgccatgaacccggtatacttttgtaacaaagcctgacagttcaggaagcacctcatacaggtaggcatggtgcgtatgaatcacatggtcgatcagctgtgaatacggggcttcactccagttcgtctcttttgcgtttaatgcctttgtctcttgatataatgtattgattctagctaagatctcttcttcatttaaatcctgctcttttatcgcttcaccgatcgggcggttgcccccgcagcaaaagtcgatgcgatattctttcagcagccggctggctcttggaaaacgtgtaacaatatcacccgtttttgtattttgatcaaaaactgcttccatttgtaaaacctcctgaagtgttttgtatgctataggttaaatgtaacgggttcaccgagggaaaatcgtgatctacatcacattctgaaaaaatgacagaaaaagcaataagtcagaagaaatcgggaaatagctatagataacttttcatgttggaggcccgcaatggagcatatatcctggcttacatttacgatgctgattctcgccagttaccggttaactcatttgattgtttttgataagatcacggagtttatccggaaaccgttcatgaagaagaagcagacgattgatgaacaagggcatgtagaaacgaaaaaagtgccgaaatcaaacttcggctatttgctgaattgctattggtgcgcagggatatggtgcgcgttgatcattgctgtcggatatctgattgccccaaaagcgatattcccgttgattttgattttgtcggtcgccggggggcaggcgattcttgaaacgtttgtcggtgtcgccacaaaacttgtcggctttttctccgatttaaagaagtaaaccattccaagcggatggttttatttttttgtcaataaagtgatacaaacagcagagagaacgtgtcagttttatgaacttttcacagcgatttttcccggatgcggcattttaggcagagaggaagcatctcattgtaaagatttcagtttttaaaatttagaattgagagaaaaaggatgtgcaaagtccccggccatttgttttaaaagcttgcggtcactagtattcagacctcccattttatacgaaaagaggaaatagatagattttttaagcgccaaaaaacaagaaatatggttgatagacaatcggtgaatagtttatttacaatcagttcgtgctacaggcaaggaaaggagtgaaaaatggctgcggaaaaagtattttcgaaaaataaaatcattggaggaaaaagaatgtcatatatgaaacgttccatctctgtcttcatcgcctgttttatggtagcggcgcttggcatcagcggtatcattgcaccgaaagcggctgccgcttctaaaacacccgttgctgtaaacggacagcttaccttaaaaggtacgcagctcgtcaatcaaaacggaaaagcggttcagctgaaaggaatcagctcccacggtctacagtggtatggcgattatgtcaacaaagactcgttaaaatggctgagagacgactggggcatcaatgtcttccgcgcggccatgtatacagctgaaggcggctatattgacaatccgtcggttaaaaacaaagtgaaggaagccgtcgaagcggcaaaagaactcggaatctatgtgatcattgactggcacatactgagcgatggcaatccaaaccaaaacaaagcgaaagcaaaagaattttttaacgaaatgtcaagactttatggcaagacgccaaacgtcatttttgaaattgccaacgagccgaacggcgatgtcaactggaatcgcgacattaaaccttacgccgaagaaatcctgtccgtgattcgcaaaaactctccgaaaaatattgtgattgtcggaacaggcacctggagccaggatgtcaatgatgcggcggacaatcagctgaaagacggcaatgtcatgtacgcgctccatttttatgcgggcacgcacggtcagtctttgcgggataaagccgattatgcactcagcaaaggagcgccgattttcgtcacagaatggggaacgagcgatgcttcaggaaacggcggggtctaccttgaccaatccagggagtggctgaaatatttagacagcaaaaaaatcagctgggtaaactggaacttatccgacaaacaagagtcgtcagcagctttaaacccaggcgcctctaaaaacggaggatggtcgcaatccgacttgtccccatcaggcaaattcgtcagggataacatccgcagcgggtcaaacggttcgtcaggagactctggatcgaattcgaaagggtcagatcaaaaagaccaaaaaaaggatcaggataaaccaggtcaagacagcggcgctgcagccaacacgatagcagtacaatacagagcgggggacaacaatgtaaacggcaaccaaatccgccctcagctcaacattaaaaacaacagcaaaaaaaccgtgtctttaaatcgaatcactgtccgctactggtataaaacgaatcgcaaaggacaaaattttgactgcgactatgcccaaatcggctgcagcaaaatcacgcacaaattcgttcaattaaaaaaagcggtaaacggagcagacacgtatcttgaagtaggatttaaaaatggtacattggcgccgggggctgatactggcgaaatccagatccgtcttcacaatgacggctggagcaattatgcccaaagcggcgactattcattttttaattcaaacacgtttaaaaatacgaaaaaaatcacgttgtatgagaacggaaagctgatttggggcactgaacctaaataacggcactttgacggacaccggatatggtgtccgttttcgtatatattataatggaaggaatgaggaatatttttgtaaacatgaaaggagatggatgtatgaatgaaacattgcagcaatacatgatgcttgtcaaggaacactatgacacgatcaatggaccggattacacaggcaaggaggaagacattgaaaagagaaaggaacaaatcgagctttacgccaaaacgcttcagcaaggcttttcaacagatgatgactatgatgaattcgcagatgccgtgattaaatgcgcatacggagatctgacggtggaagaattagaaacggtttatcgggaattaacgtctccataatcaataaaataagggggaggagaagcatgaaagacatgatcatgaagacagaccggcttattttgcgaaaaatgaggcgcgatgacgccgaaaacctgctcgaaatcttttctgacccgatagcaatggaatattatccatcgacaaagaatgaaaaacagacattgcaatggatcgaccggacgcttgaaaactatgaaaaacacggaaccggtctgtgggttgccgaacataaacaaacgggcgaatttttaggccaatgcggcatcgtgccacaggaagtcgaaggatcgaacgaaatggaaatcggctatttgtttaaacggagcgtctggaaaaacggctatgcaaccgaagcagcatcagcatgcaaacaatatggatttgagtcatttcatctgaaaaaaatcgtatctttacctgatgcgcaaaatctgccgtccagaaaagtagccgaacgaatcggcatgactttagaaaaaacaatacataaatggggaaaagaaattgccgtatattcagtgtatcgctaaatttttattctgtctcactaacttgagtatactttgagattgagacagaatttctttttaatccttaacttccgagaatatatattatgtaaactagaaagaaatgaaggttaggattatacaatgttcctcctgtacgacggttctttgacataacccattcttctcaaactccttctcctttaacttataaaaattgatctcttcttgtgatcatctttgtacaaaagaattgtaattttgaagggaataaacacttctttgcttgcatattcatttagttttaattgggcgcgattctccctatcaaatcaaaactcatctcaatatctatatgtcaatatagtataaattcatttggtatgatctgttctagaatccagccaatttctaacatcttcaacggtgaaaacaccgcttatcatctcaaatagaaaacaatgcctgaaatatgagagagccgataaccgcgtaatagggttatcggctttgtgtctgtacggctaactctttgacatgcgtttatcagcaacctctcggttatgtcacttgttgctggtcttcttgatcaagtccacgccatcgtatgccagactttccacacttgcagccttcagcagtatgtaatgatcaaaaaagttcttcgtatagtctgtaacaagatttcgcatctccatagcatcccgttcacctctgagttcctcattaacactggtaaacacgatgtcgcagtaatctaaatgcgcaacacgatcaacagagaaataataggtttccatgctattgttagcgccaattatcgcattcatgttatagttaggttcacaaaacagtagcaagaagggtttcttaaggtcgctgtcgagaaggccgaacgcaccgctatccaagccaatcccgcaggcgaaccggtcgtcgtcccggcaaacaatcgccgtcgtaggccctccataagaatgtccgactatgcccatgccgatgtcaagcaacaatctgcccttaaagatggaattcagttctccagagtccagtttgtaaagataatcggctacataccttacatcttctgcctgtaactcactatactctgttaacttggcaagtatcggcagtgtaagcacgttatggcacatctcaatggcagtttcatcgtcaggccgcatctccatcttaccagccaacgccagcatctccggatcttcagaaaacgccataatgacatccgaaaaatcctttgatacattaaacaggcgcccatctttacgcttatacatcgtgctattctgatggccgatgcttaccacaacatatcccatgcttgccaagtctgtacagatcactgtaccccattctggagaaccgcccccgccgcaaacatagaataataccggatagcgcttttccttcccggagagagcaaggtcgtcgtaacactgggtcttgatatctatagagaaaacatccttcaacgcagtgacaagtggctgctcattaaacatctcgtagacttcaggaaacatgtacgttgatgtagtcttaccttcgctactgtcggacggatagtacacaaacgccgtcagttctctttttgagtgatctgatgccgtgtactcaaaatccatctgggttcgaccgacagtatagccgccaattggttctggaaatgcgtcataagttttcattttcttattcccccttaattaataaaagtggcgaatgtgaaatacatacattgcgctataagcgcttttcaaaactgtgaaactattacatcctatcttcagtgaatcatatctactccttggctttcttgagatcgctaacaatttcagatatatgattcccaataattatttccaaacttgctgcttcttttaatgttaatgggtgaatatatgtgcacacctcttttaacaagatttttctataaaatttcgacaaggttctacaatacccttctatgaatattcataatatctcagtaatagtgcatcagtcgttcagaatggatccagtttactttcccaaataataatggatccacttttactttctgtaaagagaacataagagtggatccattaaatgataaaatacttatttgactagtgtttacaacgcataaaatggatctatgtttacttccttgtacaacagaagtgtattaccgaaaataaaaaaaccccattaaattagggtttttttgaacatatgacaccaagtttttcaacgaactgttaatcgataactttagtttattgttcacagaacggtttatcaaatgacgaataaaaaaacagctaccaggcatttcacctctacatatgtcaacatacacccctattttcttctgacttaaagtatggctcttttaattttggacatttgagtatcagaaagttttcatccgttttgctcccaagcctccaaattcagttcattgtttatggccgcggcggccatagcacccatcgaggcggcgacaacggcttgatgcaatttcgtagctgcatcgcctgcactatagatgcccggtatattcgttttcccaaagttatcaacgacgaccgttcccgattctgtgatgtcgcatcctatggctcgcggtaaatccgatcctgtcacaagttccgttttaaaaaagattcccttacatggaattgtcgtcccgtcttcgagaacgacttgttgcacgatcccgtcgtctgagtcgatgcatcgaatcggcgcttcgaatacagggacgcgatgcctgctgagctcctcgcactgctcgtccgtcagttgatgggggccgttcgtgcaaatcgtaaaacggttcgtccatcctgatatgagagaagcgaagtgaatggcctcgtcccccttggtaatgatcactagaggcttatcccttaattcccagccatcacagtacgggcagacgaaggcgctcttcccataaacctctgccagccctggaatatctagcggctgatccttcattccgacggcaaacagcactttcttgcttgcaaaagtgtttccttgcgcagttgtcatttgaaaatgaccgccggtttttgtaatcgacacagctttatccgctataaaagacacggagggatatgcactgatctgttcctttgcaatttgccgaaattcacttgggcttattccgtcacgggtaagaaatccgtgagctttgcgagtaacggcgttgcgtggccggcctgcatcgatcaccgccacatttttcctcgcacgcccaagaacaagggcggcattcaaccctgctggacctcccccaataatcgctacatcgagaagttgttttttcatgtatttaagaacctccatagatctttaatatctataattaattgctgtgtcgtcatgaattcatgtacatgttctgattctgtaatcggatcagaacttttccaaaacggccgccctgtcggatttccaccttgtcgtttggataagtccgttccaaataagcggcggtgattttccggttgcgatcgtccgcaggcaaaccaaacattctcaacatgtccataacctcattgagcgccgtttccctggatacctccctcgttttcatttcccgggttacgagtgattcataggtataaccttttagaaacaataaatggagcaaataggccatctccgaatgttcatttttaaggggctgatctgaaaccagcggccaaatctcattcagaagactgtgctcccgagagccggctgacagactgatatagcaaaactgccgtgcgcagctcagcaccctctttacgctctcccaatcagcaatagccgggcacatggagacaaatacaaaatcaaaagcatttccccatccctttgcttggatatctatgtcttcgaaaggctcagctacaatcttaaccttcccgtttgttattcctgttatattttctttcatcagctcgactaaaggaagactaggctccacggcggtaacttcggcccctctctctgcaaatggcactgtaaatccgcccgaggctgctccaatatctaaaatagaggtatctttaaatgtcaccccctgcccttccagccatttcataatccgttttgtccttttcctcccttcttcgttaaacgcttgctcattgaatgactttgctctaaggtcaaaatggtgtactttatccattccggcttttttcattttgttaaccgctgtctgctgatcttccttccaagcttcttcccaaacggtttctttaaaaaattcgtttatcaagatccataactcctttcattttttgctgtaaaatcaatgattaaggcttaacagactttaaagacactttatatctttgatagtcttaaaaaaataactgcggttcacaactcaacagttatttttttggcaaggtcagatattttttgttgtctcaaataattctccatttcatcttctgcagataccatcaccttctgaatcacacattctgatccatggttcaagttgcaatcgaacaaggaggctgtaccttcaattgcgtgaataatatcaagaaacgaaatgtcttcccaattccgctttagcctatatccgccattggcgcctgaagcggattcaatcattcccgccttggccagcttcgttaaaattttcgataaatacgtgggcgatacctcttgccgttctgccaactgctgtacaccgacaaatgtatttggggcgcctgctgcaagaaagagcatagtgtgaagggcatagttcgttgctttcgaatacttcatagcgcagtttttcacctcaatcatagactttacttatccatgatagcttttatatttaggcaatgtcaagtttttcatacttttttccacacttctgcaggatcaaaaggaaagaaacaaccgaagcccgatctacgtacaacattcataaaagggaactccagattttcaggtagctgaaaaggctatcacatgaaacaatgattcggggtcaactagtgagaaaaaatcttctcttgtttgacattaaagaaattagtgaacgggtatctttctaacattcatccgctcttttggctgtattcagaaggcaatccatagattaattttgcagtttaaaaatccccaaagctacgctgtgaaagcagctttggggtatggggaattcttttagcatgttcggtgtttcgcactttactcaatcacagaccaagccggtgaatcaggatctaatgtaaagtcatgagatgactcgtcgcgatacatcggatcggcataaatcgagtcttgatcttgatttgttgcgttttgatacggcgaaaacgagtcgtattcattctgtttccaaatccatagtccgtctttgccggattccttgtggtacacgttatgattcactttatttccttcatttttcgtaaaatcgtttgcgataaatattcgcgaatcgcttgctgttatgatgtttttttcgattgtattgttttttgtatcatactggagcaaaagctgtccgccatccagcccctttgtatcattgcggtaaataatattgtgtgcaatgacagaatggctggtgcctccccgcttttggtcgtatccgccgatagaaatgcccgtatacgcattctcatacactttgttgtcggttatttgaatatcatcagcatatttccctttatgttcagacgttgcttcaattccgatatcgttgccgtagaccgtattttccttaatgtcaatgctttgtcctccgtcaacatatattccgcccgcagaatagtcatcaccataggcaggatttccgtaagtggagttatcgtaaaccgtgttgttttctacgataccgtttcgcacaaaatcgttttgagcggccgttccttcatatccgatcagatcaattccgatgttgttattgtcgcgaaccacattgcctctcaccgtgaaaccgtcaatgtttccgttcagcacaaccgcttcactcgctccgagtgtcagcttttcaaccgtattgtcctcgatcttaatgtctttcatgctgccggagccataaacggcaatcccgtgggcattgccatcatccgctgttgtttttatatcccggacgtgattgtttttgatggtaatatgactgctggagcctgacacataaattcccatggctgttgcttcttctgatgaaacggaaaggtcttgaatcgtcagtccgctgattgtgatgtactgttgattgtgaatctgaatgagcggtgtttcatattccgcgtccttaacagattctccgctgatgacgactttttcattctcatagttttgaaatgtgataggcttttcagccgacccgctctctctcacatcaagcgtttcatgatacgtgccttcccgaatcatgacagttgtgccggggacagccttttttgctgcctgtttcagagttcgaaacggcttttctttcgttccttcattttgatcatttccatcgggggaaacatacaagctgttagccggttctgcttcttttgctccggtcttatcgtaagcaaaagcgatgataacagaaactaaaatacacgctgataaaataaaataccattttctcatactcagcactcttttcttttcaaaatggataaactaacaccattatagaatatcccatttatggaaaaccatcgcaaacattttgaaaaaaaaaggcaaccctggggatcatagggttgccttcatattttatgagtttattcagcacttccggagttctatgaatgagatagccgcctattccttcctaaaatcgccggaagcacccatcctaattccgatgtcatacatcgggagaaactgattgaaaaattgattaatagctgcaattttgagtccggcagcattcaggccgtcaaacaggctgatgataaaggtcaatatcagactgccttgatacacttccctcttccctttaaataaaggatgtaaaaatgttaagaatattaaagaaatcgcaatgggatacaaagttgttaaaaccggcattgaaacgttaatcagctgtgttaatccctatattgctacaagggtgctgaacattgacagaatgacagcaatttttttataggagatgtttggaaacaagccgtggaaaaacgaagagcatgctgtgatgagtcccacacttgttgtcagacatgctacagttatcattaagcccaaaaaaacggaaccatatggtccgaaataataggatgaaacctttgccaaaacctcggctccattttctaaaagacccagtttttcaacgctggaagcccccatatatgaaagcgctgaatagatcagagccaagagcgccgctgcaatcgccgtcgattttgcacaaacgattatgagctgttttttggaggccgctcccttctctttcatggcgttcacaatgatgattccaaatacaaaagcgacaagggcatcaagagtaaagtaaccttctttgaatcctttaaaaaatacgtgtgatgcatatccttcagacggagcttgaaagcttccgattggatgaataatagccgtaacaacgagcaatccgataaatgttaatttaataggagttagaaattttccgattacatcgataattttagttggattcagggacagcaagcatgccacagtgaaaaataatacggtaaatatgattaaggcaacagggcccgcatcatttgataaaaaaggtttaacccctatttcaaacgacacattgccggatctgggaatcgcaaaaaaagggccgattgctaaatagagaaccgttgtaaatacaatgccgaacaacggatgcacacgactggccagagactgcaaatcattttttcctgaaaaaacgaatgccgtaatggcgagcaatggcaatccgactccggtcaccaagaatcctgcattggctgtccatacattctctccggccatctgacccagcataggcgggaaaatgagatttcctgcaccgaaaaataatgcgaatagcattaatcctatgattaggataaatgaaaaaggaattttttttgccatcatgagtcctccgattcgggttaagctattagtgcgtttttagtagtcagcagtgtagcgcgataaaaattttcaaaataaatgtcctgaattatcagtaaatattaaataaaagtactatcctactatagtagctgttgctcgtattgtcaaaggtttagtctgtataaaaattacgtcgcactcctcctttggaattgatttgaaagtttgttacataatgtaaaaataacgatggaaagtaaattctctttttgggaggttgtgaaatgccattagggcctgcaatcatttcggtattaataggattcggggatcgtatatgtcattatgagagcggtaaggaaatctaattgatggcaggacgcctcggccccgatcccttgtcgcataaaccaaggccgccaatccctgttcggctctctgctcgttatagaacaaggagatatatagaatggtatcttcattcgctcggctgaaattgccgggtcatgcggggcaaaagctaagaaaagcggccagtcaaataaaatgactggcctatctgttattatatatgatttacaaagtagagacatcaatcacgaatcgataacgcacatcgcttttgaggacgcgctcatatgcttcatctacttggtcagctccgatgacctcaatttgcggagccaagccgtgttcagcagcgaaatcaagcatctcttgtgtctcccgaatgccgccgacaagcgaacctgcaatgctgcggcggcccatgattaaggaaaacacactgtactgatcccgttctgccggcgcgccgacgttaacaagtgttccatcggcgcgaagaagcgataagtatgcatcaacgtccagattggcggacaccgtgtttaaaataagatcaaagcgtccggccagctcagtgaatactgcagggtcgccagttgcaaagtaatgatctgcgccaaaacgcaaggcttcttcctgtttattcaaagagcggcttaagaccgttacttctgcccccatggcatgcgcaaattggatggcgacgtggccgagtccccccattcccacaacggcaactttcttgccggggcctgcgttccaatgcttcaaaggagagtacgtggtgatgcctgcgcacaagagcgggcttgcaacatccaagttcaggctgtccggaatgcggacaacaaaatcttctttaaccacgatgtattggctgtaaccgccatatgtcggatttccatcgtagtctaaacagttatacgtttggatcacgcctttcgtacaaaattgctcctctccgctctggcagtattcacattcgccgcaagagtcaacgaagcagccgacccccacgcggtcgccgacagcaaattttttaacacttgtcccaactgctttgacgatgccggcgatttcatgtcccggaaccattgggaagattccgcctccccattcatcgtacgcgctatggatatccgaatggcaaatgccgctgtacttaatatcgattaaaacgtcattcggttgtaattcccttctttcaattgtggtctgttcaaatttcgccttggctctcggagcactcagtacacgggttgagatggttttatgcagattacacatccatatcgatcctttcttacgttatattacgccaattcatagagaagaggtgcaagttaaggttaaaccttaaagttcgctttaaggcaagaggtttttctgaaatcttcttcggcttgcgttaaagtccactttaaggtctataatcattgtgtgttgtgacacatccaattagaattttgatgaatatgatggaggtttcaaaatggggtattctataaaagaagttgctgaaaaagtaggtttgcctacacatacactccgatattatgaaaaagaaggtcttctgccttttattaaaagagacgcaaatggaaaccgcatttttgaagaaaaagacttgtcatggttggagcttgtgatatgcttgcggaaaactgacattgcgctttcggaattacgggaaatcgtcaatttaacaaaagaaggagattggaccatctcgaagcgcaaacaaatacttgaaaaacataaagaaaaaatgcttgaaaagcaaagagtcctggaacgcgcctttttaaaaatcgatgagaaaatcatgtactatgatggattagaaaaaaagaatcaggcaatgtccttgaaagcggatgaaaagtaatttgataagtgccggcgcgctttcaattatggcactacattcaaaagaaatttttccaaagtctcctttgcggcttgctcatccgtaccatagaccattaacgtgatctcatccccttcttgcactcctaattgaaggatttccatcagatctttcccgtttgctgtctgcccgtttttagcgagtacgatttcacttttgaatgaaatcgctttgcggacaaatagggtcgtatgcctggcctgaagcccccgggggagccgaactgttgattttgttactaacaccataactctctccttgcttctttttcgattaaggctacgaaattcttttctaagctgcatctacagaataatcgttaaagcccactttaacgcaagggattttgtgaaatttgctgagaaaaagccgtctccggcctgcgctggaaacggcttttttcttaatttaaaaaggatgctttatatacagataaacgacctgcttatatatcccaccaaaaggtttcgggaagcgagtattggctgttcaatgcgcgttcaatcggctctttccagccgtggtatgcgagggtaaaggctccccaatgaatcaacatcatgttctttccttttacatctttatgggcttgtacagattgttcgggtgtcatatgaatcccggaccagcgtctgtcatattggccgccttccattaatgtgatatcgaaagggccgtattttttgccgatttccttaaagtgttcatcatatcccccgtcaccgctcgtataaaaacgcgtatgttttccgaggatgacccagccgccccacagggtcgtgtttcgattcaataatcctctgcctgaaaagtgtttggacggtgtcagggctattgtcaaaccttgaaactccgtttcatcccaccaattgagttcggtgattttttctttctcaattccccaccggatcaagtgtgcgctgattccgtaaggaacgaagaaatgaccggccttttccttcagctttaagatggatggataatctaagtgatcataatggtcatgtgtaatcaagacggcgtcaatcggcggcatatcattgaccgtatgcaggatgtcttcgctgtagcgtctgcttccgatgaatgatacgggtgaagcaattggacccagcatagggtctacgagtatttttttgcggtcgatgctcagtaaaaaagcggaatgtccaaaccatgttaagctgtcttcgttacttttaacgatgttccaatcaatctcagaaacagggatttgatcggaaggattgcgctccttgccgccggaaacagcgtctctcatcattgagaaaactccggatattccgcccatatccatcttttcttgtgtttgattaagaaatttgccatcggcataattgtcaaagctttgatacagctttttttgttccttgcttggatttcctccaaacacaggatgtaaattgatgaacaataaaacagccgcagctaagatgatgataaaaatgaataaaaacatcatggtttttttccttgttccttccttttcaggatgatatcttgcttcttcttattctaccgattatagctgcttcgtcgccagtataatgaataaaatgtaagaaccctccgaatttggagagttctttttaatagtgccgcgtaaaacggctattgtgtaaatgctcagccggcgattccagaccaccgccatagccttctcaggcaggatgcagcaattatttattttgcactaataaaaatgtgtatttggtgccctccggcttgtttttccaataaatcgttacctccgcatctcccttttggcgtccttcgtagtctaccgagttcatgctcggattagcatatgcatggagaataaaggggtcatcgaccgcaacctctaaatcttcgtccgaaaattcaatttgaggacctccatttatactgccgcaatagaaatgcgcacggccggaaccgccaatgccaactgtttcgtcgtatacggtgaagatgtgagttgagcattcgcttggtttaatagtaccaactgatgcagcatttgcagaaacggcatgaaaggacagaatcgtcgcaagggcaatggctagtgacaagaaatacttgcttaattttccgatgttcatgttgtcaacctctaaccaaatattgtcagtatacatattctccatatcgaaatatatacctctataataaggttcttacaaaaaaagagctgacgctaatggtcagctcccgcttttaaaaccggacagattcagagggttggaaaaaccggtccaccgcttcatcggttacatctgaaacgttccggtacttgtagttcggtgattgatcacggtcgatcaggacggacctgacgccttcgaagaaatcattgtgcttcaaaaagttctttgccagcaccagatccgtggcaaagcattcttccagtgttttttgacgtccgtccgccagctgtttcaatgtgatttttaatgaaaatggcgatttggaaagcattgtttttttcacattcgagctaaaggtgcttccctcgctttcgagcgattgaaggatctcttccagcttatcatacttaaaatgacggtcaatcgcttgctgatcacgggcgagcgtgctctcctgggagggctccgttttcgattcgcggatcagctgatcgagcttttcttcaacgcttgcaaggcgccaatcggtttgttccactgcttgaagcaatcgttctaaagcgccgctctccatgtaggcgtctgccccattgatatacagcacgtcggctgcatggatgacagacgccgttaatccaagataccgccctaagcggcccggggctttgtttaaaaaataggctgccccgacatccggaaagaagccgatattcatttcgggcatcgcccattttgtcctctccgtgacgatccggtggctggccccgtacgtcaggccgacgcctccccccatgacgatcccgtccaagcaggcgatgatcggtttcgaaaatcgatggactgccatatcgacttcgtactctgtttcaaaaaagcgctcggcatcttgcagggcctgttttgacgaacgagcttcatagagtgccttaatatcccctccggcacatagtccttttggtcctgcacctttgatgaccacgatagaaacgttttgatctgtctcccactcgtttaacttttcaccaatcagacggaccatgtcgtatgtgagtgagttgagcgctttcgggcgattcagaacaatcgctgcggcgccgttttgattgacggaaaacagcacgtcatcggacatcttgatccactccttttatgaatgatgaaagtttggtttgcgcttttcgacaaatgcgtgaattccttctttggcatctgaagtgacaaacagctcggcgaatctgtttcgctccctctccagtgcttgttccatgctttcgctggcgccctgtacgacacattcgacggcgcgcctcacgctggtcatgctttttccttcgataaaagacgacgcgacagcagctgccgtcttcatcagttcctctccctttacagccatctgtgcaattttcagctctaccgcctcttgagctgaaagcgatcggcccgtcaggataaggtcgagtgctgtcgctgtgtccgttatgttgcgaagccgctgtgtaccaccaaatgcaggaatcaagccgagctttaattcgggaagaccgactgttgcatcgtctgatacgattctgaagtggcagctcatcgcgagttccaggcctccgccaagagccggtccgtttatcgccgcaatgacgggttttttggaagcttcgatttcatcgcagagcgcctggcccccttgtgcgagcgccaatccttgtttttggtccccaagttttgaaacgaattcttttatatccgctcccgccacaaaaaagcggccttctccagtaatgatgattgcttttgtctcctcgtcgcgggccaattcccgaaaaagagagcgcaattcggcgatacaggaagaagaaagtgtatttgccggcggattgttcaacgtcacggttgtgatgccatgttctgttttaagtgtggcatatttcaagttcaatattgatccctccctgattaaataaaaaaggcccctctgaaaaaaaatcagttgtgcatgagagggagccttatgttaaggattagaaccagcgttcggtgacgacctttttacgcgtgtaaaactggacgccgtcctttccgtttgtcccaagatctccatagaaagaggctttgttccctgcgaaggagaagaacgccatcggagccgggacgttgacattgacgccgatcattccggcatcgattttgtcgcggaactgctgggcgcttttcccgctcgatgtgtagatgacagcgccgttggcaaacttggattgattggcgagctcgatcccctcgtcaagatcttgtacacggacgacgctcaagaccggtgcaaagatttcgtcctgccagattttcatctctggtgtcacatgatcgaaaatcgtggctcccacaaagtatccttctcgaacatccggattgcgtccgtctacggcgagtgcggccccttcttttataccgctgtcgatatagtcaaggacgcgttgtttatggacttcgcggatcagcgggccgacaaagtgatcctcggatctgccgtctcctgtcttcagcttccgtgtttcagagacgagcatttccatgaagtcatcggcgatgtcatcaacgaccgccgcaacggagcaggccatacagcgttccccgctgctgccgaatgccgcaccgatgatgccttgaacagtcttttcaagatggcaatccggcataacaatcgcatggtttttagcgccggccagcgcctgaacgcgtttcccgttggctgtgcccgtttgatacacatattttgcgaccggttctgaaccaacgaaggagacggctttaatatcatcgttctccaatattccgtttacaacatcctttcctccatggacgaggtttaacacaccttttggaaacccggcttcatagaacagctcaacaagcttcccggcaagaataggagtccgttccgaaggtttcaggacgaacgtgtttccgcaggcgatggcgagcggaaacatccacaggggaaccatcattggaaagttaaacggcgtaatgccggcgacgactcccaaaggatagcgccaaatcgatccgtcgatgcccccggctatcgcgggcagggattctcccatcattaaagtaggtgtggctgtcgcaagctcaacaacttcgattccccgctgcacttcgccgcgggcgtcttttaacgttttgccgttttccgtcgtaataatgtctgccaattgttctttttgctcctggagaagctgtaaatacttgtataaaagccttgcccgattggggacgggcacaagcgaccaggtctgataagcgtgcttggcagcctgcacggcacgatctacatccgctctcacagatagaggcgcataagcgatgacgtttccgtttgcaggattgacgacttcttccgattccgcacctagagaattgacccattccccgtcgatatggttcatcattttttttgcattggttgtgatcatttgatttctcacctctccttactgataagttgtcttctgttcgcttatttttttgtataaaacagacatatctttttccccgtatccgttctgatcggcttcttcgtaaatgccgaagagaatcttgctcaccggcagttcaacgttgttcttctcagccaaatccaatgcaaagccaaggtctttcagcagcagcttcaaagaaaagccaggtttatagttttcatccgctatgaaacttttatagttgcgctcatagatccggctctgcccatagctgacgttcagcatctcaaacaattggtcgaggtcgagattgctgtttttggcaaggtgcaaggcttcactgacgccggctgtataaaaaccgattaagaggttgttgatcagctttgtattcgttccgctgtcgatgttttcgttcacatgaaaaatattctcgcccaatgcattgaaaacaggcaacgctttatcaaaaacggacttcggacccccgaccataaaggtcagcgtccggttgaccgccccgatcacaccgccgctgaccggcgccgcaagaaaatcgatacctttgcttttcgcttcctccgcaattcggatattcagttcaggagcgaccgtgcttgtatcgatcaggaggacgcccggttcagccaggtgtacgagccctttttttcccagaaaaacctcctctgcagcgtttgaggaaggaaggcttgtgaggatggcgtcacactcttcaaccattttttcaactgaaatcccgatcgttcctcctgcatgatgcaaggccaattcagcttctttgttaaggtccattccataaaccgtaaagttctcctgaagcagattcttcgacattggcagacccatattgcccaaaccgataaatccgatttttttcaaacagtttccctccgatcacaccgtatatttttcatgagcggctattttttctgcgatttcgcgtttttgagtaaacagattgctgaaaagaggcaaagaaacgctgcgagcctcttcaaatgcgagttttctttcggcttcatcagatgctatgcttgataaggcggtcaccgccatctcttcgattctgcggtagccttcttcacaaatgacattcgtcatcatttctttcaaccgtgctttttcaccaccgtatatttgcctagctttttcggttcggcgggcggcggattccatcacatagatttcttttttcatgtcggcgagaagccgtgcgtattcctgatcttcttgagtgttcacgcgagagcggataagcgctttcagtgtcttgccgaaaagcctgttggacagctgaataaatcgccggtttcgatttccctcgctgcctagttgagcttccggctctgagatgccgttttgctgcacttctttcatgagcagtttggcgatcgttaagcggtttatttcatttgtcccctcgaaaatccggctgatcctcgcgtcccggtacaatcgttcgacttcgtactcctgcatgtatccgtagccgccatgaatctgcaccgcttcgtctgcgatccggccgaggatttcggagcagtaaactttattgatcgcacattcggatgcatagtttgtgagttttctcagtctatcgtctaatgggagagccgaatctaaaacattgtccaagcaatctgccgttctgtaagcagcgctttccgcgccgaaaatcgagaccgccatgtcggcaatcttttcttgaatcattgaaaaaccgatgatcggcttgttaaattgctttcgctgtttggcgtagctaacagcaaggttcaatgcttgttttgccgttccaatgttcgaaaacgcgagctttaagcgggccatgtttaaaatgttcaaagcgacgtgatgacctttcccgatatgacctagaacattgtcgcttggcacctcgacttcctccaagattaaggttgctgtcgaagaccctttgattcccatcttcttctcttcaggtccgatggaaacacctttaaacgagcgttcgacgataaatgctgtcatgccttccgccgtttttgcaaagacaacatatacatcagctacttgcgcgttcgtaatccactgcttttccccatttaaaatccaggctgtcccttccctattcaagacggctgtcgtttttgcgtttaaagcatccgatcctgcgcccggctctgtcagagcatatgctccgatccattcgcccgatgccagttttggaaggtatttttgtttttgttcctctgttccataataaatatacggcagtgtcccgactcccgcatgaatattaaaggagacgctgaacgatccgccggctcccattttctctgccaccaacccggaaagcttcttgctgagtgaaaggccgccgcaatcctccggaacttcgatactgagcaaaccgagctctcctgctttttgaaacaattttttcacgctttcgtgatcctgctgatcaatcgattcaagaaggggcatgacttcgtttttgacaaatgattctgtcgtttttgaaatcagtcgatcttcctctgtgaaatcttccggtgtaaatccttcagcagccgattcgtgttgagaaatcaagggttcattccatcgaagttttgctttccccattgcttacctcctcgcttccgctaaaaagagtgataaaccgagataaaaagacgatgaatccgcttacatttttgctgatacgaatcatcgtctccttttctcatccagataaggaccaaccaattatgaagggcacggttgtttcggtcatttagcaggcttttcttgccagacgccggaacataggaccgcctttttgtttcatgaagcagctgttccgcgaaaagtcccgggcagtgcagctgatgaaagatatgaagcttttaatatcagcttatcaaataattggaagatttccaaatgtttttttggtttactctattttacttgtgaaagcttgggaatatgcattgtcagccctctgtgaacacgtcttggcaagtcgagattattttttttgcaaaaataaaacagaccatagttttatggtctgttcagaaagggcgccgctgatcgtttattcaattgataagcttgagacgatacattccgcatggccggcgagcgtaaattctccaaagccccagggcagcagcatgtgatctccttttttaaatgaaaagttatggccgccagatgcgatgcgcccttccccttctatgacgctggcaagaagaaacggtttatcctgtttgaaacaggccgatccttttacatcccatttttctactgagaaataaggacaatcaatcagtgcggcagtcttgacgtcgcccgatgtttcgtattgaacggtttcgcgatcaggggaagacggaacgtcgatcacttctatgcttttttgcaaatggagctcgcgcaggtttccttcagcgtcttttctgtcataatcatatagtctgtaggttgtgtcagaattctgctgcgtctccaaaatcaaaatgccttttccgatcgcatggacggttccgctcggcacatagaagaaatctcccggcttcactttgacgcggcgcaaaagctcattccattttccgttttcgatcattgagaccagttcttcccgcgtcttggcatggtggccgtaaatgatctccgcatcttccttgcaatcaatgatataccagcattccgtctttccaagctccccgttttcgtgcagctttgcatattcatcatttggatgcacttgtacggataggtcttggtcggcgtccaaaatttttgtcaaaagaggaaagcggtctccctttatatgtccgaataaatgacggtgttcatcccataattcgcttaatgtgagccctttatacaagccgtttttcacgacgctttgtccattttgatgtgcggcgaaagcccagcactcccctgtttgttcggatggaatgtcatagccgaaagaggctaaagccgttccgccccatattctttctttaaaaacaggctcgaaaaataacggttcagtcatgacgggcgtcctccttttttagatgatttcatccagaagtttgtatgcttcttcttttgtttgggcagagagaagcttgtcccggtaggtgtcatccatcagttttctggagagcatttgcagaagcttcagatgctcgtttcctccgctttctttcgggacggcgatcataaaaatcagtttggcgtcagttccgtcaagactcctccagtctacgcccgaacgtttaatgccgaatgctacactcggcttcttgacggcatcagacttcccgtgcgggatcgcgatattcataccgatcgccgttgtaccctcaagttcgcgattgatgatagcttgtttaaattcgctttctgaatgcagtacgcctttccgggacaatttttggatcatttcatcaataatgtcgtctctcgtatctcctgacaaatgaggttcgatcaaatctgtatcgatgatgtctgtgagctttgtaatttccggcttttcgatttttttgctttccgcttcgatttcgatgttcggttggggaatgtcgttccctgcagcagcttcacttatccctgcgggtgcagctgtgacctcttttttgagcacattgaccaaaagagaggtaaccagggatccggcaataacagcgataaagaacatcaacacatgatcgacagcgccaagcaccgctacgatcggtccgccgtgggcgactctgtcccctacattaccgatcatggcgatcacggaacctgtcattgaacccgccataatacttggtatgacgcggagcggatcctgtgcagcaaacgggatggcgccttcagtaatgccgaataatcccattgtaaatgctgcttttcccatttctctttcttgcgcctgaaattttcttttccctaaaaacgttgcgattccaagcccgatcggaggaatacaaatggcgacggcgatcggtcccataatttcatagttgccttcaccgatcatggccgagccaaacaagaatgccactttattgacggggccgcccatatcaaatgagatcatcgcccctaaaattaatgccagcagaatcgagcttgagccctgcataccagccagccaaaccgtcaatgattcaaagatttgcgcgacaggcgcgccgatcagcaatacgaacgccaagcctacaatgagcgaggaaaccaccggtatgacgatgatcggcatgatcggctgtatggcttttggcacttttaattttttgatggccagcgccgcatatccggctagaaagcccgcgataatgccgccgaggaaccctgcaccgctcccgctgccgtaaaagcttcccgtcgctgcgatgtatccgccgatcattcccggcacaagccccggtttatcggcgatactgtaggcgatgtaaccggctaaaatcgggatcatgaatgagaatgaggctgccccgatttgctcaatcgttttccaaaaagaatcatcagggatcactaaccctttcggcgtcttttcgcctccaagcgtcaatgcgaccgcaatcaataatccgccgacgacaatgaaaggaaccataaacgatacaccgttcattaaatgcctgtaaatcggattttgctttttctccgtttgagcggaggcttccgttttcacagccgaacgatagacaggtatatcgccgccgatcgctttttgtattaattcttccggttttcggatgccttcctgaacaccgacagccagaagtttttttccgataaaacggtctttgttgaccgagcggtctgcggctataataatcgcgtcagcctcgcggatttcctgctcggtcagctcattttccaccccgatgccgccttgtgtttcgactttcatttgaacgcccattcgatcggccgctttttgcaaattttccgcagccatatacgtatgggcaatgccgtttggacatgatgtaatcgctaacagtttcatgcgaatcctccttctgaaactaaagtagtgagcagctcttgtcattactttataataaaaacgtgcgtgtaaaagcgttgttttttaccgcaggctccggaaaaatcggtttttttaaagcaggactgcagtgagcggcgacttgtaaaaacatatgggactgaatttgaaaaaaatgtgccgtattgcaatagggagctgaaatttgtcgagggggtgtaaacataggacatcctctttatgaaggttattttgatgagggtattcgaagaaaaccccagtgaaaagaaaatatctgatggtattgatgaaatggggatgcttctttaaaaaatatctcattcctagtgcccgaaagctctgattatgatttaataaaaaattaagaaaggtatgatatcaatgatgagattacttattagttttatattcggggctttaggggcagttataatgtataacataaaatcaaacttttctttccctgtgacaacaattgttttagtggtttttgtggctgcttgtttgcattttgacctggttaaacgtaaaaagagcaaagatcagaatgataaaaagtatgagtttatatggtggatcgcaacaattctcatggttctagtgatgactcttaataccgtctttgtaaaaattgaccctaagtataatatcatcgttgtattgattcacattttgtttatggtgattattaagagtagatggaagaaagctaagacagactaagcagatgggcggcctgcttttttcgtaccatctcggcagactctttttccggtgtccgcaatgtttttcaccttcaaattcaaaataaaaagacatccatcaggacaccttttctttctctttttcagcttttgcttgttatacagaaactagacaaaaaaagtaacaatttctatgctcttcatcaaccagtattcagctcgtttcattgtgaaaaattaatcatcctattggagaaataaaaaagtgtccaaacctgttgaattagaaagaaatctactcctcactaattcatggctctggacaaatatttcaaaagattataaaggacgccgaaatagacgatatattcgttgatgctgaaacagatttcatcatttctttttataatacagaataattatttaatcgttcctctaactcatgaatccttctttcaagctcagagaacttcttgtcgttgtatctatgatcacgttcaatgtttcttattgattagtttaagcatggatatgactttttcaggatcgttttcctctatgcgtgttaatgttttgttgattgtatctaaccgctcgtttacgcttttgaagtcttctttcatttccttttgcatttcgtagatcgcttgcaaaacttgattatccaattcgtccatccctttctattgattatatcatcatcctaatgattgtgtttcattttttggaatgctcctttccctattgctaatgtgtttattctttctcaacggtctacttgcactataaaactccacttctttttcagtggggagctataaattagagatctttatataactcatgtttaatccaaagttcgaagtattgagtagcctcattaatctttaaatctttgcttgttattgaaagtatattgcaaccgaatggatcgatttttgaaaaactcaaaggtggctcatctatcccatgatcctgaaagttaaaatacacgtcccacacatcgatatctaggcgttttaatcctaccgcttcaagatctaatccctttttattgtaactaatatgtagatgttgtgcttcatcataattcattaggaaaccctacctttagaaaaagatatgatgttttttcagttgggcggcacggtggaaatgaagtgataaaggccttctaattgaattttgataaaggtcagcgccccgcttttaataatccaaataagataagaacttcatcacatttgtttctttcgtcagcttttggatgaaggccggctgctcgcttaagctggacagctcttggaacaattgttttgtcatgttttgatcctcatgtttgacagccagcataaagacgagcgatactttttcagagccccagtcaagcggctcctttaatgtggcgatcgcaatggctgattgtttaatcaatttggcgttcgcgtggggaatcgcgatgcccgctccgatgtttgtcgccgacattttctctctcaagacggcgtgtacggcatattctttttccacatagcctttctcgtataaagcgattgccagctgttcaatcagcttgtagcggtgttctgactcttgctgcaagaaaacgagaaaaggagtcgtgtcgttcagcactttaaacgttttttgtttttggcgggtcgattcaccgagctgatccataaagtcgctgagctttttctcatcagccgactcgagcagcggtgatacaacaatatgaggaattgataaatcctccaggctgaccgttgatatgacaagctcgatatctttatatcttgcagtatagtccgccaaatctgctttcgcgatgcagtccatcacggcaatttggtggaatttccgttcgatttttgtccgcagcagctgtgacattccgatgcccatatgacaaacgatgatcgcttttttatgcttgtcttttccatagctgaagcgctcgatcgccgcttggaaatgcaatgtcagataggcggcttcttcctcgggaatcgaaagtgaaaacgtttggttgatgtcttcaagagcatcaatgacaatatgaaacagataagggtacatttttttgatatcattgagcatcggatttgatacggaaaggtcatagctcagccggtttaaaacggtattaaggtgaactttcaatccattgatcaaaacccggtcctcgcggaaatccatcattttcaactctgatacgcgattgattaaatattcgacaacctttggaagcaaagggttttccagtccgctgtccccttcttttccaaatgggtagcgaacttttccgcctaatatatgcaatgttaaatagacggcctcttcttcaggaaagcggatcgcaaaaacagcttccagccgttttaaacaggcaaacgtccactgaaattcttttttctttttgactgcatcgatttcccccggcgaaatggtgatcggctgtttcattttgatgcggcggatcatcagcaatgtatgcaacagtaaattttcgaacgtttcatcagtgaaatataaagaatgccgcctttgcaatgatctgatctcacttttaacaaattccacttcatggcttaaaaatttacttttaataaatcggcttgtaaactccgggttgtcaatcaactccgagatgcgcgccagcgcttttctcttatttttttcacttccttcgatctttaaaccgaggcgctgcttggataccagtgtgaggccaaaccgcttcagccaaacgtcaattttattcaaatcccttttgatggaagacttattcaagaaatgctcggcagccatttcttttgcagaaaccggctttggattcattaatagctgataagcgatttgcagcattctttcttcatcgggtagctgctgtgcggcgtgatgttcggtatataattgccggcttaaacggactctttcttgatcttcaatattcaaataaacgcccaatcccggtttgcgaattaattgagcatcagaatgctgattgagatagtcttcaatcgttttcagatcatttctgatcgttttttcagaacactttaccctgtctgcgaaatcttgtacgactaaatagtcatcaggttcagataacaacagattcagaatgtctttttgcctcgtattcatatctctctcacctgtttttctatccttcccgtcagtttcacttaaaagaaatgttagtataagtatactatatacgtaaccgtttacattatacagtgaaataaaagggccaaaagtttcgttttttaccgaaacttccggaaaaaatgcttttaatcaactcggaaatttttcttttataggaattttttataatagatgatagtgaggggaaagagaaaagcagacggcagaatgaaaacagccgcacggttctgagcaacggaaaaaggatcaacggtgctgctcccgccgatccttaaacattaaaattctcttttattataaaagctgagcgatatcgcgtatgaaacggagatcatcacgagcagtacaccaaccaaaaggatgaatgtacccgcatttgacattccgctcagaaaagccgttaatttttggctcaatgcaagggtctcgtccgcgtctataaatttaaaaaaggctgttcctccaaaaataatgaagaaaaatatgaggatattcgccattttggacttcaaatagccgtacttaaaaatcagcggaaatgagatcgagctaaataaagtgacagccacaacagcacccatcgctcctgaaaatgtcaatgggaaatcaagcggcaagtgcagcaaatgtccgaccgcattgatcaaagaatagaagagaatggcataagccgcatagacataaaccgatacatatttcgataatacgatgatgtttcttttaataggcaagctgatcaggattttgtcactgttgtttttgtcttccaaggagcttgcgcctaatgccagctggtacgtgacagccaatacagcgaccgtatatccgacaagctcaagctgcgacaatgtaaaagtgaaaaaaatcatcaataacagcgatagcttcattgcccttttctgcattaaaatatcttttttaattagatgatacacgatgatcactcctgccggttgaaaataccaaaatatcttccaaagtgggtttttctatcatgacggaatccccgaaatgctgaacgacttcccgcttatctctggagagcgcttcaaaaccatagcggtttttcttgatgccgattaaggcgtcttcgttccctttgcgcagcgtatcgaggtctcctttcacaatgcagtactcctccaacagctcatcctttgtcttgctcagcacgagccggccgttatgaatgaaagtaatatagtccgctactttttctaaatcagaggtaatatgcgtcgaaaagaaaatcgacttgttctcgtcctgcagcaatgtttgcagcacgtcgaggagctcggacctgacaagcggatccagtcctgatgtcggttcatccatgatcaataattcggcatgatgggaaagcgcgaccgccaatgagaatttcatcttcatcccttttgacaagtttttgatctgtttgtttaaagggagctggaagtcttttgcgtaccgctgaaaaacagcttcgtcccactttttgtaaaacggtctgatgattcctttcatttcgtttggtgtcagttcttcgtaaaaatgattttcatcgtatacaaagccgattctctgcttgatttcgatattgtgtttttcattgtcgagaccgaaaatgctgatgttcccttcgtcttttttgatcaggttcatgatcagcttgatggtcgtgctttttccggctccgttcgggccgataaaacccataatataacctttctcaagcgagaagttgatgttttttaaagagaaatcttgatagtgttttgttacattctttaattccagtatgctggtcacttttaccactcctcataaaccagtttgagcatctcttggagttcttcgtatgtaaagccgatttgtttcgcttcagtaacggcttctgctatgtgttcttcgattaatttgacttttgtttcccgcagcatgtccttgttaatggctgcgacatacgagccctttcccgcgactgtgacgataaacccttctctctccagctcgtcataggctctttttgttgtaattacgctgattttaagctctttggccaggtttctgatcgacgggagcgcctctgactctgagagttctcccttgacgatttgatcttttaattggttgacgatctgcaaataaatcggttcatcagatgaatttgaaatgatgatattcaaagcatgacatccctctattcgttataactgtatatatacaatataaacagttataacactgttgtcaaaccatcacaaaacaatgcatattatttgcgatggttttgtattacgtagcagcagaaaacctcctgtttccagcatggcagatcatacaaaaatgttgtttatcttcttgtttgtaaaacggaaaagttgaaataataaatcccaatttctcaatgtgacacagagaaattgggatttttatcagtgttgaaaatcagctttttggagctaaccccgttagttatactccagaataggcggagaatcctccatcgaccggtatgatggttccagtgacaaatcgcgaggctttatcgcttaccaaccataataacgttccgattagatcttccggaaccccaaatctatccaacggcgtctggttgataattttttgtgctcgctccgtatatgttccgtcttcattgagcaataggctcctattttgggcggtaagaaaaaagcctggggcaatggcattgacacgaattccgacttttgacatatgcacagcaagccattgtgtaaagttactgacggccgcttttgcaccgctgtaggcgggaattttcgtcagcggcgtataggcgttcatggatgagatgttaacgatcacatttccgtcgtgatcagccatgtcttttgcaaatacttgagtggttaacagtgtaccaagaaagtttaaatccaatacagaccttacaccctctatttctaaatcaaaaaacgtagtcaattctttagtattcaagtcttttttatataaatattctttatctgttgttcccattggatgattgccgcctgctccgttaatgaggatattgcatctgccgaatgttctgttaatgagttgtttcgcttgttcaaggctttgtttatcaaggacgtttgctgtaacggcaagtgcttcgcctccgttttcttggatatctctcgctactctgtctgccgattcagctcttcggctgactactgctacttttgcaccgcattgagctaatgctttagcgaaaccgctgcataagatgccgcttccacctgtcactacagccaccttatctttcaagttgacatgaaaaggaatctgcacatttatccctcgtctctgcattttagttagtgcttgttcatttattgcattctaaggctatccgcttcttttctttcgtcaatgtttcccacattccatttaaatacactgcaccaagcgcccggtcatataaaccataacccggttttccggtctctccccaaatcatccttccatgatccggtctggctggtccggcaaaatctatatctcttaatgctcttacgatttcatacatatctaaagaaccgtcttctgaacggtgggaggattcttgaaatgacttttccccgatgatcttaatgtttctcaggtgcacaaagttaacttttcctttttttccgaaataacgaatcaattccggaatatcatttgttgacttcacacccagtgacccgctgcataaacacaaaccgttaaaggagctgtcatagagatgaatcaatcgctccaaattctctttgttcgttatgattcgaggcagtccaaagataggccatggcggatcatccgggtgaatcgccattttgacttgttcattttctgccgccggtataaccgctttaataaaatacgaaagattttcccataaatcctcttccgtcatgtgctgatattgttgaaaaagattctttagctgtccatcttcatagcttgtgtcccaaccgggaagttttagttcaccatgtaatggattcatttgtctaactttttcttcttcataaattaatgctgtagaaccgtcttctagtgcatagtctaaagaagaacgggtccagtcaaagaccggcatgaaattataacaaacgattttaacaccggcttttgccaagttgcgtatcgtcgttttatagttttcaatatattgatctcttgtcggaagacctaatttaatatcttcatggacaggtacactttcaatgacacttaacgataaaccatgattttcaattttttcttttaactctacaattttctcataaggccatgcttcccctacaggaatatcataaatggccgaaacaattccagtaacgccgggaatttggcgaatatactctaatgtgaccgggtcgctgtctccataccatcgaaacgtcatttgcatggttcccccatcctcttccctcttattatttaacattcgatatcatcatttcgcatgaaataacaatatattggaacgatttttttcaaagaatttgccgattagtatccgcttacataaaattttcatgatcatgattcatgtatcgtgctcgatgacaaaattcagctggccgggatgtaaccgcggacaaagattcctgctcgaattaatggaaacatcttcatcatgtggccttaatcttttaatcacacggcaaactgtaagaaaacgctccgtttttgctttccagttctgtgccatttacgatcagttttctcttttctccatttggtacgtgaaaagtgagttgatcatacgataactcgtatgttccttccttttgtattgaaagtttgatcccgtcttctgttgtctccatatcgacatgtataaaggcaaatgtatgagtatattcatttgttaacccatcatcttcatacaaacgataagtcgattttccttttcctttgaatgggaataacaaaaatcctctttcatcttggttctttgtttggaatgtcacttttgcatcatttaccggaacgatcgctcccgctttcgctaatagcggagtataatgtaatggtgccggcagaacgactgtcttccctccttcataccatgttcccgtatggaaatcataccagcctttttcatggttcggtaaatatacttcccgctccgtcattcctttttcgacgacagatgcaacgagcaaagattcaccaagtataaattcatcgttctcttcaaatgttttctcatcatgttcaaaatcataaaatgtcggtcgaatgatcggctgataatgttcgtgcgcctcatatagcgcggtgtaaatgtaagggatgatcttatgtctaaacttaatgagttcacggatttcatcgattgtttctggaaacatccatggttcattaactgtcccgtcatcgttccacgaatgaatggtaaatctcggatgcatgataccgttttgcacccatcttacgaatagctccggttcaggggccagtcctgaaaatccgccgacatcatggccgaaattgtaaatgcctgataaacttaaaccgatgccagttttaatattaaattttaatgttttccagcttgttcggttgtcaccggtccaagtttgtgcataacggtgcatgccgggacagccggatcttgagatcaggtacgggcgtaattccgggttgtattctagctgcgcctcgaaagacgctttcatcatcaaaagcgggtgaagcgctcggatcagttcaaattccacttctttgccgaagccgtgacacttggcattttgactccatatttcaaattcgttattatcgttccaagttgaatcaattccgtattccaacagcttttctgttacttgagccttccaccagtcgaacgtttggcgcttcgtgaagtctaaataagctccgatatcatcccaaaattgggccatttccggtttttgtgtttctctgtttacaatgaacatgtctttttcttgtagttcatcaaagtacggatgatcctttagcaaacacggtttaatgttggcgcataaacggacgcccttctcatggaagtgttgcaccatctcttttggagcaggaattttgatctcatcccagttaaagacataacgtttatcaccgatagatgtgtatcctgacgataactgaaacgaatcgcataacatatcatgttcttcacaaagacgaacgaaattttttaattgttcttgtgcatttggcgcatcggtatagctcatcgtagagcctgaatagcccaggctccattttggcggcaagatcgttttgcctgtcagccaagagaatgtttcgactacatcttttattttcggaccggctatgaagtagtagtctaaatcccccttttcggcctgataatagcggtacagtccatgatagttatcaagctctgaacccatatcaaaaatggaagctgatagattatcatagaacattccataggagatgcctgttttcttatgacgtgtaatatagaatgggatatgtttgtatagcggatctgaccgctctgcgtcgtaccccatcgcgtcgatatttaacatccggtagcgtttcccgtgtttatcgacgtttcccgttttctcgccaaatccaaaatattgttcctggacatcgcgttgtaaataatggtacacgccctttccaaaagccccttcaaaattatacccttgtgtttgccgatcgtttgcaacattgatccattcagaaccattgtgataaaaccagctgatcctaaagccgttcaattgaacatgaagcttgaccttgccggttttcacgataaaaacatctttgacttgctggaattcgtattgaggcaatgtaaatccgctcatgtctaaacgatggcgtccctcccatggcacatcgatctgtccaggcgcgacactccacgttttttcaagcgttaacgcttctccctccgtcagcaaaatccgaattatatcttcttcaagaatgaatattttcgcatgtgcatgaccgtcattcaaatgaaaatccagcacattattctcttctttcataaatgtaaacatataggtttctttaattgacattaaacagacgcctcctgtcttaaagtccaaataattgaggcaacactaagctgatttgtggaatgtaggtaacaattaaaaggacgatcatgatcgcagcataaaatggcagaatcggtttaaccactcgttcaatatcaactttacctatgctgcatcctacaaacagagcacttcctacaggaggagtgatattgccgatacaaaggttaaatacgatcataattccaaaatgcacgggatccatgccaaagctttcaacaattggcagaaagattggagtgaaaattagtacagccggagtgatgtccataaatgtaccgattattaataagatgatattcatcatcagcaggatcaaaattgggttatctgtaatccctaaaattccattgctgattgccgtcggtatgcctgtaaacgccatgaccaatgacagcatcgttgatgtcccaaccaaaaacataataacggctgtgatttctaccgtttccagcagcattttggggagctgtttccatttcaatgtcctataaaagagcgacaacaataaggaataagccaccgctattgctgctccttcagttgctgtaaatacaccggcgataatacccccgattacgattacaatgagcaacaggcttggaatcgcatcgagaagcactttaaaaccttgactaatcgtaatctttggcgcaacagggtattttttcttttttgcaatcatacaggcgacaaccatcgtagccagcccccacaagattcccggcaaatagcccgccataaataaagcggcaacagatgttccgccgctgactaatgagaaaatgatcaaaagaccgctaggcggaataagcaaaccagttggtgctgaagcaatatttactgcggcagagtaagtccggtcatatccttccttttcttgaagcggcgacatgaccccgccgattgcagcagcagcagctacagacgaaccggaaatggaaccgaataacatgtttccgacaacatttgtatgggccagagaaccgggcagcctgccgctgatcaattttgcgaagttaatgagccgcattgcaataccgccattattcataataatgcctgataaaatgaagaacggcaccgctaataaagcaaagctgtcgattccagtgaccattttttgcgccgaagtgaaaatggcaacatcaaaaggaaaaatggtaagcattgttacaatggatgccgccgcaatacttacagaaatcggaacgccgagaaacaacaatatgaagaataccgccgataaaatgagaccggctgctatggccatatcatttcacctcttttttagttttcaaaaagcctcagtcacatctttgctgctttttttacatcatcacctgacttttgttttgaattgaattcatgtaaagattcatataaaccggccaagctgtatccaatgatgagtatgcctgcaacaggaagtgatagataaacaaatcccaccggtatccctaatgctgctgaagattgctccattgtggtgatcactgctttcgaacctcctaacaccaacacaatcagagcaaaagcaatcaaaagaatctgaatgaaagtatgaacgaaaacagctgcttttattggaagttttcgaacgataaattcaatcgccaagtgcttttttttccaaaatgcataggcaccgcctaacatagaaatccatatcagtgaatagcgtaaaaattcttctgaaaacgtactgggagaattcagtacatagcgcgtaaatacttgccatatcgcaaccaaaaccatgatggccattagtgtgcaagtcaaacattcaatcgttttattcactgctttttttaaagctagcatatacacccctcccttatcgaaaaatattcgagtcgctcattcatccagagtcattttacttttttagctttcgaatttccctatagtattttccgatcaattcttttttggcaaactcatcatgaagcgggcttaccgcatcccggaatggagtcttgtctggcttgtggaacttcactcccatttcctttgctttctcaaccgcattttcagtttcttcagcccaaacgattttgtgatactcagtagactctttcgccgcttcgatcaccgcattctgctgttcttcgcttaattgatcctttttgtccaaattcatgatcaaaatatccggaacgattgcatgttctgagtatgaatattcttttgccacctccccgtgattgctgcttgttaaagccatttcgttgttttcggtgccatcgattacacttgactgcaatgctgtatatacttctccataagccattggagtaggtgctccacccatgagttccaccattcgaatcgctgtagcactcggctgcacccgaatttttaaacctttaaggtcatttgggtgcataatcggtttgttctttgtgtaaaagttccgtaatcccgcatcatagtaggttaatccaataaaccctatgtttttcgttgtatcatacatttcttttgcaatatcactgtccatggcttcatagaaatgatgtttgctgtcaaataaataaggcaagctgaagatggagtagacctctgaaaaactttctaaagcgcttgcacttactttagccagatcgacagccccggtctgtgtcaattcaatcacttcacgttctgaaccgagctgagcatttggatacacttgcactttaacggtgccattggttttcttttctacgtcttttgaaaatttgagtaaagacttgtggatggggtgttcctcattatggttgtgagcaagccgtaacgttacggttttatcgacgcctattacatcgctgcttttacaccccgtaagcattccaaagattaaagcgcatacaaaaaacacggatagcatatttctcatgaactaccctccttgaatctcataaccgttgctttctaaccaatgattgattgcgattcatgttttctttcatcgccatatttttttggtagcgtttacaattccgctcgaatagtgaacgaatatgtgaaatttttgcattgtatgtttcggtttatcccctgaatcccgtttccaattatgttctgtaacaatttgtgtaatattttagtgcattagatgatcgtttttctcacacatctcctcctttacgataagtttaacaacgttgttaaaaataaacgttgcttcatcatccgaaaaattctttaacaacgttgttattttcttcggaagatgtatatgattgttattttatgatgtatcatttataataacaacgttgttatttattatcataaaattatttttgaaaatttgcaatattatatttttaaagatgttttggagggtccaaaatgactgtaaccattaaagacatcgccaatgcttccggagtaagctattcaacagtctcaaaggctttaagaaacagccctcttgtaaaaccggatacaaagaaaaaggtcttgcaagttgccgaacaattagggtatagtccgaattttgcagcgagaagcttggcatctaaaaaaagtcaaacgatcggtcttgtctggcctaccattgaaagaatcgctttatcagcacttgttactaaaataaatgaagtggtcgaaaagaacaactattcaatgattttatctgttaacagagctaaagaggcagtggatttgtttaagagttttcgcgtggatggaattatgatttttgaagaaggcggcgaaactcagcttagtgatgatactggcttaactattcctatcttatcttacggagtgtcaggtgaacatacacatcctattatcgatgtcaatcataaaaaagcaatttacaaagccgttgcgtatctgtatcaacttggccacaaaaacattagctacgtcggcgacctctcccctgccgacaagcgtcaggttgaaaaaagcaaagggtttgaagaggttatgatggaagccggtttgaaattaagtcgaaacagtattttaaatactaatgggttaagctggtataacggttataccgctgcgaaaaaactattacaacaaaccccaaaacctacagcaatcattagcggaagctacgatatcagtgtagggattttacgagccgtaaaggaacaacagctcagtatacccgaagacctatctttaatttcttatgataatatccctcaaatggcaagccttgaaaccccgctgacgagcgtaggggttccaatcgatcaattggctcacaaaatggtcgattctctgctgtctcttattcgcgagccgggctcaataccattaactcaaaaaatggaccctgaattaaacgtaagaatgtcatgcgcttctccagcagttttaggtgaagaaaacaagtaacatttaagacgagtttttcaggtcatcttttcttttaaaagctgatggcaatggattttacagaattcctcggtacattgatttctgaatttttacatgaacggccgcatgccttagggtacgttctttctttatagaaaatatatgttgcagacgtgtttttatatgtttctaataaatgcaaagctcaggtattgttacctgagctttgcatttattctcctgtctccgcaaatcgcttgatccgctctccaatttcatcgcgtacacgctgaaagaatgcccatttttcttcttctgtcccttctgctttggcgggatcgtcaaaaccccaatgctcgcgcttgacgtgcggcggtgtcatcgggcatttatcagccgcgtccccgcacagcgtaatgacgaggtctgcgttgtgtaagatatcgggatcaatgatatcggacgtctgctcagaaatatcgatgcctgcttctcgcatggctttgactgcgttcgggtttaaaccgtgcgcttcaatccctgcactgtagacgttccactcgtctccgagatgtttcttcgcccagccttcagccatttggctgcggcaggagttgcctgtgcataaaaaatagatggtcttttttgacattggtcatcgtctcctatcatgtttaatggatgatcagcagccacacataaagtccggcaagcgtgatgaacagggttggaatggtcaaaatgacacctgttttaaaataggttccccaagaaatctttacgcctttcagtgaaaggacgtgaagccacaagagcgtcgccagggagccgatcggcgtgattttcggaccgagatcagagccgatgacattggcgtaaatcagcgcttctctgagaatcccgtgtgtatcggtattctgaatcgcaagcgcatcaatcatcaccgtcggcatattgttcattaatgaagacaggatggctgcgataaagcccattcccattgttccggcaaacagcccttgatcgctgacggtctggatgacctgtgagagaacatctgttaagccggcgtttctcaaaccgtataccacgacatacatcccgattgagaagaaaacgatcgcccaaggcgctcccttcagcactttcttcgtttgcaccgcggggctgtttttcgctgtaattaagaaaatgacggcgatcacgcccgcgatgatcgagacagggatcgagaacagctcgctgataaagtaaccggccaacagaacggctaatatgagccatgacaagcggaatattttcctgtctctaatcgcttccgctggctgttttacatttgtcatgtcataatgccgcggaatgctttttctgaaaaacaaaaaaagcacgatgatgcttgcaataagcgaaaacaggtttggaacaatcattcttgttgcatattcgataaatccgatgttgaaaaagtctgctgagacaatattgacaaggttgctgacaacaagcggcagcgatgttgtatccgcgataaatccgcttgcgataataaaaggaaaaacgagcttttcttgaaaatttaacgcgcgtaccatggcaagcacaatcggcgtcaaaattaaagcagctccgtcattggcaaacagcgcggctactacggctcccagcagggtgacatagacaaacatccgaatgccgtttcctttagctgccttggccatgtgcagggcggcccactcgaaaaatccgatttcatcaaggatcagggagataatgatgatcgcaacaaatgccaaagtcgcattccatacgattcccgttacgtctaatacatcctgaaaattgacgactccggcaattaaagccagcaccgctcctccgcaggccgaccagccgatggatagatttttcggctgccaaatcacgagcgtgagcgtcagcagaaaaatcaaagtggctaagactgtcgtcatcgcgtgtacgcctccttcataggtttcctctccggacacatcttataataaaattgttatataagtcaatgcttatattcggaatgcaaatgaaaaagagggaacagtccaccctcttctgttttaactgcacgaaacgggtctttcttttcttttaacggtttgaagaacctcgtcgtgtgcatcgatctgattgagaacggcaaggaccaattcgcgttccggaaagtcgtcatgaagcgaataaaaacgccattgttcccttctctgttccttgatcatatttgcgcttttcagctttcgcaaatgctggctgattgcgggctggcttgtttcaaacatatcgacaagctggcagacgcaatatggtttctcctgaagcagtttcagaattaagagtcgggtagaatcgctcaatatcttcatgcagctcaccgtgcttttcgaatcaagctttgtttgtacggacatgacattcctccaatatcaggcgttttgcagacgttatgttgcatccattatataaatgtccttttatataatcaagcggtgatcatcaaggcgcggaactcgtgacaacatcgattgtcactgtgaaacacgctaaaatgattgacactagagttgaggcaaaaatcggcgtgtcactgcgtttttgcggccggacaaataaaggatgaggcccatgaggatcgaacagccccaaatgaaaaatccggtttctgtagcaagcagttcccaatgaaaaagccagacatgaaggattcccaaatgataatgaccaaagacaatgaaatatacgtatgtacgttttgcaataggttccttcaaattatcatcatactagaacagtaaagcctccgaggactcggaagcttttttattctcactcatcatttcgccgcttcttcggcatgattatgattcgcatctcccatgaaaggtagttgcgtaatatactagtcattcaatccctttccatcgagaatttgctgagtatatttttcaatccgcgactctctggttttggattgttttggtttggaaaaataaagaatatatgctctttgccggcccggcgtcaatgcttcaaaagccgcttttaaagctgggatttcagcgaattttttttgaagttcttctggaattgtatattctgcagcctgtttaaaatccacttgcaggccggctttttctacatcaatggcctcatttatataagctttcaaaatggtctccatttcagctatttcttgtacattggtgaatcgaacctgccgcgcggcttgtacattctccgtttgctggataagaatcccgttggggtcctttaacaatgcgcctttatgaaacaaaagcgcacaatattccttaaatccatggattaaaacgatgtttttattctcgaacgtataacaaggatgcttccacttgaaatcttcgttcagctcacattcaagtacgatttgacggagcttcttaaattcttccttccacttttcggctttgcttaaaaattcatcaacctttggattcgttctgctatttgtcataaggaccacccctctttatttcataatgtcattttaacctaaacttgctctgccgacagctgaaatattttaagcgttacggagatacaatatgcttagcaaaagaagaggcgggatgattatgaaatttagcatcatgacgtttaatatccatcatggaaaaggaagggaccgccgcgttgatttaggtagaacagccggtgtgatcgctcaaagcggctgcgacatcatcggcctgaatgaagtggatcggcatttctcaaatagaagcgattacgaagaccaaatcggccggcttgcagaacaattgaacatgcactatgcgtactgcccctccctttcattgagttccggcgattcttctgagaaaaggcaatacgggaacgctctattaacgcgttttccgattaagaaagaacggcatcattcattcaattttgtcaaagggctgatcgaaggaaggtctcttcttgaggctgatgtccggatcggtgaccggctctttcgcgtttttgttacgcatttgagcctgaatccgtggcttcacggcaagcagacggattttttaatcgagaaggttcaagagagcgatctgcctgtgatcgtcacgggagactttaatatgaaaccttattcacggggatggaaaaaggtcgcggaaaaactggccgacctgtgggatgaaagtcaatacggacaggggttcacccacccttcccaccgcccgagacggcggttggactacatctttctcagtccgtcttttcatgtgtcagcggctgaaattgtcgccgttgatccgaacgcttccgaccatctgccgcttaagggcagcatcacatattaaaggacggctttagaagccgtcctcagcgtgtcgacaaaccctcgcattcgttgtcaggcctgcgcgtcggtgctcacgaattccaacattcgctccgctccaatgctcggccttcctagactgcaagggttttcaatcacgctgaaaggatgacaaaatcccaaaactaaaagtcgttttgggattttgtcaacaatctgatgacggctttagaagccgtccttaagcttttgcgatgcccagcaaaacgccggctgcgacgatcagtatgatgccgatggcgataccgatcagctgccgctttgttttcttttcgccgagcagaataatgccgccgagcgttgagatgacgatccccatctgtgatagcgaaaaactggtcgctacgccgacccgcggctgggagatgaataaaaacatgtttcccgctgcccagattaaaccaggaatgatatttttgatgacgtaaaaattaaacggcttatgcctgaatgtcaagatcaaaccgccggcaaccatgccgacagcctgaggaaaaagagccgcccagccgctgacatcaaaaagccggacgacgacgacatacacgagatagccgaatgttgaaatcagcaaaatcacgattccttttttcatgtcgccggttttttcctctgttttttggctgcggtcttccagcgatgtcagcacgattcccacgatgataaaaatcagcgccagaacgccgagaacgatcgagattgtcgtcgcccactcatggaaaacaagcaccccaaacagagaagtggatacgagctgaagccctgttgagatcggcatcgttttagacacgccgatcagatcgatgcttttcagctgattggtctggccgagcgcccaaaatagtccggaaacgacgccgacggcaaatatccggggggataattcaggctggacgacgaagtagattccgattgaaaaaattaaagcgccgaatgttgtgccgagcacctggctgtacggtccgcccccaagctttacattaaagagcacgatgcttccccagaaaatcgctggtaaaatcgctaagaaaatgtccatttgatttaaacctttctttccttgtttttatctattaaggtgcactatcgatgcgatttttaacacaaaaaatccattttgaacaacgttcaaaatggattggtactgttaccgcaaaatatcagttttcactgtttacgctgccaagccaaggcatatcgggaacagctgccggttttttgtacaagtcctggatcagtctgtctttaatgccgagcggattccggtttaaatctttcaggctgaaatggatgcttcccatcacatttgaggcgcggtttaatgcgatctgccgcggatattcttcagggtctgaccaggcgggatctgagttttgattgattttataggctgcttgtccaatgtataaatgaacggggcgatggctgacttcatttttccaccagtccactaagatgtcgtaggaagctggggcaaagccgatgctccagtagatttgcggggcgatgtaatcgatgtatccctgtctgatccattccctcgtgtcagcgtaaaggtcgtcatagtttgtcattccggcggctgtattcgatcccgtcggatcatctgctatatttcgccatacaccaaaggggctgattccaaatttgactgaggccctctcttttttgacggcatcattgatttgtttgacaagctggttgacgttgtcccttcgccaatcttcaatatttgaaaaacggtcttttccatattgttcatatgtgctcaagtcgggaaattcgactcccgcaattttatacggataaaaatagtcatccatatgaacggcgtcgaccgggtaattcttgacgacttccgctatgccttggacaatgaattcctgggcctcagggatgccgggattgtaatacagctgtctgccgtaggcaacgacccagtcggggtgcgttctggccgggtgatcctgtgacagcctgttcaaatcggtatgattcatcgtgatccgataagggttgaaccatgcatgaaattcaagctttctccggtgggtttcttcgagcaaaaatgccagcggatcgtatccagggtcttttccttgaatccctgttaagtattccgaccacggcccgtatgcggaaggataaaaagcatccgccgccggcttaatttgaacgacgaccgcgttcatccccattgctgtcacatcatccaaaagcttcacatactccgttttttgctcttcgattgtcagtcctttttttgaaggccagtcaatatttgtgacggtggcgatccacactgcccggaattctttagtttcgcagcctgcgctcttttctttcatgaacatctccccttttggaaaaatcagaactttctgttattatatgccggatgttcttttttgtatatgaaaaaacaggccaagacatgtcgctgtctttagcctgtcgtttgaatcgccagtttcacctgctgcatcaaatattggacaaatgcttcatccctcgcgagccatgcagcgtaatttcttttaatgaaccgctctgcctcttcgaatgaagtgaatgtctcatgctgagccacgccgtttaattgaatgttccagccatttgcgctaggaaagagaaaaaactggtcctcgtccctgttgacataaaggctgccgtagtcggacttttttacattatagacgtttttaaaggcatctgctctcaagggctccagcggaaacggttcagttacatacagcttgaacgcttcatctgtcagcgggcaccccgctgccttggcatggccgcctccgccgaacgtgccggcgatttctgatacatctgtttcatcatggatggtgcgaaggctcacttttttgccgcccatatttaagatggcgatatagtctaggtgcggatacgttttcccgagttcgttccccacctctgaatgataggattcggcatgcacgatgccgacgcagtgcgcattaatgaaggtttgaacgatttcccgccgtttcctgcggatataccgttcaattttttcttcttccatatccaagattttttcttcgaattcatcaaatgaaaacgcgtcgctttctttaaggcgccggatcattttttcctcaaattcgtcgatggataccataaaaaacaggtcattcaggcgtttcgcttcgagagcgcccgtctgttcccattcccatgtatcatagaggcgtacgagttcgacgaactgatccatcgcttttgtctctcgaatgtggccgttgtctattaagtattcatagaaaagagaagtcgctgaagcgagcctgccatcctcatattgaacttttatcatgccccaagggcgttcattcaaatgaagcgcagttttatggtggtcgatcagtttgacctttccccccgcttccgcatattggtccagcctttcctcattttcttgatgaacggacaagtccgtgataaacaggccttcatgctgtttttctttgccttttgtccgctccaaaaaacgcccgacttgcatgtcgagtccggtgaccgaattgtagcggacctcgacccgttcgccaaaagccacttttgcgagaattccgcagccgactccgtccaagtcgttgtgagtatacaaatgatacatgcttcccgcccaccttgctgttttattgtcggcctgccgcagcaggcgcatctttctcatcttactattgtaaagaaacggattttttatacagttgtgaggtaagacaaaaaggacagcttcttgttagaaaaagtctgtccggcaaaagcgtttatgtctcttgcagcaaggatccgccttgcaagtgtgcggtgagcagtctgtacgcattttcggccctgtcggcacttggcggttcaaccccttttaacggataatccaggccaagcgcttcccatttgtagacgccgagcttgtgataaggaagaacctccaccttctgaacgttcgcaagcgtgccgataaacgtgccgagggccgttaaatcggcatcgatatcggagatccccggaaccagtacgtggcggatccagacgggaacttgatgttcagcgagaaaccgggcaaattctaaaatgtggtcattcggcattcctgtcaggttgatatgtttttttctgttgtgatgcttgaggtcaagcaaaacaaggtctgtatactggatcagttctttgatctgctcttgaaatgccggcgcagccgaatagcatccgccggacgaatcgagtgccgtgtgaatgccgaggcttttgcatgctttgaacagctcgattaaaaacggcagttgtaaaagcggctcgcctccgctcacggtgatgcctccgcccgatgattgaataaacgggagataatgctggacatcctgaacgatttcggaaaccgtcatttgttttccggttccgatttcccaagtatcagcattatggcaaaattgacagcgcatcaggcagccttgtgtgaagacgacatacctgatgcctggaccgtcaacggtgccgaatgtttcgatcgaatgaatatttccatccatggagatcacctctttttatgaggcggagcgccttggtcgcgctccgcttattgctcgctacatcgattcatggaaggttctgctgatgacgtctaactgctgttctttcgtcagcttaataaagttgaccgcatagcctgagacgcgaatcgttaactgcggatattcctctggatgttccatggcgtcgagcagtgtctctctgttaaatacgtttacatttaagtgatgtcctgtttttgcggcatatccgtcaaggatgcttgacaaattggcggcgcggctctcttcgtctttgccaagcgctttcgggacgattgaaaaggtgttggaaatgccgtcgagcgcatagctgtaaggcagctttgccactgaagacagcgatgcaagcgtccctttagtatcgcggccgtgcatcggattcgcacctggagcaaacggttctcccgcgcggcgtccatccggcgtatttccggttttcttgccgtaaacgacgtttgacgtgatcgttaaaattgacatggtctgaacggactggcgatatgtctgatgcttgcgcagttttttcataaagcgcttgacaatgtcaacggcgatcgcgtcgacgcggtcatcgttatttccgtacttaggaaagtcgccttctgtttcaaaatcgaccgcaatgccgttttcatcgcggaccacgctgactttggcatatttgacagcgcttaatgaatcggcgacaacactcaagccggcgatcccagtggccatcgtccgcaaaatttccgtgtcgtgcagggccatttcaattctttcatagcaatatttatcatgcatgtagtgaatgacattgagcgtgttgatgtacaagcctgcgagccattccatcgtctgatcgaatttatgcatcacttcgtcatagtccagcacgtcggaagcaaccggcggcatttccggaccgacttgcattttatgcttttcgtcttttccgccgttaatcgcatataaaagagctttcgccaagttggcgcgtgctccgaagaactgcatttgtttgccgattgccattgccgatacacagcaggcgattccgtagtcatcaccgtattctggacgcatgatatcgtcattttcgtattggatcgagcttgttttaatcgacattttggcacagtagtttttaaacttttgcggcagtctgacagaccaaagaacggttaaattcggttcaggcgccgggcctaaattgtcaagcgtatgcaggaaacggaacgagtttttcgtcaccagggcgcgtccgtcgtgcgccattccgccgattgattctgtcacccacgtcggatcgccgctgaacagttcattgtagtcaggtgtgcgcgcgaatttgaccaaacgcagcttcatgacgaaatggtcgacaagctcttgggcttcacgctctgttaatacgcccgttttcaaatctctttcgatgtaaatatcaaggaacgtggacacgcggccaaggctcattgctgctccgttttgctctttaatggcagccaaataggcaaaatacagccattgaaatgcttctcttgcattcgccgcaggcttggaaatgtcaaacccatagctttttgcaagcgctttaagttcgttcaatgctcggatttgttctgacagttcttcacgaaggcggatgttttcttcagacatcacccgagaggtgccggccgcatcttttttcttttcatcgatcaagaaatccacgccgtaaagcgccactctccggtaatcaccgatgatgcgcccgcgcccgtaagcatcaggcagtccggtaatgattccgacttttcgggcgagcttcatttcgtccgtatatgcgtcaaacacgccttggttatgagttttgcggtaatcggtaaagatcctttccacttcttcattcagtttaaaaccataggattcgcatgcctgctttgccattcggatgccgccgaaaggctgaagcgaccgtttaaacggctcatcggtttgaacgccgacgactttttccaggtctttgttcaaatatccgggaccgtgcgaggtgatcgttgagacgatctctgtatccatatcaaggacgcctccgttttcacgctctttttttgtcaaatccattacatgatcccataatgccgatgtagcttccgtcggaggttcgagaaacgattcgtcaccttgatatggctcaaagttcgagagaataaaatcgcggacattgacttctttttgccaaacgtttgtggtgaaacctttccattgttccatttaaatccccctctttttcaagttgaaatgatataacagttgttgcatttatatcttatgttgaatataacaggtttgaatgtgataaacatcacatattttgtgaaatagttaacaaatttgagaaagttctttgaacatcgcgtttttttcaatatagactgttgtttgaagcaatttttattatttaaatctgtattataataaagtcaaaggtaacgaaaactgttatataaaaaagccggcaaaatggccggcttgcacagagaaatattgatcatcagcctatcgatacagtctgattgccgaatgattcgatggtgctttgggagctggtggcaaacatagcagtcttttgacgagaccgctattgcatgacgttttttcactgatctgagcgaggaagcatttccgctcggagagctcaagagcctttaaatccgccggcagcaaaacatgaattaaagaaaacccattgcctgctgcaatgggagaagtcatgaagaagctaatatttgaacgattttgtcttcaatatcctttcctttctcatcatccacgagctgattgaggagaatggagaaaatcaatgtctttccgcttgcagtatcgacatagcccgacaaggaactgacggttgaaagagagccagttttcgccctgacttttccttttagagccgggtctttcagccggtttcttaatgtgccgccgaccattctgtcgctttcacctgcaactgggagtgaacgggcaaacgacggaaaccatttctcgtcttgaacggaatacaatagctttgtgatctgatgtgcagaaatcaaattgatatgcgagatgcctgagccgtctctgagaacgattttttccgtgtccagtccaaatctctgcagttccgtatttaacacctctagcccttgatcccagcttccttcacgtctcgcggcccttcccatttccttgatcagcgtttcgccatggccgttgttgctgagcttcataaagggaatcatcagctctgacagcggcatggattgatgtgtggtgatgcggtgcgctgtttttggcgctttgccgattttagtctttcccaggattcgaatgccttgttgatgtaaagcctgtttaaataaatcgagtgcatattctgacggctcccaaaccgcaacccattgtctgacccttgaagcgccttgtggaatcgtccctttgatttggatggtatttcctccgtgtttccttttaatcgtgatatctttttttccgtcggcagcaacagtcttggcatcgtttttgattttgacatggtttgtttgcggggtgagcaatacagcaggtttttttccggtttttccggcagggttcacgtcgattatgaccgttccggcatcatagtcttcatttggcgaaacagttaaagctgaaatctgcgctccatagtatgcgtcttcatcggtccaggaaaggtcttgagaatagcggatttcatcgtaccaggaatcatcgccgaccaagtctccccggataactgtgatcccttgttttcggagtgctttggccatttgctgaaagtccgctgtcaaaagcgtcggatcgccttttccttttatataaaggctgcctttgagtgtgcccgcggctcgcgccccatcagccattacctctgtgggaaaggtatagtcctcgcccaggacggaataggcagctgctgccgttaaaagcttcagattggacgcaggtctcatccgtgtatcgcccatatgtccgtatatcattttcccgctttccgcagacctgacgctgatgcctgcgagcgctccttttaaatcaggttcggtctttaacagctgatcgatttgctctttgagcccgcctttttcctcagcgcccaagccgtccatgctgccggccaaagtcaatacaaagatcatcatcatacacagacaaagcttcatatgtttcttcatcggatatcccgcctcccgcttatgttttaatactttattgcaaaacggggcgggatatactcctattggtcggttttcaccaaaaacctccggtataaaaacagcagtatcataatgtgcagcgcaattccggtgatcccgaaaacgagaaaaagcccttcgtgggatattcccgccaagtacgttttcgctgtccaataaggtgaaaacaccgaaaagctgccacggcacaggaataaaataaaccgcggccggcatgagagtgagcaggctgaatcctttcattaaagcgagtccttccactttgtttgcgacataggcggctaaaagcagcgtgtaaatcggggcttcaagcgtgaccatgatcaggacgaacaataggttcacagcgccaggcgccattagaccgccggaggcaaacagcaaaatgctgtagcataatgtcatcgccatcggcaggatgagccggatcatgacatatccgcgcttcgacaagggcgtcacggcaaaatactgaatcatattttcgtcgcgctcatcaagcaggataaaccccgacatgacaccgagaatcagggggatgaaaagcatggcaaggctcatgatcaaatgacggtatggggtgatattgaattccgtcaattccgctgacaaaggaacgcctgctgcagtcacgatgatgagcagaaaaggcgccagtccgtaaaaagcgagctgcgattccgttcttgtcagtatattttggttcaaatttaccacaatattttcatttgcccgtcaaatttaaagcaaaaaaaagcaccacttatagtttaaactataagtagcgcttcatttccattaataagccaggctgaacagaccttttatgtggctcaggtagcggacgttgctcgcttctttcatcaatgaagcaggcaggcctttaagagatgtgctgttcgcgccgataacggcaactgcgtctttgcggcccaggcttgcaagcgtacctgagttgacagggctgaacgtcgccattgatttgttttctaagtatgcatacaggttgtagccgatcagctcgcccatttgccatgcgatttgagctgtcggagggtacggacggccatccggaccgaagacaacggcgctgtcccctgcaacaaacacgtcttcatgtgatgtagattgaaggaagtcgtttacagttgcgcgtccgcggttgacttcaagacctgattcgccgatcagcggattgccttgaacaccgccggtccagacaaatgtatttgtaacaattttttgtccgtctttcaaatcaacaacgtttccttctacatttgtgacaggcagtcctgtcaagaattcaacgccgcgtttttcaaggctctttgtcgcacgttcgatcagctcatccggaagaaccggcaggattttcggaccggcttcaacaagcttcagcttgatttctgtcggatcgacaccgtagcttctcgcaaggctcggcatgatatcggcgagttcaccgacaagctcgacgcctgttagtccgccgccgccgattaagatcgtagcatcagcttcgtttttcgttttcgcgtattcgcgcacgcgctcttcaacatgcttgaagattttgtttgcatcgtttgcagatttgagcaccatgctgttttcttcaagtcccggaatgccgaagtaagcagtgacagaaccaagaccgacgacaagtgcgtcatatgtcagggtagagccgtcagaaagagcgacttcttttttgtcaactgagaaagagttgactttggcgattttaagatcgatgtcttttcctttgaaaagctttgcaagcggcatcgcaactgcctgttctgacacgttgcccgcagcaaggcggtgcaattccgtgatgatttgatgtgtcggatattggttaaccactgtgacttttgcttcttcttttgtgtagtgtttgcgaactgttagagcagacagtaatccgccgtaaccagcgcctaaaatgacgatatgttttgacatcgtgaatcctccgtccttattctgaatgtatagtgattatttttgtttttcgcgttctgacatgatttgcaggtagctttgaacaaatcggaacagcttttgggcctgcggatctttaagcattttcagcaaaccgaaaagtccgatgacttcattgctttcgtcagcgcggtcttttgcttcaatggcggtagccgcgatttcttttgccgtatctttgacaggctcaagaatttctgtaatggcaccgaccgtatcattttttaatacttcatcagttgcaacggattgtgcgaagtcgtaagactttgtcaaaatgttgaccagttctgtcagctttggaagctggtcgactaaaacagtcaaagactcctgtacttcaggttttagcagttgatcgataagatcgcgttggctttggcttacagattcgtttgtttgatcagctgtttgatcgattgtttccggcataaccaattctccttttcaataagcgatgtgctgttttttgaaggaagcccctttttatagtttgtgaatttatgcacaaacaagtccgcaaaaaggctctccccttttgtgtttgttttgctgttttcggtctggaactcccgaaaacccgcaatctcaaaacacgctgtattttttactactaaatgataacactttttgaacaaaaaatgaacgtgattgtttcggaaatgaaataaaatcatagaaaactttatatatagggcttctttcatccctttcatttcctatattgtgtctttttttacgaaacgccccattcacacgggataatagagacggaaaacgtgcgaaactttcatagaatcgtatctgtcagtttacataataaagttattgttatcccgggttaatcttcatctttgacgtccggatcttcggggatgggctcgttcagaacggattccgcccactctttatacttttccatctgttccatgtgcgtattgaattgctctttgttgattaaatgctgctgtccgtcaaagacggtgcggattttcttttctctgacaagctgttcaacatatgcttctgaaagcgttaaatattctgcggtttcctttatcgtcaagtacatgttttgtttcctctcgttttgatttaggcgaacattgcgattgtaggatcatacgataaggtatatcagtttagatgatggaggcctattctatgtattcaaaatggaattctgaaacgtcttatccgccttcagccccgcaaatgcataccggtcaatcttcgcagcagatgaaccaaaggctgaaaaatctcgaagatcaaatggaattgctcatcaagctcatggaaagcaacaatcagctgctgcgttcgattgaagagcagcagaatcgcgtctgcacggccggcggcggttcggttatcgtcaggatgtgagtgttggtcgatcgagcttcatcaaaataaaaagaggaaggacgtgtccttcttctttgtttgtaagccttatccagtatactacagattttttcgcactgaaagaccggcaatttcatcatatgtttcgcggttttccaaagttgacaaatcgcctgcgggctcgttcatataggcagctctgatcagccgtctcatcacttttgcatttctcgtcttcggcaaaccgctgacaaaataaaccgctttgggcttgaccgctttaccgatcgcatcagatgcaaggttcagcaaatcatcttttaattcttccgacggcttttccgactgtctgaggacgacgaagcagacggcagcctggcctttgagcttatccggaacgccgatgacgcctgcttccgccaccgctggatggccgaccagaacggactctatttcggcggggccgatccttttcccggcagcattgatcacatcatcagagcgtccgctgatcgtccagtagccgttttcatcccgttttgcccaatcgccgtgcacccagacgtcggtccagcggctccaatatgcttcttcgtatcttgacggctccttccaaaaaccgttcgtcatgccgacccagggctttgtcaggacaagctctccgacttcattgacgacttcctctcctttttcattgaagacattggccgccatgccgggaagaggcgaattaaacgtcatcggcgtgatcggccgcaggagcacattgcctaaaattccgcctgagatctctgttcctcctgaataattaaatataggaatccgttcttttccaacatggcggaacagccacatccacggctcataattccatggttcgcccgttgagccgattgccttcagactgttcagattgtattgatagagaaaatcttcgccgtgctgcatcagcgagcgaatgagcgtcggagagacgccgagatgcgtcacccggtgtctgctgacaagctcccacagccgatccggggccgggtagtccggtgctccgtcaaacagcaaaacagccgctccgtttatgaggcccccgaatattaaaaacggccccatcatccagcccatgtctgtaaaccagaaaaatgtgtccccttgtttgacatccatcccgaatcccgcatcaaatgcagctttcagcggaaaaccggcatgggtatgaaccgctcccttcgactgtcctgtcgtccctgatgtgtatagcagcatgagcggatctgaactgtccatttcttcggtgttttgcatgggctcgtttttcatcaattcattccagtcgatatctctcttataattccaatcttgatcgccgccgtgaagcttgcagacgacgactttttgaacagtgggggaacggtccgcggctttgtcagcttctttcttcatgcagaccttctttccccttcgcaaaaaggcatctgctgtgacaaggattttcgctccggcagcggtaagtctcgccgctgctgcatgggcgccgtagcctgaaaaaaccggtgagaataccgctccgattttagcggcggccagcatggcgatgaccgtttcggggatcatcggcatgtaaatcgcaatgacatccccttttgagatgccttgctttttaaagcctgccgccgcacgggcgacttgttggtgtaaagaagaataggtgatctgttctgtttttccgtcttcactttcccagatgagtgccgtcctgccggccgtatcaggccggcgggcccatttttccacggcgttgtaaacggcatttaagcggccgccggtaaaccattgcggccattttatgcctttgtcgagattcaatgtttggctgtaccgcttgtaccagctgatcccgagcgctttttcggcctcttcccagaaccaggcgatatcgtttgtacttgctttcaaaaaatcatcatagtcggaaaaaccgagggctgtcatccattgaaacagccgggttgtttttacaaattccggatcaggctgccaaaccgctttttcgcccatgccgtttcctccttttcgtttcattggcctttagacgggataaacaggatgcttccgttccgtaaatgtcatgtatttggtcatatatgcattcagccgtttgatgagttccgttcgcagcgagtcggccggaatgatcccgtcgacaatcatttctgaagcaagccggtaaatgtctatgtctttttggtactctttccgtttttcggcgatgaatgcggaccgttcttcttcaggcaattctgcgatttttttagcgtaaacggcatttaccgctgcttccgggcccatgacggcaatttgcgccgtcggcagcgccagacagcagtcaggttcaaaggccggaccggccatcgcatacaagcctgcaccataagctttcctgacgatgacggatattttcggtacggttgcttcggccatcgctgaaatcattttcgcaccgtgtctgatgatacccgccctctcgactttcgttccgatcataaaaccggggatgtcagccagaaacagcagcgggatatgataggcatcacacaaattgataaactttgcggccttgtctgccgaatcgtggaacaaaacaccgcctttgacccgcggctgattggcaatgatgccgacaggctgcccgtgaatccttgccaaaccggtaatcagctctggcgcgaacaattttttgatctcataaaaagacgcttcatcaatgatccgatcgattaaatccatcatctgaaacggagcgttttggtttttcggaatgatgtcctccaatgaccggtcaaacggacgggcggattttgcttcaatgacaggcgctttttcggtgtagttcgacggaaagtaggaaagataccggcgcgccgacttgatcgcatcttcttccgtgtcggcaagaatgtctccgcagcctgaaacagaacagtgcattctcgcgccgcccatttcttcaagcgatactttttcgccgatcaccatttccgccatgcgcggcgagcctaaatacatcgaggcgttaccttcgaccataatgacgatgtcgcaaaaagccggtatgtaggcgcctcctgccgctgaaggcccgaacaagagacagatttgcgggatgcgcccggataatttgacttgctgataaaaaatccgccccgctcctcttcgccccggaaacatgtcaacttgatccgtaatccttgcgcctgccgaatcgaccaaataaagaagcgggcaattcagtttttcggctgtttcctggatgcggatgattttttcaacggttctcgctccccatgatcctgctttgacagttgaatcattggccatgacgcaaacggttcgcccgccgatttttccgattccagtgacgactccatctgccggtagcccgtcagccatgcaattggcaaaaaacgcgtcctctaggtcgagtccttcgtcaagcagcagctttaatcggtctctgacaaataatttcccttttttcttattagcttcatggtatttctccgcgccgccctcctgaatccggcggatgcgttcatacaattccttttcggccggcatcggctgtccctccgttcgttttattctcccgtataatccggcttccgcttttctgcaaaagctttcagcccttctgtcctgtctttcgtcggaatcgtcagttcataggctttttgttcaatggcaagccctgtttcgatagctgtctcaaggccttgattgatggcaaacttcgcttgtctgacggctaccggtccgttcgccgcgatgttcgccgcgatgctttcactcgcttcctttaacttcgaaagcggaacgacatgttcaaccaggctgatcttttgcgcttcttcggcgctgatgcggcagccggtaaagatcatttctttcgcctttcccctgccgatcaagcggggcagccgctgtgtccctcctgcccctggaatgattgcgagcgttgtttcggggaggccgagttcaatatgttcggctgcgatcctgatgtcgcacgccaatgcaagctccagcccccctcctaaagcgcttccgtttaatgaagcgatgacgggctgcggcagtttttccgtttcgctgaccacgcgttgaatcagggaaacagcctgcttcgcttctgtttggctcatgcgggctctttcctttaaatcggcgcctgcacaaaacgtcctgtccccttttcccgttatgatgacacagcggacggccgggtttgaacgaatatctcgaaggatgcgctgaaagtcgtcgagaagcccaagcgagagggcatttgcagcctgcggcctgttcagcgtcaacacggcgaccgactgctcgtttatggaataaagaacattgggctccattcggtcttcctcctcttcatcaatgaaaacagttctttgatttagccgcctgcaaatttcggcttggcagctctcttccggttttgtcttcgatccatttagcagctgaaagcagcttgctgagatcaactccggtttcgatgcccatctgggcgcacatgtagatcaaatcatcagttgccgcattccccgtggctcccggtgcgtaaggacagccgcccagcccgccgcatgatgagtcaaatacggtgattcccatgtccatcgctgcgatcatgttggcgagcgccatccctctcgtatcatgaaaatgaagggcgatattctcttttggaaagcgctttaagaggacttcaagcaccctttgaacctgtacgggatttgctgcgccgatcgtatctccgagggaaagttcgttgatccccatgtcgaacagcgtttcagatgtccgtataatttgttccaatggcacgtgatgttcataaggacagccaaatactgtggacaggtatgctctggcggtgaggcccgcttgttttgccgctccgatgacttccttcaggacgggaagcgtttccccgatcgatttgttaatatttttccggttgtgtgtctcgcttgccgacatgaaaacagaagcttcatcgatccctccttcgagagcccgttccagcccttttcggttcggaatcagggctgcgtaggtgacgcccggcttccggttgatccctttggcgacatcaagggcatcagacagtgcaggaatccacttaggatggacgaatgaagtgatttcgatatacgaaagccctgtggcagaaagcatgtcgatccaggtaattttatcagctgtcgaaagtgcggtttgttcattttgcagaccgtcgcgcggcccgacttctttaatgaaaatgttcttcggtacgtccatttgccatcctccagaccttattgaagctccaataagacatccccttcatcggcaaaatcaccttcgttctttctgacggttttgactgttccggccgtttcggcgacaatcggaatctccatcttcatcgattctaaaatggcgacttcctgccccttttcgattttgtcccccgctttcactaatattttccacacgtttcctgccatattggtgacaacagtattcatagtacgcctccttgatttcattttgactgatagcgactgataaaatcggtttggaccccgccttttcggaattcgtcagaacttacaatgtcttcaaggagcggaatgttcgttttaatgcctttcacttgatattgtgaaagcgcttcggccaatgtgcagatggcttcttctctgctgcttcctttgacgatcatcttggcaatcatcgggtcgtaatacggggtgatagtcatacccggggctgctgcgcattcatgacggacattcggttgctcaggcagcttaaggtcggtaatccgccccggcgaagggaaaaatgttttcggatcttcggcacagattctgacttcgatcgcatgtccgtcccgccgaatgtctttctgcttatgggaaagcggttttcccgctgcgatattgagctgttcttcgacaaggtcaagccctgtaatttcctctgtcaccgggtgttcgacttgcaggcgggtattcatctcaagaaaataaaaatgattctccttgtctactaaaaactcgattgtcccggcgttgacatagccgatcgacagcgcagctttcacggccgcttcaccgagctttgtgcgcatggtttcatcgaataacggagcaggtgcttcttcgatgattttttgctggcgtctctgaatcgaacagtcccgctcccaaagatagacggcattttcgtatttgtctgttaaaatctgaatctcgatatgtcttgcctgttcgatatatttctcgatgtacatagccccgtctccgaaaaaatcggcggctcgtttttggttgccttcatatgctttttctaattcgctttcattgcggatcagctgcattccgatgccgccgcccccaaaagaagccttgagcatcacgggatagccgatggattcggcaagagcccgggcttcattcagaccggacaagctttttgtcacgccgggaacgacgggaaccccggcttgttccatcgcttgtcttgcttcaattttgcttcccattttggcgataacgtcaggcggcggaccgataaacgtaatattctccttgaggcacctttcggcaaaacggctgttctcggaaagcaggccgtatcccggatgaatggcacagacccccgcttttttagcggtttcgatgattttttcaatatttaaatagctttcactgacccgcggtttgccgatcagccaggcttcatccgcagctttgacatgcagggactccgcatccgcttcagagtagacagcagccgtctgaataccgagccgttgacaagttcggatgatccggagggcgatttctccccggttggcaatcagtactttcttaaacaaaaaggtccctccttttatgttagtcgcgcttgaaagagaaaattacaattgaaaatgctcaagcgcctgctcccttaacttgaatttttgcactttccctgatgccgtcatcgggaactcttctacaaatgcgatatagcgcggaatcttatagcgggcgattttgcctttgcagtattcttttaattcgtcagccgtcatcgatgctccgcttttcagtttgatccaggccgatacctcttcgccgaatgtttcgtcaggcactccgacaatttggacgtcgagaatgtcgggatgcttgtataaaaactcttctatttcccgcggatatatgttttcaccgcctctgatgatcatgtcttttaatctcccggtaatccggcagtagccttcttcatccattacggctaaatctcccgtatgcaaaaatccatcctcatcgatgaccgctgccgtggcctcaggatttttgtagtagcctttcataacatggtagccgcgtgtgcacagctcgccttgaacgcctctttcaacctcccggttcgtacccggttcagttattttgacttctacattcggcaaagcgcgccctacggtttcgacccttcttttgagcgaatcgttgaccctagtctgggtaatgaccggtgaggcttccgtctgtccgtatgcaatcgttatttcagacatccccatgttatcgatcacttttttcatgacttcgatcggacagtttgaaccggccatgatgcccgttcttaaagaagacaggtcatatgatgcgaaatctggatcattcagttcggcgatgaacatggtcggtacaccgtgaagcgccgtgcatttttccgtttcgacggctgaaagcacttctttcggactgaattcttgtaccggcaccatcgtcgcgccggcggtgacgcaagcgagagtccccagtacacagccgaagcagtggaaaaacggaacggggatgcacattctgtcttttttcgataaattcatgcattccgcaatatttgccgcattgtttgccaaattggaatgggtgagcatcacgcctttcggaaagcctgtcgtacctgatgtatattgcatattaatgacatcatgctctttgagccgttccatcctgcgatcaagcgctttttcgcttactgaccctgagagctttaataaatcatcccataggtacatgccgggatgcctttgatcccccagcaaaataatattttttaagaaaggcagtctttcagatgcaagcctgcccggttcgccctcctttaattcaggaatcagtttgcaaaggatatcaatgtaggaagtgccccggtatgattccattaaaatgagtgttgtggcatctgactgtttcagcacatattcaagctctgataattgatagttcgtgttggctgtgactagtacagcacccgcttttgccgaagcaaactgggcggtgagccattccggagtattggaagcccaaattgcgacatgttcacctttatcaataccgagcgccatcagtccttttgcgacttttctgcacaactggtcaaattcccggtacgtataacgcaggccgcggtccggatagacgacagcctcgtgatcaggggcgtctgccgcggttttctccaataactttccaattgtcaaatggagcagctctgccaacgttgtccctcccttccgatagaaagcgttttcatttcagcgcttgtttgccgatgccgagctgccttgcgatgacgagccgttgaatttctgaagtgccttcaccgatttccattaattttgcgtcccgcagcatgcgctccactccatactctttcatatacccgtatcctccgtgtatttgaatggactgattgcatgtcctgaacgccatttctgaggcataaagcttggcaaaagccgcttcttttgtaaacggacgtccttgatctttcagccaggcggccttcagcaccatattgcgggcgagctcaatttccatggccatgtcggcaagcttgaactgaatcgcctggaaataagagatcggtcggccgaattgttttcgttcgcgcgcgtatgtgagcgccgcctcaaatgcgccttgggcaataccgacagccagcgctgcgatcgaaattctgccgccgtcaagtgtattgagaaattgtttaaaccctttttccgggcttcccaatagattttgttttggtacgcggacattgtccaatatgagctgtgatgtattggagccgcggacacccattttgtcatattcgcttttaatggtgaagccctccgaatctgtcggaacgatgatggcggaaatgatgttttttccgttgtcatctattccggtgacggcggtgacgatgacggtcctggcaaatcctgcatttgtgatccagcatttctcaccgctgatcacatagctgtccccttccgagcgggcttttgtccgggtgccgcccgcatcggaacctgcattcggttcggtcagcccaaatgctccgagcgcccggcccgtcgcaagcgggacgagatattcttgtttttgttcttcagtgccgaaataataaatcggcgcagccccgagcgatacagccgcagcatagctaagaccggtgcttccgcacgctttgccgatttcttcgacgctaagtgcataggaaatcgtatctccgcctgaaccgccgtagctttcaggaaacggaatccccaagaggccgagctcccccatttttttaaatgtctcaatcggaaattctcccgtcctgtcaacatgttcggcgtgcggtgcaatttcctgtttcgcaaaatctcttgcgagttcacgaatcatttgctgttctctggttagttcaaaattcataaagtgcccccctttttggatcgtcaaattccttaggcagcagagctttgtaacattatattaaaaaagtgcatttttcatgccagaggattttggacaggtaaattgcatgtttgatcgccaacaggtacttacctttatgtaagtacctgaactaaaagtgcatacttacaaattggcagtgtgaactttatactcaagatgaaaacatgctgaaggagggcaaatctttgaaaacgctagttatcgttgcacacccaaatttagaaacatcagtggttcataagcgctgggtagaggaactcaaaaaatatccggaaaagtatacggttcacgaattgtccgacgtttacccggatggaaacatagacgcggaaaaagaacaaaaattggtggaatcgcacggcaatcttgttttgcaattccctatctattggtttaactgtccgcctcttcttaaaaaatggcttgatgatgtattagcttacggctgggcttatggttcaaatggaggagatcgattaaacaatcgtaaagtggcattaggtgtatccgccggaattaaagaggaagattatcgtgaaaacggaaggtaccggtatacgcttgaacaaatattagttccatttgaaacgacattccggtattgccgcgcagattatcgttcattttttgcattttacggcaaggaaaaagagcctggcggaaacgaggaagaagaaaatgagccgggagcaggagaattggagaaaagcgcacgagattatttgcattttattgatcatatgtagcaaggggttttgctgaaaatcattcgggctgaaacaggctgtcagcccagcctgtttttctccccccactcacacatcatatttaacaaaggcacgatggagcgtccgcgttcagataatgaatactcaacctttggggggatttggggaaattctctgcgaatgataaggccgtctgcttccagctcttttaacatgatgcttagcgttttgaaggaaatggtgccgatgcttcgcttcaattcattatgccgcatcacttcgcgttcagacagccaatatagaatgactattttatatttgccgcttatcaatgacaacgtatagccaaagccggtgtctttaagttccacaccggtcggaacgcaggtttttccggatgggatttgcataacgcacactctccttctgactcttatatcatagatcattatgtaatgtgattgaaaggatgtaaagggaggagtttgaaaggtgcctggtaaaaaaattctgcgcctgcatgttttatgaggatgtaaattcagccgaaaaaaactgcacctccggattgtcagatggtgtctgacaaaccaggtgcagtttcagtacaggtctctttatttatcttctgatatggccgtcgcctctcatgatatatttgcatgtggtcaattctttcagacccataggtccgcgggcgtgaagcttctgtgtagaaattccgatttcagcgccgaatccgagtgcgccgccgtcggtgaacctggttgaggcattgtggtacaatgctgcagcatcaacggtattcagaaaagctttggctgtttccggattttcggtgataatcgcttctgaatgctttgttccgtatgtttcgatatgatcgcaggcttcttcaagacttcctgcgactttaaccgcgagatcaaggcttaaatattcgttctgccaatcggcttcccctgctggtcttgcgcctggaatcatttgaacagccttttcgtccccgtgaacttgaatcccgtgttcgtttaaagcattgataagcgcggcgctgttttcctcaagccatttttcgtggacgatcagcgtttcaagtgcattgcagacggcggggcggtctgttttcgcattgatcatgacatcgatcgctttttcagggtccgcttcccggtcaatatagatgtggcagttgccgactcccgtttcaaggaccggaacggttgcgttctcaacgacttcctgaatgagggccccgcctccccgggggatgagtacatcgatatgttctttcatcttaaagagctgcttcgttgcgcttcggtctgtgctttcgatgaattgaacggcatcgcgggggatgtttgtcgaatcaagcgcttgatgcatgaccgatacgatcgctgtattcgaatgaatggcggaagagccgcctttcaaaacgatcgcattgcctgattttagagcaagcccggtcgcatcgacagttacgttcggacgcgcttcatagatcatgccgatgacgccgagaggaacgctgactttttccgcttttaacccgttgtcgagcgtccagcttgatagcgtttctccgaccggatcatcaagttccgcgacttccagcagcccatcggcaaaatccagaaccctgtcttcattgagcgacaggcggtcgatgtaggctgcatcatagcctttttttcgtcccgcttcgatatctttggcattttcagtgagaatatagctcatgttttgtttcaggtggtcggccaatgcagcaagcgcctcgttcttttctttttcagttgccagccgcaaagattttgcggccgtttttgcctttatcgctttttcttcgatttgtgcactgatgctctcgctcgtcgcagtcatgtcaattcctcctttgatttgttttttaaagcggaacggatagctctaaatgacagacaaacgcttctctgtcaacgacagcctgtgaggaagcggctgtttcctgattcgtatccttcttccatttacgaagctgggatgaggaaaagttgacgacgccgaggccgatttcctctccttcctgatcaaggattcgaacgacggatccgttgctgaaacggccgttgatgtcgtaaatactagaaggatacaggctttttttacggtcgataataaactctttgctttcgttgtggacgacgatgtctccttcaggtccagagttaaatgctatccattgctttttatggttgagggcgtgtgaatccgcattcggtataaaatacgttcccctcgcagtcccgcagatcgcttcgtgcaaaatgccgggggtgtccgcgcgccctaaaaaccctttgatgcctgaagccattgtaattttaaaagcgtccagtttggacttcatgccgccggttccgacttcgcttcctgcatcccctgctgaagcttctatttccggcgtgatttcagttacttcctggacgagtgcggcgtccggcgtttttcgcggattcgcgtcataaaggccgtctatatcagagaggatggtcagcaggtcggcgtcgatcagacccgccactttagcagaaagcgtgtcattgtctccgaatttgagccgattgacggtaaccgtatcattttcgttgatgatcggaataatgccgcgtttcagcagcacgttcatcgtatttctcacattgttgtaccgtttttcatctgaaaaatcgctttttgtgattaaaatttgtgaagcgatatagccgtgggataaaaaaagcttggaatacgcttcgattaataagccttggccgacagaagcggatgcttgtttttcaggcaatgtatccggcctgttgataaagccgagcttccggtaaccggctgctacagcgccagatgaaacaaggaggacttcgtgtccttcatctttgaggcggacaatctgctcaacgagcttttcgagctttttgctgctgatttcgccgtgaagacttgttaaagaactgcttcccactttgacaactaccctctgttgattagaggtcattttatcactcctgtagtatttttcttcgttacgggcatttactttgctgcgactaattgttccagttcgagactgatcgttttggatcgttttgcggcttgtttgaccgcctgttcgatcgcttcgcctccgccgctttcttccaaggcctttaaaccggcggcagtcgtaccgttaggggaagtgatgttgtctttgagaacagctgtatcctcagggctttccaacagcattttggcggcgcctaacaatgtctgcgcgccgatttcccttgttaatttttggcttaatccagcctcggctcccgctttttcgatgtgctccattaaataataaaagtaagcaggcccgctgccggcaatgccagtgaaaatgtccattttgctttcttcgatggaatagacttctcccatgcattgaagcagttgtttcgcggtttttgacagatcggccgttacatggcttccttcggccatggcggttgcagatgcgccgattgcacttgaggtattaggcatgattctgatgaccggctgcatgtcgtgcagcgtgttttcaataaatgatattgatatgccagctaaaactgacacgataagctgatggggtttgatatgcggtttcatggaattaagagcgccctctgcatctttcggcttcatcgccaggatgaagcaatcgatgttctgatagtcaagttgttcttttttgacgccttgtattccatatttctgctggagttcttctaaacgccggtggttcgtgtggtttgtaacatagatttgcgaagcaggcagttttttggattgaacgatgcctgagatcattccctctgccattgatcccgcccctataaaagctacgtttttttgattaaagatctttaacatctccctttgttcgcatttctgttcgtatttttcgaacacggttagtatattaacactttagatcattatgtcaagtttgcgtgttttgcttggacggcgcagagcatgtgaaaaatggagatttttgaagaaaaaaggaaaagaaaaggaggctgaaggcagattcttcatcttcatgtgcaccttttgtcgtttgtcatccggccatttgaaggccgtttgaatgatttaacggaattttttggagatcaacagcctttcggaccggtaaaaaagtatgttcctcgagccttgtgaatgcaattgaaaaagcgcgggttcgaagcttgtcgaacccgcgcctgccaacatcaatatgttgtgatgtaaagctgcccctcatcaccgcgccattccgcatacagcacctcttgatactgagtgataccctgacttgataattgattttgcagccaaagctcatcaaatccggcttcgtgcagattgttcttttcgagctggccgtcgaggattaccggcaccgggagctgaaccggtttgtaaggaatgtttaagtcatcttttgtcggcatcccgtatttgtgttttgggaggacgctgatcgaaccgtctgtttccaagatggcgtattggatctcgtgtaaggaaaaacagcctttttcacgtgccaatgtctgcagctggttcaggtccaatttgttctttttaagggcgttgtaatcgatttttcctttattgatgacaatgctcggcctgccttcgagaaaacctctgatgttttgcactttttgcgataaaacttctattgaatagattagaacggcccaaatgaggatggcgaaaaggattttccagatggtgacatcctcatcgaaaatcgcgtttccaaccatctcgcccaatattaaagccgaaataaaatcaaacggcgtaatttgggcaaattgggtttttcccagaattttcgtcatcagaaacaatgctgcaaaccctatcgtcagttcgactaccaagtgtacatattccatcaaggttccctcccgaatctctctcctcattgttaacaatcgggatgcagtttaaaccagaggaatacttttcctgagaaatggaccgactgatgatcctctgaaacgtcggggatcagccaaaacaatcgtcaaaaaagagcggcgtcagccgagctcttcttcggtcaaacggctgttaagtgccgtaaccgctctcggcttctgcacgatcacttccggcaatgaaacagatacagctgcacgggcgccttttcccgatgtgatgcactgttgaaaaggtgcactgcattgacagacttgtatttgattccgggcagttcggcagcgctttagctccatatcatccaaaacaggcggccaggttaactaaaagtccctccatgcggcaggttctcttttacgtcccctccctccaacgattgatttcacatgatccctatttcttcggacatctgattgtttctgcctggcatgtttcataaggcttatagatcctaaagtggcaagaaaaacacataaaacaactgccactgaatataaatcaaaatcgagaaagattttcacgagactgtaggaaatgacaagtgaaaaaaccggtgacacaacccatactttcattaacttcaaaatgacgcttttacgaaaaattgcccttcccttttcagaaaggccgatcccgatgatgctgcaagtcgtaatctgagtttgcggcacgggaatgccgaatagcgaagcgccgatgaccagggacgcaccgagccctgaaacacaggacccttgcaaaagcgaaaactcggtgattttttttccgttcgtctcaatgactcggcttccaaggcaaatggccccgatagccacgaacagccctccaagaaacgttccgctgccgactgacaagaggcctgctccaacgagaggtccaacggaattggcgacattgttcattcccgccgaaaaagcttctaaaaacccggttaaaatcaccagcgcagtaagcagccgcgcccatttttgctgtttgagccaccgcagcttcgcctcagtctttttcagcaattgtccaattaaaaaagcgagaaaaaatgcggcaatcggaatgatcagccaatacatgacgatcaccaaaagcttatcggtaaataccgcctgaaacgcgacgccgaccccgacaatcgagccgaccgtcacctcgctggttgaaagaggaatcccggcgatgttcgcgataaacagcgaaatcgcggatgatccaaggataatcacgacaatatgcacattgagaatagacgcgggaatgatgcctgaaccgattgttttcacaacctctcctccgcctatcatggcgcccagaaatacgccaattccgctgatccacaaggccgcctgccttttcctgacggcgcctgcgccatatgctattcccatcgacgctgctgctccgctcgctcctatgttcatggcaaaaaacaaagcgataatgaatgccaaaattgtaatcgtcattttttacccagctcctaccggaattgatgcagcccgcattctgttttttcctggtgggcccaccttcccgctcttaaattgccgctgtctgtcacgggaagcgtacacacctcacagccgatgctcggataatcttgatcatgaagcttgtgatacgtcagctgattcagcttaatgtaagtccagacatcctcccatgtccagtgaataagggggcagattttaatcagtttaaaattgtcgtccttgttgatatatcggacatgtttccgtgtttccgactgctcccgcctcagcccggtaatccaggcttccatgcctgacagatgctccctgagcggctcgattttgcgaaggcggcagcactggtccggctggcgcttccaaagttcgctgccatagcgtttttcctgctcttcaagtgagaggccgggttttaaaaagtggatcgacagaccgggatagcgatctttcacttcattgatcagctcatatgtttccggaaaatgcagtcctgtatctaaaaacacgatgtccgcttctttcacaacctttgaaatcaagtcgatcaaaacgattccttccgcgccgaagctgcaggcgtaaacgattttttgatacgtgctgtacgcccatttcaaaacgtccatctcgccgctgaaagtatccatcacctcttcagaagctttttcatcccatgtgctatacgttaaaacatcgttcatcgattttcccccaatacgtcctaaaggtttgttttcttatcctctgatacgaaacatgaactaaaagaacatataggcagattattcactttttagactaaatgtgatctggaaaatgttattatttcagcaattttgtgaatatccgaaagaccagatgcgcaagatcgaaatcaatcatattctctgcttgtggacctaaattaatagagcccaatttgatataccgaaatattatcagatgttaagcaagtatttcgcaatctgtcatggagaacaagtgaggaaccatatgaaaggacggcgaatatacttactttgacttcacaaaatggatagatacctagtgataagcaagtcaggcgataaggggctaacatgctgcctaatggggaggtgggcgaagatcactccttgccgaacggcaacacatgaatgagaaaaacgataaacggggaaagtgaattcttatcgtgacagctgaataatggccaacagacatttacctgaaagcaagaaagatacagtagattgtgaggggtaatcaatgatttcttctgaactgatactgcccgacaggcagcttaaaccaagaaagaaagggatcaccatcctgatcgataacggggttcccttgagcttttttaaagatacgattcacggagcggcagattatatagattttgtgaaatttggatggggaacgtctttgattacgaaatatttggaggaaaaaatcgatagtcttaggcagaatgacgttcaattcttttttgggggaacgttgtttgagaagtttttaagccaggataaaattgaagattactaccgctactgcaaattatatggatgccgttatgtcgaaatatcaaacggaacggtccgtctctctaataaagataaagcaagctttatttccgacttttcgaaagaatttcacgtgttcagcgaagtcggcagcaaagacagcaccctcagcagcgagctggagtcagccgaatggatcgattatatcctcgaagatcttgaagccggagccgagaaagtaatcacggaaacgagggaaagcggcacgagcgggctgtgcaaaagcgatggagaaatgcggtcccagcttattgaggagatccttcattccggtatcgcttcaggggatttaatttttgaagcgccgacaaaacagctgcagacgtgtttcattgaaaaaatcggtcctgacgccaatttggctaatattccgtttcaagatgccattccgcttgaaacgctgagactgggacttcgatcagatacattttatttatttgattaggttcgcttaaatagcggcctattttttgttgcggaaaccggcgataggcatcaataacggccggaagcgaatctgataaatcgcatcgatgatcctcgtagaaatccattggcagattaaggcctggataacgattccccaggcgatgacagacgcggtcaaaagaaaaatgaatgcattcatgataaacagcgcagttcccggttttccgccgcggtaaatcgatatcattaaagccaaggcgccaaaaccgccgttagaaatattatatttatatagcagtccaacccccgctcccaaaaggacggagccgtaaaataaatccagccagatattgttcgtcgtcataaccggcatacaggattcgaagatctgcaccgaaacggacgtcatggtaatcgcccccatcgtcccgaagactgtcacgggttcaagccatttaacggccgtcaaaaggagcgagaagttgacagcccagacggttaatccgtgcggaacctgaaaccagaaattgagcaaaacagcgatgccggctgcgccccctgaaggaatatggttcggaaacaaaaacagcgccataccgagaccctgcaacacgctgcccaacacaatagcatgtacgattttgagttttcttcccatacggatataatcccctttaaagtaacttgtcctctttcctactatatgtaaggggaaatgaaaaatatcacattttttcggggtggacgctgatcagatgtaagacgagccatcccacacatacgcttctacgagctctgtatcaatttcgattttgtcggggacttgaatgcagccgtcttttatgctgacgggcacgatttgtgcgaacggattctccatcgcatcccattcaagcggttcgatatcttctccgtccattttggtccaatgcggtaaacaggcttgtccgaaagcggcgtatattcttgaaagtccgccgtcatagctgtggggagagaccctttttccgaaatgcctggcgagcttcagaacggtttgaaattcgtccgtgccctcacagtgcataacatcgggctgggcaatatcgactgcgttctccagaaaaatcggcaaaaacggctttgcgccttttacgttttctcctccggcaaccggaacagaaagcgctgagcgcagcatccggtattcagctaggtcgtcaaacggcatgggctcttcaaaccaaagcacgttttgccagccggaaaaccacgtttcccacttgcgcgcggcggcctgatcataactctggtttgcatcgaggatcagtccggtgctttgccctgtcatctcctggaaggcctgaatatgtgccaagtcttctgaaaacatcttgcctcccgctttcagcttgactgccttaaatccggcccgaactgccttttcgataagccggagggaatggcggctccaatccggcctgtctgaatacgattggaatgacgcatataccgggatctgctcccgcagttttcctccccataattcgcataccgaaaggcctgcttttttcgccgtgatgtccgttaaagccatgcttacagcagaggcggcccgctgatgccattttttgatgacagtgatcagctccgttcgattgctcgcttcttttccaattaaataaggaatgatccgttttttaaagcctgcatccaaagcaggcagccaatccgcgcattctccccatcctgtcagacctgaagctgtcgtaatccgaatcagatagcttgttctgtagcttttcaatccgttcgcatcgccgtaaggggaggaaagcttgtggaacagcggaaatgtgtcaaccttttctatgcgcatgttttttcctttcctcctatcttgcgtcagccggctgcagccccttgtcccctttttttgtcgtgtcttcctttttgacgtgaatcatggtcagcacaagtacaccgacaatcaacgtcaggcccgctatggacataaacatgccgagtttcgaccattccatcagtctcccgaaaatcggcggtccgatggcgactcctaaaaatctgaccgaaccgtacagagatgtcacaaagccgcgcctctcttttccgacagccccggttatgaagctgttgacacatggcagaacaaagcctgtgccgatgctgctgatgacaaggatcgaaataaaaggaatgagcgcggagaaaaaagacagtgtgccgtaggaaaccgtaatcagagcgagtccgatgaccatcatctttttcatcagccgctgattttgtccgattttgctgcccgtaatatatgatgttgtacacatcacaagcagagggatcgccaaaatcagccctttttttacgccgtctgtatgatattctttttccaaaacatcggataagtaaaagaggatgccaaacagagtaaacaaacagacggctcctgcgagatatgcggtgaaaagccatctgccctcatgtttaaaaacgcttgtcagcccttttacatattttccaagaggcggcggatcttttttcttgtctttttctttaataaaaatccaagtcaaaatgatcggcgcaatacaaaaagccggaaatgcaaagaacacccaaaaccaagcgattaatgcaatcaatgatcctaaaataggagacagcacttttccgaagccgttcgaggcttcaacaagaccgagcacccggctttcgtcggcccctttaaaaaggtctcctgtcagcgccattgcgatcggcgctgtaccggctgccccgagcccttgcagtcctctcccgaacagcacccatgggaaggcattcgcaaaggtcgtcgatgcaaaccctgcaagaatcccccctgccccataaaggaacaggcacggaataatcaccactttccgtgagaagcggtcggccaaataaccgagcagcggaataaagagcgctgcagtgatcgaaaacactgtaatgacaaggctgacttgaaattgcgataaattgagttcggatttcattttcggcaaaatcggaatcagcatcgaatttcccaacgtcataatcaacgggatcgacccgatagcaacaaccgtcatgccagagttttgtttttctgccataagtttgtacatccttccttattcataatgaactataaaattggagttaactgctcgggttgcatccgtcatcagctgagcttcgtttccggccgtttttcaggttcgcgccggccgagccgttcagtatacaaatcgatatccaccgcatatctcggccttcttttcacttcggtgaaaatcgttccgatatattcgccgataatgccgatccccatcaattgcagaccgcccaaaaaccatatcgaaatgatcagcgaagcccagcctgcattcgtatacccgagcagtttttgaatcattgcataaatacccgcgatgcagcttaggaaaaataagaagaagccaatcagggtaaaaaatcggatcggagcgacactgaaagacgtaatcccgtgaaaagcgaaagacagcatttttttcagcggatatttcgtttctccagccatccgctcttttcggtcatagtacacttttgccgaccgaaggccgatcaggggcaccaaaccgcgcaggaaaacatttgcttctgcatagcggctgagctcctcaagcgcccgtttatttaaaagccgaaagtcggcatggttatcgaccagctggatgccaagcttattcatgatcttgtagaaccatccggctgtcgttcgtttaaaccatgtatccgtttggcggcttcggcgtacaccgtagacgatttcatagccttcatgatatttttcgataaaccggcgaatcgccgaaatgtcatcctgaagatcggcatcgattgaaataacgcaatcggatttttgctttgctttatcgagtccggctaacagagctttttgatgtcccgaattacgggccagcttcaagcctgtcacatagcggttttttgtgctttccatggcaatcagcggccatgtgcggtctgtcgatccatcatcgacaaataaaagcttgctctctgaagaaatcagtttatctgctgtgagatcatccaataccgcagtcagctgttttgcggtttcggcaaacacgtcctcttcgttataacagggtacgacgatcgtcagcaaaggctgttgaagattcaatttgcttcctccttatcgatgcttatttcgcttcatatacatagatgttccaagcggactgcgggtggctgaaccgctttaaaaacgcaagcttgttttgttctgcattcataatcggaactgaagaaaaaatatattgtccccccatttttttgaatgcttcagtgtttaactccaggttcgtgatttttttctttgtgctctttttgaacgcgtaatgttttccaagctcgtcaacaaacaagtagcagcggctcccccactcatcgaaatagcgcttcagggccggatttttatcaagctctttggcgatgattttccggaattgatacttgtatttcagtggataaatattggcatacgtatcaagtgtgtagaagccgttatactgcgcaatcgccggatgcaggccgatgctcgccacccggtaggaatcggtaggacggccgatgaatcgtttgatctgtttaaactgatctgatgcataaaattcccgaaagcttggggcgtggtggtatgcgccgtaagtcagctcttcatgaaacggaataagcacaagcagctgggcgattagtgcggcatgaacaaaacgccgccatctcttccccattttccacaatatgtagcatgcaacggcaaagcttgcgtatatcacaagagggcgcaaaaagtggaaacgggcgaaattgaatgccgaaagcagactgatcttttcctttggaagcgcccacagcttgttgaaccagagggcataccataaagaaagcgcataatttaaaatgaataaaaagatgaacagcttttcttcgcttggccgctttttgcgttgtctagcaacgacgagcccgaaagtgagcacaatcaaaggcagtatcactgccgtatggacggtcatgacatgattgtggccgagcacgaaatttttaaaggacaaccgaaacgaatgaaggatgtcatgcctggacgaaataaattcaacgcgatgcatcgtttcgcctgaagcgaaaaccgaataaacaagccggtattctatcgccaggaatatgcctgtcataagagcgatacttccgagaaagcgaaggttaaagctgcgctttgtgaccaaatcataaagccaaatcagcgaaacggcggcaaggaaaaagaagaaaccgagcacaaagcttgagtaaagcggtaaaagcgcaagggttgaccactctttccatgagtcgttccctgccctgatgtttaaaaaagcccataaggccaaagggtgaccaagcgtactaagcattcctgaaggccaaaagggtgtcagggcaaatgccagcgatacggcgattctgatgaaatacgccttttcatcgcgaatcacatggcttttcagcagcaggtacatcccgacaaaggcaaacaccctcgtgatcgtctggcttaaagcatatgcggtcatcgaaggaaacaaggcgtgaagccagacaatgccgctccattccgttccgtaagcgtcccgcggcaacccgttgatgatttgcggaatgacggctttaacgccgccgagcagctgcccgctttcggccagcaccttataccaggcgatattggaatccaggttgtcatgcacacggatatgagcgtcttcatttaatatgtaaagcggaaggacatagagaagaatgacactgaatgcgaaaatcaaatatcgcttttctctgctcaactttttgacgaataacgacacgaataccacatccattttgttctcttttggaaatatagagagcttttatcatatcgctgttattattcgtggaagcgttttgaaaaattcatcaaaatgaaaaaagctgcctgcttcaccagacagcttcgttttacaaattaccaagggtaagggtagaaaggataaaaaggataaaagaacggatagaagaatggatacggataaaacggcggcctcggtctagggcgcggtcttggccgcggataagggtagcccccataagtaaaaggctgctgtctatccggatccgcccagttatcttgattttgataagtttcttccactgttatagcctcctttagttgcttttcatactttaggttatgctatatcccataaaatggagtaagtacacaatttttcacagataactttgggcggcagtccgaagatcagccagaaggcgaaagcactgaatcaaaaaaacaaaacagcctgccccgtcaacctaaaaataaggtcgcgggacaggctttcatttatatgatgtgaatacccctttgtttttaaggcagtacagagctccccattaaatatttgtcaacttcacgggcgacttcgcgtccctcgtgaatcgcccaaacgatcaggctttgtcctcttctcgcatcccctgctgcgaagactccatcgacatttgttttaaattccccgtatgctgcgtcaactttatttctcaccgtatttaccccgaactgctcaagcagcggctgttccgttccttcaaagccgatggcgataaagacgtattgagcaggccatactttttccgttcccggaatttcgtggaactcaaatttcccttgatcattctttacttttttcatttgaatcgtatgcagttctttcaaatggccgtttttatctgcgacaagcttttttgtttggatcgaatattgtctcggatcgtttccgaatactgcttgcgcctcttcataggcatagtccagcgtatggacatgcggctgttccggccacatattttcggcggtccttgtatcgggcagcttcggatgcttgccgaattggacgacgcttcgcgctttttggcgcagggccgttgcaacgcagtctgcccccgtgtcaccgccgccgatgacgatgacgtctttatttttcgtattgataaactgcttatctttaaaattcgaatcgagcatgcttttaatggtgcctgttaaatagtccatggcaaagtggacaccttttgcttcacggccttcaatcaagagatcgcgctgtttttgggcccctgtgcaaaggataatcgcatcgtactgttcttttagttcgtcggctgtaatatctttgccgatttccgtattggtgacaaagtcgacgccttcctgtgtcaacagtttgatgcggcgttcgacaacgcttttttcgagcttcatgctcgggatgccgtacattaacaggcctcccgggcggtcgctgcgctcataaacagtgaccgaatgccccgcctggttcaattgatcggcgcttgcaagacc

(The sequence listing continues in the following parts.)

What is claimed is:

1. An isolated polypeptide having cellulose 1,4-beta-cellobiosidase activity, selected from the group consisting of:
   (a) a polypeptide having cellulose 1,4-beta-cellobiosidase activity comprising an amino acid sequence having at least 95% identity with the amino acid sequence of SEQ ID NO: 5979; and
   (b) a polypeptide having cellulose 1,4-beta-cellobiosidase activity encoded by a gene comprising a nucleotide sequence which hybridizes under high stringency conditions with the nucleotide sequence of SEQ ID NO: 1782, or the full-length complementary strand thereof, wherein high stringency conditions are defined as prehybridization and hybridization at 42° C. in 5×SSPE, 0.3% SDS, 200 µg/ml sheared and denatured salmon sperm DNA, and 50% formamide, and washing three times each for 15 minutes using 2×SSC, 0.2% SDS at 65° C.

2. The polypeptide having cellulose 1,4-beta-cellobiosidase activity of claim 1, which comprises an amino acid sequence having at least 95% identity with the amino acid sequence of SEQ ID NO: 5979.

3. The polypeptide having cellulose 1,4-beta-cellobiosidase activity of claim 1, which is encoded by a gene comprising a nucleotide sequence which hybridizes under high stringency conditions with the nucleotide sequence of SEQ ID NO: 1782, or the full-length complementary strand thereof, wherein high stringency conditions are defined as prehybridization and hybridization at 42° C. in 5×SSPE, 0.3% SDS, 200 µg/ml sheared and denatured salmon sperm DNA, and 50% a formamide, and washing three times each for 15 minutes using 2×SSC, 0.2% a SDS at 65° C.

4. The polypeptide having cellulose 2,4-beta-cellobiosidase activity of claim 1, which is encoded by a *Bacillus licheniformis* ATCC 14580 gene.

5. The polypeptide having cellulose 1,4-beta-cellobiosidase activity of claim 2, which comprises an amino acid sequence having at least 97% a identity with the amino acid sequence of SEQ ID NO: 5979.

6. The polypeptide having cellulose 1,4-beta-cellobiosidase activity of claim 1, which comprises the amino acid sequence of SEQ ID NO: 5979.

7. The polypeptide having cellulose 1,4-beta-cellobiosidase activity of claim 1, which consists of the amino acid sequence of SEQ ID NO: 5979, or a fragment thereof which retains cellulose 1,4-beta-cellobiosidase activity.

* * * * *

UNITED STATES PATENT AND TRADEMARK OFFICE
CERTIFICATE OF CORRECTION

PATENT NO. : 7,494,798 B2  Page 1 of 1
APPLICATION NO. : 10/983128
DATED : February 24, 2009
INVENTOR(S) : Berka et al.

It is certified that error appears in the above-identified patent and that said Letters Patent is hereby corrected as shown below:

In the claims:

Claim 4, line 49, remove cellulose 2, and insert cellulose 1

Signed and Sealed this

Fifth Day of January, 2010

David J. Kappos
*Director of the United States Patent and Trademark Office*

UNITED STATES PATENT AND TRADEMARK OFFICE
CERTIFICATE OF CORRECTION

PATENT NO.         : 7,494,798 B2                                                                 Page 1 of 1
APPLICATION NO.    : 10/983128
DATED              : February 24, 2009
INVENTOR(S)        : Berka et al.

It is certified that error appears in the above-identified patent and that said Letters Patent is hereby corrected as shown below:

In the claims:

Column 268, Claim 4, line 49, remove cellulose 2, and insert cellulose --1--

This certificate supersedes the Certificate of Correction issued January 5, 2010.

Signed and Sealed this

Twenty-sixth Day of January, 2010

David J. Kappos
*Director of the United States Patent and Trademark Office*